US012807523B2

(12) United States Patent
Jaffé et al.

(10) Patent No.: US 12,807,523 B2
(45) Date of Patent: Nov. 24, 2026

(54) ENHANCING AMMONIUM OXIDATION AND FLUOROCHEMICAL DEGRADATION WITH FERRIC IRON PHASE COMPRISING POLYMERIC COATINGS

(71) Applicant: THE TRUSTEES OF PRINCETON UNIVERSITY, Princeton, NJ (US)

(72) Inventors: Peter R. Jaffé, Princeton, NJ (US); Bruce E. Koel, Princeton, NJ (US)

(73) Assignee: THE TRUSTEES OF PRINCETON UNIVERSITY, Princeton, NJ (US)

(*) Notice: Subject to any disclaimer, the term of this patent is extended or adjusted under 35 U.S.C. 154(b) by 405 days.

(21) Appl. No.: 18/533,781

(22) Filed: Dec. 8, 2023

(65) Prior Publication Data

US 2024/0190735 A1 Jun. 13, 2024

Related U.S. Application Data

(60) Provisional application No. 63/431,370, filed on Dec. 9, 2022.

(51) Int. Cl.
*C02F 1/72* (2023.01)
*C02F 101/16* (2006.01)

(52) U.S. Cl.
CPC ............ *C02F 1/72* (2013.01); *C02F 2101/16* (2013.01); *C02F 2305/02* (2013.01)

(58) Field of Classification Search
CPC ..... C02F 1/72; C02F 2101/16; C02F 2305/02
See application file for complete search history.

(56) References Cited

PUBLICATIONS

Wan, et al., "Anaerobic ammonium oxidation coupled to Fe(III) reduction: Discovery, mechanism and application prospects in wastewater treatment," Sci. of the Total Environ., 818:151687, 1-12 (Year: 2022).*

* cited by examiner

*Primary Examiner* — Patrick Orme
(74) *Attorney, Agent, or Firm* — J. Clinton Wimbish; Maynard Nexsen PC

(57) ABSTRACT

Media are described herein for the degradation and/or remediation of ammonium, ammonium containing contaminants and/or fluorochemicals. A medium, in some embodiments, comprises an electron donor, an electron acceptor comprising iron particles having a polymeric coating, and a Feammox bacterium and/or one or more enzymes capable of oxidizing the electron donor coupled with reduction of Fe(III) of the iron particles to Fe(II). The electron donor, in some embodiments, comprises ammonium, an ammonium containing compound, and/or molecular hydrogen. The medium, in some embodiments, further comprises a fluorochemical component, and the Feammox bacterium and/or one or more enzymes exhibit reductive dehalogenase activity capable of fluorochemical degradation in conjunction with oxidation of the electron donor and electron transfer to the electron acceptor.

30 Claims, 13 Drawing Sheets

Specification includes a Sequence Listing.

ENHANCING AMMONIUM OXIDATION AND FLUOROCHEMICAL DEGRADATION WITH FERRIC IRON PHASE COMPRISING POLYMERIC COATINGS

RELATED APPLICATION DATA

The present application claims priority pursuant 35 U.S.C. § 119(e) to U.S. Provisional Patent Application Ser. No. 63/431,370 filed Dec. 9, 2022 which is incorporated herein by reference in its entirety.

STATEMENT REGARDING FEDERALLY SPONSORED RESEARCH OF DEVELOPMENT

This invention was made with government support under Grant No. ES032694 awarded by the National Institutes of Health. The government has certain rights in the invention.

SEQUENCE LISTING

The content of the electronic sequence listing (SL-060017-00235.xml; Size 2.13 MB; Date of Creation: Dec. 21, 2023) submitted herewith, is herein incorporated by reference in its entirety.

FIELD

The present invention relates to systems and methods for the degradation of ammonium and fluorochemicals and, in particular, to systems and methods employing microorganisms for ammonium and fluorochemical degradation.

BACKGROUND

The removal of ammonium and other contaminants from soil and water is an important environmental task. Wastewater treatment plants in the developed world and in many developing countries oxidize $NH_4^+$ to $NO_3^-$ before discharging the treated wastewater. This is done to decrease oxygen demand in the receiving waters. Additionally, nitrogen excess in near shore environments has been identified as a major environmental problem leading to eutrophication and anoxia. Legislations are being implemented requiring the conversion of $NO_3^-$ to $N_2$ in conventional waste water treatment plants. The nitrogen compounds that are present in contaminated water, such as ammonium $NH_4^+$, nitrite ($NO_2^-$) and nitrate ($NO_3^-$) will have to be converted to elemental nitrogen $N_2$, which can be released in the gaseous state into an open environment.

Moreover, per- and polyfluoroalkyl substances (PFAS) are emerging contaminants present in many consumer goods. These fluorochemicals are of significant concern due to their potential health effects. Because of their high water solubility, they are ubiquitous in drinking water sources, including groundwater, which becomes the main source of exposure to humans. Efforts in sustainable manufacturing of chemical compounds require that compounds for release into the environment are degradable. PFAS are very stable and little is known about their biodegradability. Even less is known about their mineralization (complete biodegradation to $CO_2$, $F^-$, and water, etc).

Release of polyfluoroalkyl chemicals into the environment can result in the formation of perfluoroalkyl carboxylic (PFCAs) and sulfonic acids (PFSAs), such as perfluorooctanoic acid (PFOA) and perfluorooctane sulfonic acid (PFOS). These compounds are highly persistent and detected widely in the environment. It is unclear if these smaller moieties can be mineralized and, so far, a lack of mineralization data has been reported. Moreover, multiple studies on the degradation of various PFAS concluded that these compounds are stable in the environment.

SUMMARY

In view these problems, media are described herein for the degradation and/or remediation of ammonium, ammonium containing contaminants and/or fluorochemicals. A medium, in some embodiments, comprises an electron donor, an electron acceptor comprising iron particles having a polymeric coating, and a Feammox bacterium and/or one or more enzymes capable of oxidizing the electron donor coupled with reduction of Fe(III) of the iron particles to Fe(II). The electron donor, in some embodiments, comprises ammonium or an ammonium containing compound. Alternatively, the electron donor can comprise molecular hydrogen or a mixture of molecular hydrogen with ammonium or the ammonium containing compound. The medium, in some embodiments, further comprises a fluorochemical component, and the Feammox bacterium and/or the one or more enzymes exhibit reductive dehalogenase activity capable of fluorochemical degradation in conjunction with oxidation of the electron donor and electron transfer to the electron acceptor. Moreover, the Feammox bacterium, in some embodiments, comprises an Acidimicrobiaceae bacterium.

In another aspect, systems for environmental remediation are provided. A system, in some embodiments, comprises a reactor, the reactor including one or more containers comprising a medium including and electron donor, an electron acceptor comprising iron particles having a polymeric coating, and a Feammox bacterium and/or one or more enzymes capable of oxidizing the electron donor coupled with reduction of Fe(III) of the iron particles to Fe(II). As described herein, the electron donor can comprise ammonium, an ammonium containing compound, molecular hydrogen, or various mixtures thereof. The medium can further comprise a fluorochemical component, and the Feammox bacterium and/or one or more enzymes exhibit reductive dehalogenase activity capable of fluorochemical degradation in conjunction with oxidation of the electron donor and electron transfer to the electron acceptor.

In another aspect, methods of environmental remediation are described herein. In some embodiments, a method of environmental remediation comprises providing a medium including an electron donor and a fluorochemical component, and disposing a Feammox bacterium and/or one or more enzymes exhibiting reductive dehalogenase activity in the medium. The fluorochemical component is degraded by the Feammox bacterium and/or enzyme(s) in conjunction with oxidation of the electron donor and electron transfer to an electron acceptor comprising iron particles, wherein electron transfer to the iron particles is enhanced by providing the iron particles a polymeric coating. In another aspect, a method of ammonium oxidation comprises providing a medium including an electron donor comprising ammonium or an ammonium containing compound, an electron acceptor comprising iron particles, and a Feammox bacterium and/or one or more enzymes. The ammonium or ammonium containing compound is oxidized by the Feammox bacterium and/or one or more enzymes coupled with reduction of Fe(III) of the iron particles to Fe(II), wherein electron transfer to the Fe(III) is enhanced by providing the iron particles a polymeric coating. For methods described herein, the polymeric coating of the iron particles, for example, can lower the charge transfer resistance to the iron particles from the Feammox bacterium and/or enzymes.

In some embodiments, of media, systems, and methods described herein, a medium further comprises one or more oxidants operable to oxidize Fe(II), thereby regenerating Fe(III). Any oxidant consistent with the technical objectives described herein can be employed. In some embodiments, for example, the oxidant is elemental sulfur as disclosed in U.S. patent application Ser. No. 16/651,737 which is incorporated herein by reference in its entirety.

These and other embodiments are further illustrated and detailed in the following detailed description.

BRIEF DESCRIPTION OF THE DRAWINGS

The present disclosure can be better understood, by way of example only, with reference to the following drawings. The elements of the drawings are not necessarily to scale relative to each other, emphasis instead being placed upon clearly illustrating the principles of the disclosure. Furthermore, like reference numerals designate corresponding parts throughout the several views.

DETAILED DESCRIPTION

Figure 1:
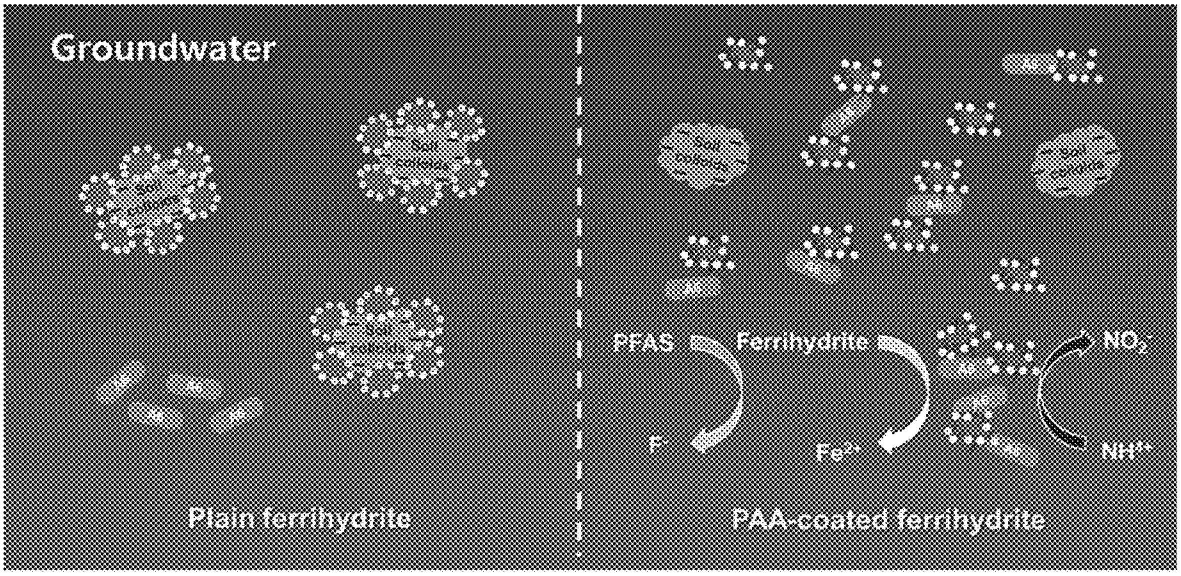
FIG. 1 is a schematic depiction of PAA-coated ferrihydrite as an electron acceptor for *Acidimicrobium* sp. Strain A6 to bioremediate PFAS in sediments or aquifers.

Embodiments described herein can be understood more readily by reference to the following detailed description and examples and their previous and following descriptions. Elements and apparatus described herein, however, are not limited to the specific embodiments presented in the detailed description. It should be recognized that these embodiments are merely illustrative of the principles of the present invention. Numerous modifications and adaptations will be readily apparent to those of skill in the art without departing from the spirit and scope of the invention.

In one aspect, media are described herein for the degradation and/or remediation of ammonium, ammonium containing contaminants and/or fluorochemicals. A medium, in some embodiments, comprises an electron donor, an electron acceptor comprising iron particles having a polymeric coating, and a Feammox bacterium and/or one or more enzymes capable of oxidizing the electron donor coupled with reduction of Fe(III) of the iron particles to Fe(II). The electron donor, in some embodiments, comprises ammonium or an ammonium containing compound. Alternatively, the electron donor can comprise molecular hydrogen or a mixture of molecular hydrogen with ammonium or the ammonium containing compound. The medium, in some embodiments, further comprises a fluorochemical component, and the Feammox bacterium and/or the one or more enzymes exhibit reductive dehalogenase activity capable of fluorochemical degradation in conjunction with oxidation of the electron donor and electron transfer to the electron acceptor. As described herein, when degrading fluorochemicals, electron transfer is to Fe(III) of the polymeric coated iron particles, resulting in Fe(II) production.

Turning now to specific components, the electron donor can comprise ammonium or an ammonium containing compound. An ammonium containing compound may be a contaminant from an industrial, agricultural or human municipal waste source. Ammonium containing contaminants, for example, can comprise fertilizers, domestic sewage, or industrial effluents. The ammonium containing contaminant may comprise ammonium chloride and/or any other ammonium salt. The ammonium containing contaminant may also be a nitrogen containing organic compound, wherein nitrogen may be hydrolyzed to ammonium. Alternatively, the electron donor can comprise molecular hydrogen or a mixture of molecular hydrogen with ammonium or the ammonium containing compound.

The fluorochemical component of the medium, when present, can comprise one or more fluorinated organic compounds. In some embodiments, the fluorochemical component comprises one or more fluorochemicals selected from the group consisting of perfluoroalkyl compounds, polyfluoroalkyl compounds, fluorinated carboxylic acids, fluorinated alcohols, and fluorinated sulfonates. In some embodiments, the fluorochemical component comprises one or more compounds selected from the following Table:

TABLE

| Fluorochemicals |
|---|
| Heptafluorobutyric acid (HFBA) |
| Perfluorooctanoic acid (PFOA) |
| 2,2,2-Trifluoroethyl Nonafluorobutanesulfonate (PFBS) |
| 6:2 Fluorotelomer sulfonate (6:2 FTS) |
| 8:2 Fluorotelomer Alcohol (8:2 FTOH) |
| Ammonium 4,8-dioxa-3H-perfluorononanoate (ADONA) |
| Perfluorobutanoic acid (PFBA) |
| Perfluorooctane sulfonamide (FOSA) |
| Perfluorooctane sulfonate (PFOS) |
| Perfluoroheptane sulfonate (PFHpS) |
| Perfluorohexane sulfonate (PFHxS) |
| Perfluoropentanoic acid (PFHeA) |
| Perfluoroheptanoic acid (PFHpA) |
| Perfluorohexanoic acid (PFHxA) |
| Perfluoropentane sulfonate (PFPeS) |
| Pentafluoropropionic acid (PFPrA) |
| 6:2 Fluorotelomer alcohol (6:2 FTOH) |
| 8:2 Fluorotelomer phosphate diester (8:2 diPAP) |
| 8:2 Fluorotelomer sulfonate (8:2 FTS) |

As described herein, the medium also includes an electron acceptor comprising iron particles having a polymeric coating, the iron particles including at least some iron in the +3 oxidation state, Fe(III). In some embodiments, the electron acceptor particles comprise iron oxide, a goethite, elemental iron, a nontronite, iron-rich clay or various mixtures thereof. Iron oxide can include hydrated forms, such as ferrihydrite. Ferrihydrite includes a dark brown or yellow brown mineral composed of about 20% ($FeO_4$) and 80% ($FeO_6$) polyhedral. The term "goethite" refers to an iron oxyhydroxide containing ferric iron. The term "nontronite" refers to the Fe(III) rich clay mineral having a typical structural formula $Ca_{0.5}(Si_7Al_{0.8}Fe_{0.2})(Fe_{3.5}Al_{0.4}Mg_{0.1})O_{20}(OH)_4$. The Fe(III) source may be scrap metal, or any other source of ferric iron.

The electron acceptor iron particles have a polymeric coating associated with one or more surfaces of the particles. In some embodiments, the iron particles are encapsulated by the polymeric coating. In other embodiments, the iron particles are partially coated by the polymeric coating. Any polymeric coating consistent with the technical objectives described herein can be employed. In some embodiments, polymer of the polymeric coating comprises one or more negatively charged moieties. Negatively charged moieties can reside on or in the polymer backbone or can be pendant to the polymer backbone. Negatively charged moieties, in some embodiments, can include carboxylate, sulfonate, and/or phosphonate. In some embodiments, such moieties are negative at certain pH values of the medium. The negatively charged moieties, for example, can exhibit a pKa of 4-7. Below the pKa, the moieties are protonated and, therefore, do not exhibit negative charge. Polymeric species of the coating can include, polyacrylates, such as polyacrylic acid (PAA), polymethacrylic acid (PMAA), or copolymers thereof. Polymeric species of the coating can also comprise polysulfonic acids, such as vinylsulfonic acid, polystyrene sulfonic acid (PSSA), or poly(2-acrylamido-2-methyl-1-propanesulfonic acid (PAMPSA). Polymeric species of the coating can also include polyphosphonic acid, such as poly(vinylphosphonic acid). The polymer of the coating can have any desired molecular weight. In some embodiments, polymer of the coating has a weight average molecular weight of 2,000 to 500,000 Da.

The polymeric coating can be present at any desired ratio to the iron particles. In some embodiments, the ratio of polymer coating mass to iron particle mass ranges from 1:100 to 1:5. The following table provides additional ratios of polymer coating mass to iron particle mass, according to some embodiments.

TABLE

| Ratio of Polymer Mass to Iron Particle Mass |
|---|
| 1:50 |
| 1:30 |
| 1:20 |
| 1:15 |
| 1:10 |
| 1:5 |

The polymer coated iron particles of the medium, in some embodiments, exhibit negative zeta potential. As described further herein, the absolute value of the negative zeta potential can increase as the ratio of polymer mass to iron particle mass increases. In some embodiments, the coated iron particles exhibit a zeta potential of −5 to −30 or −10 to −25. Moreover, in some embodiments, the polymer coating exhibits porosity and associated pore structures.

The medium also comprises a Feammox bacterium and/or enzyme(s) thereof capable of fluorochemical degradation in conjunction with oxidation of the electron donor (e.g. ammonium, hydrogen) and electron transfer to the electron acceptor. The Feammox bacterium may be an Actinobacterium or a bacterium with a similar genetic composition. In some embodiments, for example, the Feammox bacterium is an Acidimicrobiaceae bacterium or variant thereof. The Feammox bacterium may be a bacterial strain that was isolated from wetland soils collected in New Jersey after a series of enrichment incubations. The soil samples were collected at the location identified as 40° 15' N-74° 30' W or within 100 m of the identified location. The Feammox bacterium may be the bacterial strain designated the Acidimicrobiaceae Feammox bacterium A6 or variant thereof. In being a variant in some embodiments, the bacterium may have at least 70% genome overlap with an Actinobacterium. The Acidimicrobiaceae Feammox bacterium A6 was submitted for deposit with the American Type Culture Collection (ATCC; 10801 University Blvd. Manassas, Virginia 20110-2209, USA) on Apr. 27, 2015, the submission was supplemented on May 7, 2015, and was assigned Accession Deposit Number PTA-122488 on Sep. 17, 2015. The Acidimicrobiaceae Feammox bacterium may have a genome comprising, consisting essentially of, or consisting of a nucleic acid sequence with at least 70, 72, 75, 80, 85, 90, 91, 92, 93, 94, 95, 96, 97, 98, 99, or 100% identity to SEQ ID NO: 1. The Feammox bacterium may have the genome size of 3.3 mega base pairs (Mb) and guanine-cytosine content 52%. The bacterial genome may further include a gene encoding a Feammox Ammonium Monooxygenase. As used herein, the term "Feammox Ammonium Monooxygenase" (FMO) refers to an enzyme that plays a key role in oxidizing ammonium coupled with ferric iron reduction. The FMO also refers to genes encoding clones or different variants of the Feammox Ammonium Monooxygenase. The gene may include a nucleic acid comprising, consisting essentially of, or consisting of a nucleic acid sequence with at least 70, 72, 75, 80, 85, 90, 91, 92, 93, 94, 95, 96, 97, 98, 99, or 100% identity to a sequence selected from the group consisting of: SEQ ID NOS: 8-28. The Feammox Ammonium Monooxygenase may include an amino acid comprising, consisting essentially of, or consisting of a nucleic acid sequence with at least 70, 72, 75, 80, 85, 90, 91, 92, 93, 94, 95, 96, 97, 98, 99, or 100% identity to a sequence selected from the group consisting of: SEQ ID NOS: 29-49. The Feammox bacterium may be live or lyophilized.

SEQ ID NOS of FMO Related Enzymes and Genes

| FMO clone* | SEQ ID NO (Gene) | SEQ ID NO (Enzyme) |
|---|---|---|
| ERCFMO_0001 | 8 | 29 |
| ERCFMO_0002 | 9 | 30 |
| ERCFMO_0003 | 10 | 31 |
| ERCFMO_0004 | 11 | 32 |
| ERCFMO_0005 | 12 | 33 |
| ERCFMO_0006 | 13 | 34 |
| ERCFMO_0007 | 14 | 35 |
| ERCFMO_0008 | 15 | 36 |
| ERCFMO_0009 | 16 | 37 |
| ERCFMO_0010 | 17 | 38 |
| ERCFMO_0011 | 18 | 39 |
| ERCFMO_0012 | 19 | 40 |
| ERCFMO_0013 | 20 | 41 |
| ERCFMO_0014 | 21 | 42 |
| ERCFMO_0015 | 22 | 43 |
| ERCFMO_0016 | 23 | 44 |
| ERCFMO_0017 | 24 | 45 |
| ERCFMO_0018 | 25 | 46 |
| ERCFMO_0019 | 26 | 47 |
| ERCFMO_0020 | 27 | 48 |
| ERCFMO_0021 | 28 | 49 |

In some embodiments, Feammox bacteria and related enzymes are described in U.S. Pat. No. 9,815,723 which is incorporated herein by reference in its entirety.

Determining percent identity of two nucleic acid sequences may include aligning and comparing the nucleotides at corresponding positions in the two sequences. If all positions in two sequences are occupied by identical nucleotides then the sequences are said to be 100% identical.

Percent identity may be measured by the Smith Waterman algorithm (Smith T F, Waterman M S 1981 "Identification of Common Molecular Subsequences," *J Mol Biol* 147: 195-197, which is incorporated herein by reference as if fully set forth).

Additionally, Feammox bacteria and/or related enzymes described herein may undergo alterations or modifications during the fluorochemical degradation process. Alterations or modifications to the Feammox bacteria and/or related enzymes can be dependent on reactions conditions, in some embodiments. For example, in the presence of molecular hydrogen as the electron donor, the Feammox bacteria can lose its plasmid and the concomitant ability to oxidize ammonium. As the plasmid is distinct from chromosomal DNA, the loss of the plasmid does not render the Feammox bacteria a different organism falling outside the claims and scope of the present disclosure. Notably, methods and systems described herein contemplate alterations and/or modifications to Feammox bacteria and/or related enzymes resulting from the reaction conditions and/or the degradation of fluorochemicals.

As described herein, the medium may comprise one or more enzymes, such as FMO, in addition to the Feammox bacterium for the degradation of fluorochemical(s) in conjunction with oxidation of the electron donor and electron transfer to the electron acceptor. Alternatively, one or more enzymes, such as FMO, can be present in the medium in the absence of the Feammox bacterium. In such embodiments, the one or more enzymes can be responsible for fluorochemical degradation. In some embodiments, for example, FMO is isolated from Feammox bacterium and employed in the media. In other embodiments, the one or more enzymes may be fabricated via synthetic chemical techniques.

In some embodiments, the medium comprises one or more enzymes exhibiting reductive dehalogenase activity for fluorochemical degradation including, but not limited to, one or more reductive dehalogenases and/or reductive dehalogenase variants. Dehalogenase content of the medium can be expressed by one or more bacterium in the medium including, but not limited to, Feammox bacteria. In some embodiments, one or more dehalogenases and/or enzymes exhibiting dehalogenase activity are present in the medium in the absence of bacteria or other expressing species. Suitable enzymes are described in U.S. patent application Ser. No. 17/279,918 which is incorporated herein by reference in its entirety.

In some embodiments, the medium further comprises one or more electron shuttling compounds. Any electron shuttling compound consistent with the objectives of fluorochemical degradation can be used. In some embodiments, an electron shuttling compound is 9,10-Anthraquinone-2,7-disulphonic acid (AQDS).

The medium can comprise water, soil, sludge, sorbents and/or any solids contaminated with fluorochemicals and/or ammonium containing compounds. The water can be any source of water, including ground water, lakes, streams and/or reservoirs. In some embodiments, the water is wastewater. As used herein, the term "wastewater" refers to any water that has been adversely affected in quality by anthropogenic influence. Wastewater may be municipal wastewater, industrial wastewater, agricultural wastewater, surface runoff, stormwater, or wastewater combining wastewater from multiple sources. Wastewater may be treated in a wastewater treatment plant. Similarly, soil may be any soil that has been adversely affected in quality by anthropogenic influence. The soil may include groundwater. The groundwater may comprise wastewater described herein. In some embodiments, the medium has a pH of 4 to 7.

In some embodiments, the medium may further comprise a carrier. The carrier may support growth of the Feammox bacterium. The carrier may comprise a filter, beads, agarized medium, or any surface that allows bacterial attachment. The carrier may include media for culturing the Feammox bacterium. The media may be inorganic $NH_4^+$-ferric iron media. The inorganic $NH_4^+$-ferric iron media may be solid media or liquid media. The liquid media may include but not limited to the following components: $NH_4Cl$, $(NH_4)_2SO_4$, $NaHCO_3$, $KHCO_3$, $KH_2PO_4$, 100 mg $MgSO_4 \cdot 7H_2O$, and $CaCl_2 \cdot 2H_2O$. The liquid media may further include ferrihydrite, AQDS, trace element solution or vitamins. Vitamins may be but are not limited to ATCC® vitamins. The liquid media may have a pH in a range from 2.0 to 8.0 or 4.0 to 7.0. The media may include traces of dissolved oxygen. The solid medium may have the same composition as the liquid media but include elements to solidify the mixture. The solid media may be solidified with 0.8% agar. The solid media may include ferrihydrite that is spread on the surface of the medium.

II. Systems for Environmental Remediation

In another aspect, systems for environmental remediation are provided. A system, in some embodiments, comprises a reactor the reactor including one or more containers comprising a medium including and electron donor, an electron acceptor comprising iron particles having a polymeric coating, and a Feammox bacterium and/or one or more enzymes capable of oxidizing the electron donor coupled with reduction of Fe(III) of the iron particles to Fe(II). As described herein, the electron donor can comprise ammonium, an ammonium containing compound, molecular hydrogen, or various mixtures thereof. The medium can further comprise a fluorochemical component, and the Feammox bacterium and/or one or more enzymes exhibit reductive dehalogenase activity capable of fluorochemical degradation in conjunction with oxidation of the electron donor and electron transfer to the electron acceptor. In such embodiments, Fe(III) of the electron acceptor polymer coated iron particle is reduced to Fe(II)

In some embodiments, the reactor comprises an inlet and outlet for the medium, such as a water and/or soil. The reactor, for example, can be operated continuously or in a batch, mode. Components of the medium, including the ammonium component or electron donor, fluorochemical component, electron acceptor and Feammox bacterium and/or enzyme(s) thereof can have any properties and/or compositions described in Section I hereinabove. Moreover, the medium can comprise water, soil, sludge, sorbents, and/or any solid contaminated with one or more fluorochemicals. Water of the system can be any source of water, including wastewater, ground water, lakes, streams and/or reservoirs.

The reactor may be a continuous reactor or a batch reactor. In an embodiment, a reactor may be an industrial-type reactor. The reactor may operate within a water treatment plant. The reactor may be a treatment pond or a reservoir. The reactor may be a tank for wastewater storage.

Reactor conditions may generally include a temperature in a range from 4° C. to 35° C. The temperature may be in a range between any two integer value temperatures selected from 4° C. to 35° C. The temperature may be in a range between and including 4° C. to 10° C., 10° C. to 15° C., 15° C. to 20° C., 20° C. and 25° C., 25° C. and 30° C., 30° C. and 35° C. The temperature may be any one integer value temperature selected from those including and between 4° C. and 35° C. or 15° C. to 35° C. Temperatures between room temperature and 35° C. may be used. The temperature may be any one temperature including and between room temperature and 35° C. Temperatures between 20° C. and 35° C. may be used. The temperature may be any temperature including and between 20° C. and 25° C.

The reactor may be operated for any desired time period. In some embodiments, the reactor is operated for a time period ranging from 2 hours to 45 days. The time period may be 5 hours, 10 hours, 15 hours, 20 hours, 1 day, 2 days, 3 days, 4 days, 5 days, 10 days, 15 days, 20 days, 25 days, 30 days, 35 days, 40 days or 45 days. The time period may be any one integer value selected from those including and between value points, endpoints inclusive. The time period may be greater than 45 days. The time period may be less than 1 day. In continuous flow reactors or in batches, the process may last from several hours to several months. For continuous flow reactors, the time period may depend on the bacterial concentration in the inoculum. Higher bacterial concentration in the inoculum may result in a shorter remediation time. The time period may depend on hydraulic retention capacity of a continuous flow reactor. Lower retention capacity of the continuous flow reactor may result in a shorter remediation time. Hydraulic residence time for the continuous flow reactors may be from 3 hours to 4 hours, from 3 hours to 5 hours, from 3 hours to 6 hours, from 3 hours to 7 hours, from 3 hours to 8 hours, from 3 hours to 10 hours, from 3 hours to 15 hours, from 3 hours to 20 hours, from 3 hours to 1 day, from 3 hours to 2 days, from 3 hours to 3 days or longer. Hydraulic residence time may be any integer value selected from those including and between value points, endpoints inclusive pH of the medium in the reaction can range from 2.0 to 8.0 or 4.0 to 7.0.

III. Methods of Environmental Remediation

In another aspect, methods of environmental remediation are described herein. In some embodiments, a method of environmental remediation comprises providing a medium including an electron donor and a fluorochemical component, and disposing a Feammox bacterium and/or one or more enzymes exhibiting reductive dehalogenase activity in the medium. The fluorochemical component is degraded by the Feammox bacterium and/or enzyme(s) in conjunction with oxidation of the electron donor and electron transfer to an electron acceptor comprising iron particles, wherein electron transfer to the iron particles is enhanced by providing the iron particles a polymeric coating. In another aspect, a method of ammonium oxidation comprises providing a medium including an electron donor comprising ammonium or an ammonium containing compound, an electron acceptor comprising iron particles, and a Feammox bacterium and/or one or more enzymes. The ammonium or ammonium containing compound is oxidized by the Feammox bacterium and/or one or more enzymes coupled with reduction of Fe(III) of the iron particles to Fe(II), wherein electron transfer to the Fe(III) is enhanced by providing the iron particles a polymeric coating. Media in methods described herein can have any composition and/or properties described in Section I above.

These and other embodiments are further illustrated by the following non-limiting examples.

Example 1—Materials and Methods

Poly-Acrylic Acid (PAA) Coating with Ferrihydrite

PAAs with four different molecular weights (i.e., 2.1K, 6K, 240K, and 450K) were employed to modify the surface of a 2-line ferrihydrite. Sodium PAA with a molecular weight of 6,000 (PAA 6K) was supplied by Polysciences as a white powder. Sodium PAA with molecular weights of 2,100 (powder, PAA 2.1K), 240,000 (PAA 240K, 25 wt. % in $H_2O$), and 450,000 (powder, PAA 450K, ~0.2% cross-linked) were purchased from Sigma Aldrich. All PAA stock solutions were prepared with deionized water unless otherwise specified.

A suspension of 2-line ferrihydrite at a concentration of 10 g/L was treated (coated) with PAA by adding a PAA solution until the final solid content reached 2.15 g/L. The coating process was conducted using an $NH_4^+$ enrichment salt medium, referred to as the A6 growth medium, which is composed of 3.82 mM $NH_4Cl$, 0.59 mM $(NH_4)_2SO_4$, 0.24 mM $NaHCO_3$, 0.71 mM $KHCO_3$, 0.07 mM $KH_2PO_4$, 0.41 mM $MgSO_4 \cdot H_2O$, and 0.40 mM $CaCl_2 \cdot 2H_2O$. PAA with four different molecular weights were utilized to coat ferrihydrite in the A6 growth medium at pH 5.5. In addition, a sample of 6K-coated ferrihydrite was prepared using the same procedure but at a pH of 7.5.

Unless otherwise specified, the suspension was agitated for 24 hrs. at 20° C. Following agitation, the suspension underwent centrifugation (13,010 g, 30 min). A 15 mL sample of the PAA-coated ferrihydrite was then collected to measure the total organic carbon (TOC) content. The TOC analysis was conducted using a Shimadzu V-TOC/TN analyzer in the non-purgeable organic carbon (NPOC) mode. The concentration of PAA in the supernatant was determined using NPOC analysis. The low-loading NPOC analysis consisted of adding 2% 2 N HCl acid, sparging for 1.5 minutes, and making 2-3 injections with a 50 mL injection volume. Default values were used for all other settings.

Furthermore, PAA-coated ferrihydrite samples were prepared as described above with a concentration of 1/5 wt %. These samples were then exposed to 100 mg/L of Toluidine Blue O (TBO) ($C_{15}H_{16}N_3SCl$, Spectrum Chemical Manufacturing Corporation). TBO is a cationic dye that binds to the carboxylic group of the PAA through electrostatic interactions, specifically to negatively charged PAA. The residual TBO concentration in the supernatant of both bare ferrihydrite and PAA-coated ferrihydrite samples was measured using UV-vis spectrometry.

Particle Stability of Bare Ferrihydrite and PAA-Coated Ferrihydrite in the A6 Growth Medium Dynamic light scattering (DLS) and electrophoretic light scattering (ELS) were measured using a Malvern Zetasizer Nano instrument to determine the hydrodynamic particle size and zeta potential of particles. The zeta potentials of bare ferrihydrite and PAA-coated ferrihydrite (1/10 wt %) were measured at various pH values. Different ratios of total PAA to ferrihydrite (ranging from 1/100 to 1/2 wt %) were tested at pH 5.5 to assess the change in zeta potentials. Both bare ferrihydrite and PAA-coated ferrihydrite were prepared in the A6 growth medium 12 hrs before analysis. The solid content of the 2-line ferrihydrite was kept constant at 50 mg/L for all particle stability tests. Before conducting the DLS and ELS measurements, the final samples were sonicated in a water bath for 5 min and stirred.

The effect of $NH_4^+$ and $Ca^{2+}$ on the particle stability of PAA-coated ferrihydrite was studied as a function of the concentrations of these cations in the A6 growth medium. Either a 12 mM $NH_4C$ or $CaCl_2$) stock solution was used to adjust the concentrations in the A6 growth medium. The zeta potential changes were examined for an $NH_4^+$ concentration ranging from 0 to 4 mM using 6K and 450K-coated ferrihydrite, and a $Ca^{2+}$ concentration ranging from 0 to 2 mM using the 450K-coated ferrihydrite.

Environmental Scanning Electron Microscopy (ESEM) Measurements

An ESEM (Quanta 200 FEG, FEI Company Hillsboro, OR) was employed to observe the ferrihydrite surface in the absence and presence of PAA. Four different molecular weights of PAA were used to coat 2.5 g/L of ferrihydrite (1/10 wt %) in the A6 growth medium. A small volume of suspension was placed on an aluminum grid and then measured at the ESEM mode (1 Torr). Measurements were conducted at an accelerating voltage of 10 kV (PAA-coated samples) and 30 kV (bare ferrihydrite) and a working distance range of 9.9 mm to 11 mm.

Feammox Incubations in the Presence of PFOA at 1 mg/L

For the Feammox incubations with PFOA, an aliquot of PFOA was added to the growth medium to reach a final PFOA concentration of 1 mg/L (0.0024 mM). All incubations were carried out at pH 5.5, as A6 requires acidic conditions for its growth (Huang and Jaffé, 2016). The relatively high PFOA concentration was chosen to ensure accurate detection of PFOA degradation byproducts such as $F^-$ and shorter-chain PFAS. It has previously been demonstrated that such concentrations do not exhibit toxic effects on the A6 activity in terms of overall growth, $NH_4^+$ oxidation, or Fe(III) reduction.

A 7 mM suspension of 2-line ferrihydrite was added to the PAA-free sample (control) and the PAA-coated ferrihydrite samples as the electron acceptor for the Feammox process. This concentration of ferrihydrite was selected based on the results of previous Feammox incubations to defluorinate PFAS. The resulting mixtures were then distributed into serum vials and sealed with butyl rubber stoppers. The headspace of each vial (2 mL) was evacuated, followed by filling it with a gas mixture of $N_2/CO_2$ (80:20). This step was carried out to maintain the required anoxic condition for A6 growth and to provide $CO_2$ as the carbon source for A6, which is an autotrophic organism. Samples were incubated on a rotary shaker (150 rpm) at 20° C. for 50 days. Triplicate samples were collected at specified sampling dates and filtered (0.22 μm) to measure the concentrations of $NH_4^+$, PFOA, degradation intermediates ($C_nF_{2n+1}COO^-$, n=4-7), and $F^-$. The pH in the incubation vials increased to 6.5 by the end of the incubation period. Additional samples were stored at 4° C. for microbial analysis.

Chemical analyses of Feammox Incubation Samples

Ion chromatography (IC) was performed with a conductivity detector to measure $NH_4^+$ and $F^-$ ions (ICS-3000, Dionex Co., USA). Cations and anions were analyzed using a CS16 column (4 mm i.d.×200 mm) and an AS18 column (4 mm i.d.×200 mm), respectively.

Fe(II) was analyzed using the ferrozine assay method, which has been previously described for Feammox incubations. The pH was measured using a Hach HQ40d multiprobe meter (Hach, Loveland, CO, USA). PFOA and shorter-chain perfluoroalkyl acids (PFAAs) such as perfluoroheptanoic acid (PFHpA), perfluorohexanoic acid (PFHxA), perfluoropentanoic acid (PFPeA), and perfluorobutanoic acid (PFBA) were quantified using ultraperformance liquid chromatography-tandem mass spectrometry (UPLC-MS-MS: Agilent 1290-6430A). The analysis was performed by SGS-CSTC Standards Technical Services Co., Ltd (China) following established methods. A volume of 10 μL of a mixture of surrogate internal standards, prepared at a concentration of 50 ng/mL in pure methanol, was added to all samples. The PFAS native standards (i.e., shorter-chain PFAAs) and isotopically labeled internal standards such as $_{13}C_4$-PFBA, $_{13}C_5$-PFPeA, $_{13}C_5$-PFHxA, $_{13}C_4$-PFHpA, and $_{13}C_8$-PFOA were provided by Wellington Laboratories (Guelph, Canada). A standard curve within the range of 0.5-100 ug/L was generated after appropriate dilution with methanol to quantify the compounds. A blank control was included in each sample sequence to confirm the absence of the target compounds. The Agilent ZORBAX SB-C18 column (150×2.1 mm, 3.5 μm) with a mobile gradient phase of (A) 85% ammonium acetate solution and (B) 100% acetonitrile was operated at 30° C. with a flow rate of 0.3 mL/min. The eluent gradient started at 30% (B) for 2 min, then increased to 90% (B) in 3 mins. The eluent was then returned to the initial condition within 0.1 min and maintained for 4.9 min during the injection interval for equilibration. Negative electrospray ionization (ESI) mass spectrometry in a multiple reaction monitoring mode (MRM) was used for the detection of PFAS.

Electrochemical Impedance Spectroscopy (EIS) Measurements

Electrochemical impedance spectroscopy (EIS) measurements of the electrode were conducted as per a modified prior method. EIS measurements were performed at the open circuit potential ($E_{ocp}$) with a frequency range from 1 MHz to 0.1 Hz and a working amplitude of 25 mV on a CHI760E Electrochemical Workstation. The impedance data was fitted to an equivalent circuit model using the CHI760E workstation. The electrochemical cell used a single-compartment housing with a Pt mesh counter electrode, an Ag/AgCl reference electrode (saturated KCl), and a glassy carbon electrode (Basi, 3.0 mm diameter) coated with a material of interest as the working electrode. A supporting electrolyte of 0.1 M $NH_4Cl$ (adjusted to pH 5.5 with 0.1 M $NH_4OH$) was used. Bare ferrihydrite, 6K-coated ferrihydrite, and 450K-coated ferrihydrite were prepared in DI water as described earlier. After centrifugation (14,000 g, 30 min), the residual solid was washed with DI water to remove dissolved PAA in the solution. The working electrode was fabricated by suspending 5 mg of bare ferrihydrite, 6K-coated ferrihydrite, or 450K-coated ferrihydrite in 1 mL of methanol and drop-casting 14 μL of the suspension onto the surface of the glassy carbon electrode to achieve a ferrihydrite loading of 1 mg/cm$^2$.

Microbial Analysis of Incubation Samples Total genomic DNA was extracted from incubation samples using the Fast DNA™ SPIN Kit for Soil DNA Extraction (MP Biomedicals) following the manufacturer's instructions.

Subsequently, the DNA samples were stored at −20° C. until further analyses. Quantitative polymerase chain reaction (qPCR) was performed using an Applied Biosystems StepOnePlus™ Real-Time PCR system to quantify A6. The DNA primer set was utilized for the A6 quantification. The A6 quantification was done in triplicate for each sample, and negative controls were included. Serial dilutions of known A6 DNA copy numbers were measured to determine the standard curve.

The V4-V5 region of 16S rRNA genes was sequenced from samples collected on day 0 and day 40 of the incubations to compare the effects of different PAAs on a microbial structure. The region was amplified using the primer set 515 F-806 R, and the PCR reactions were carried out with a Veriti 96 well Thermal cycler (Applied Biosystems). A TruSeq® DNA PCR-Free Sample Preparation Kit (Illumina, USA) was used to prepare sequencing libraries, and the quality of the library was verified using a Qubit@2.0 Fluorometer (Thermo Scientific) before sequencing on an Illumina MiSeq platform. Paired end reads of 250 bp were generated. The operational taxonomic units (OTUs) were clustered using Uparse software (Uparse v7.0.100, drive5.com/uparse/) with a 97% similarity cut-off. Taxonomic analysis of the sequences was conducted using Mother (version v.1.30.1) against the Silva SSUrRNA database with a confidence threshold of 0.8-1.

Example 2—Results

Characteristics of PAA Coated-Ferrihydrite in the A6 Growth Medium

Figure 2:
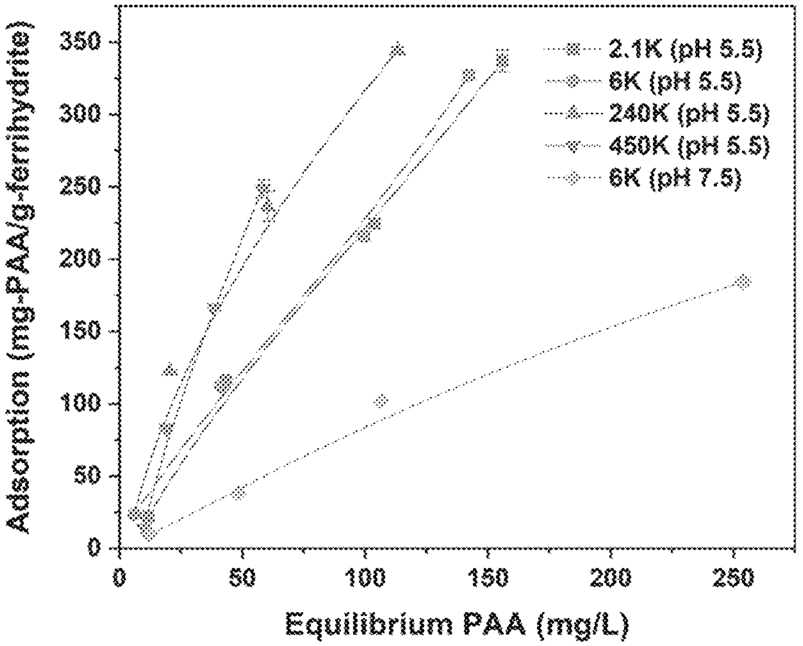
FIG. 2 is a graphical representation of adsorption isotherms of four different molecular weight PAAs on ferrihydrite and effect of pH. Squares represent 2.1K PAA at a pH of 5.5, circles represent 6K PAA at a pH of 5.5, upward triangles represent 240K PAA at a pH of 5.5, downward triangles represent 450K PAA at a pH of 5.5, and diamonds represent 6K PAA at a pH of 7.5.

FIG. 2 displays the sorption isotherms of PAA on ferrihydrite in the A6 growth medium. As the A6 growth medium is typically introduced to sediments or aquifers under acidic conditions for biostimulation or bioaugmentation of A6, sorption isotherms of PAA on ferrihydrite were performed for four molecular weights of PAAs at a pH 5.5. To examine the impact of pH, additional isotherms were measured for the 6K PAA at pH 7.5. The results presented in FIG. 2 show that the higher molecular weight PAAs (240K and 450K) sorb much stronger onto the ferrihydrite than the lower molecular weight PAAs (2.1K and 6K), and that as pH increases, as shown for the 6K PAA, sorption decreases.

Figure 3:
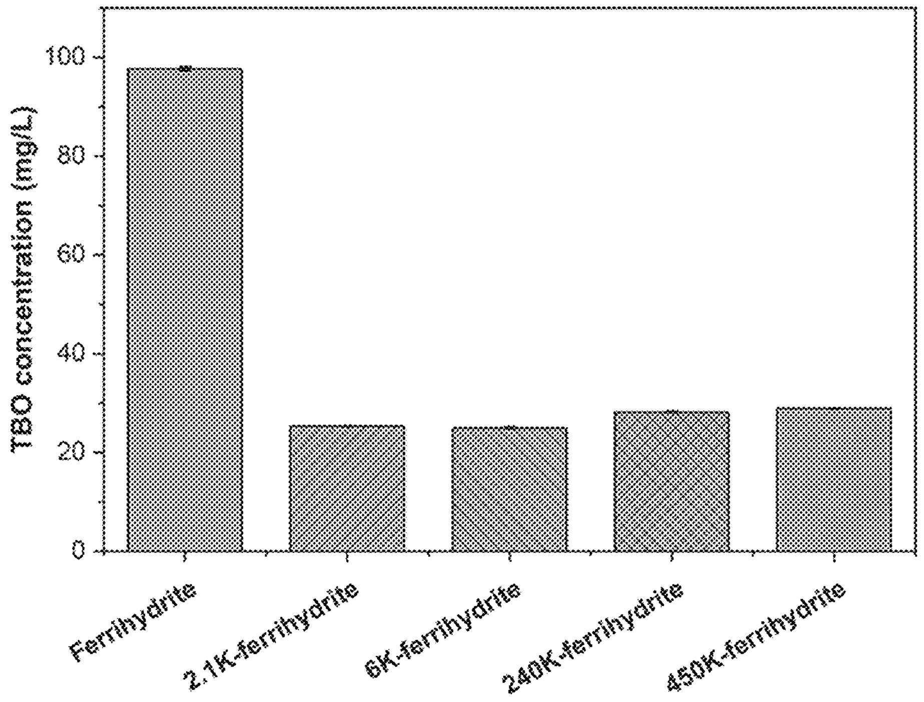
FIG. 3 is a graphical analysis of Toluidine Blue O (TBO) concentrations in the solution containing ferrihydrite and PAA-coated ferrihydrite (⅕ wt %) at pH 5.5.

FIG. 3 depicts the TBO concentrations, illustrating the sorption characteristics of bare ferrihydrite and PAA-coated ferrihydrite. Without the presence of PAA, there was a negligible sorption of TBO onto ferrihydrite. However, when PAA was introduced, a significant reduction in TBO concentration was observed, resulting in values of 25.3, 25.0, 28.2, and 28.9 mg/L for 2.1K, 6K, 240K, and 450K-coated ferrihydrite, respectively. The higher TBO concentrations observed with larger molecular weight PAAs, particularly 240K and 450K, may be attributed to a stronger binding of the negatively charged PAA onto ferrihydrite, which leads to a lower concentration of residual PAAs in the supernatant. These findings align with the sorption results discussed above and the zeta potential measurements discussed below.

Figure 4:
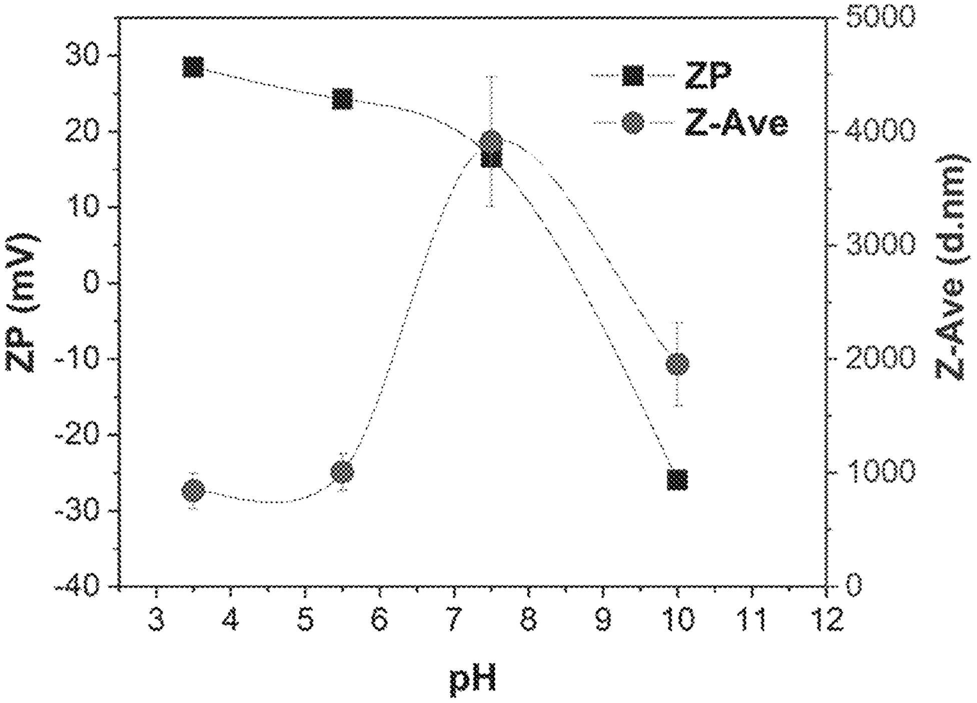
FIG. 4 is a graphical representation of changes in the zeta potential (ZP) and average hydrodynamic diameter (Z-Ave) of bare ferrihydrite particles at a ferrihydrite content of 50 mg/L.
Figure 5:
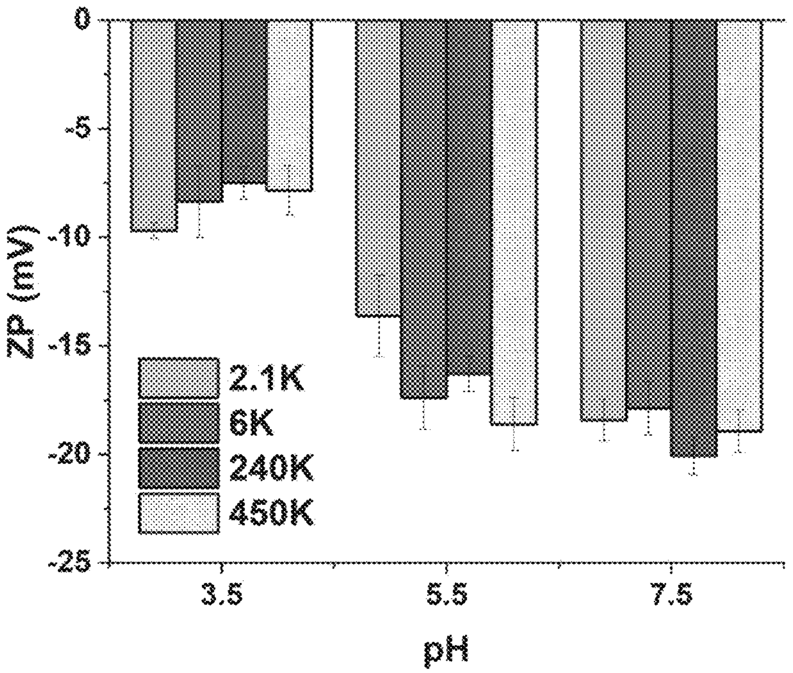
FIG. 5 is a graphical representation of changes in the zeta potential (ZP) of PAA-coated ferrihydrite at different pH values. Ferrihydrite was coated with PAA in the A6 growth medium at a ferrihydrite to PAA ratio of 1/10 (w/w). [ferrihydrite]=50 mg/L.

The results presented in FIG. 4 demonstrate that the pH of the suspension has a significant impact on the zeta potential of the bare (untreated) ferrihydrite particles. When the pH is above the point of zero zeta potential ($pH_{icp}$), which has been reported to be approximately pH 8 for bare ferrihydrite, the zeta potential becomes negative. The hydrodynamic particle diameter of bare ferrihydrite exhibits a rapid increase from pH 3.5 to 7.5, which can be attributed to the decrease in the absolute positive zeta potential. This decrease in zeta potential facilitates particle aggregation, leading to a reduction in colloidal stability. In contrast, when ferrihydrite is coated with PAA at a ferrihydrite to PAA ratio of 1/10, the surface charge of the PAA-coated ferrihydrite particles becomes negative, as shown in FIG. 5. The absolute value of this negative zeta potential increases as the pH increases from 3.5 to 7.5, suggesting that the dissociation of COOH groups of the PAA polymers results in negatively charged —$COO^-$ groups along the PAA chains. The adsorption of the polymer onto the ferrihydrite is responsible for the change in zeta potential of the polymer-coated ferrihydrite for several reasons: (1) the sorbed polymer chains have negatively charged functional groups; (2) there is a shift in the slipping plane due to the formation of the polymeric adsorbed layer; and (3) active sites on the particle surface are now blocked.

The degree of dissociation of the carboxylic groups of the PAA chains depends on the pH. For example, the degree of dissociation of these carboxylic groups on the surface of $ZrO_2$ was 0.03 at pH 3, and 0.97 at pH 6. When the pH is above the $pK_a$ (4.5), uncharged PAA chains with a globular structure tend to induce densely packed PAA adsorption on oxide surfaces. However, the PAA chains undergo a conformational change at higher pH values, forming prolate and swelled structures (e.g., open-coil conformations) due to ionic repulsions. As a result, the PAA chains adopt a more stretched conformation at higher pH values, leading to increased blocking of active sites on ferrihydrite and a shift in the slipping plane, ultimately reducing the zeta potential.

The results presented in FIG. 5 show that the negative zeta potential of all PAA-coated ferrihydrite samples decreased as the pH increased from 3.5 to 5.5. Notably, the 2.1K and 240K-coated ferrihydrite exhibited a further decrease in the negative zeta potential above pH 5.5. However, subsequent experiments were conducted at pH 5.5 because, as mentioned above, acidic conditions are required for the A6-mediated Feammox process.

Figure 6:
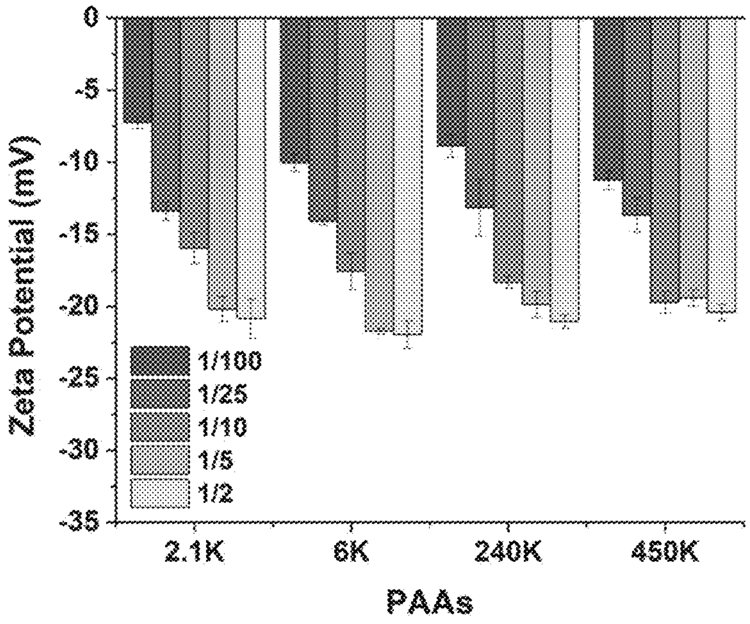
FIG. 6 is a graphical representation of the effect of the PAA-coated ferrihydrite (mass of PAA/mass of ferrihydrite) on zeta potentials as a function of PAA molecular weight and PAA loading in A6 growth medium at 50 mg/L of ferrihydrite (pH 5.5).

Based on the above results, a pH of 5.5 was selected to study the effect of different mass ratios of PAA to ferrihydrite on the zeta potential of PAA-coated ferrihydrite. The results depicted in FIG. 6 demonstrate that the absolute value of the negative zeta potential increases as the ratio of PAA mass to ferrihydrite mass increases from 1:100 to 1:5 for all PAAs, except for the 450K PAA. In the case of the 450K PAA, no significant changes in the negative zeta potential were observed once the ratio reached 1:10. The results further indicate that the effect of polymer molecular weight on the zeta potential is negligible. This can be attributed to the similarity in total length and the number of tails and loops formed at the oxide interface among all PAAs. Results also show that increasing the PAA loading on ferrihydrite leads to significant changes in the zeta potential. Colloidal stability is commonly classified based on the zeta potential values. Colloidal suspensions with zeta potentials of ±0-10 mV, ±10-20 mV, ±20-30 mV, and ±30 mV are considered highly unstable, relatively stable, moderately stable, and highly stable, respectively. Therefore, based on the studied PAA-coated particles, moderate colloidal stability is achieved at a PAA to ferrihydrite mass ratio of 1:5 in the A6 growth medium at pH 5.5.

Figure 7A:
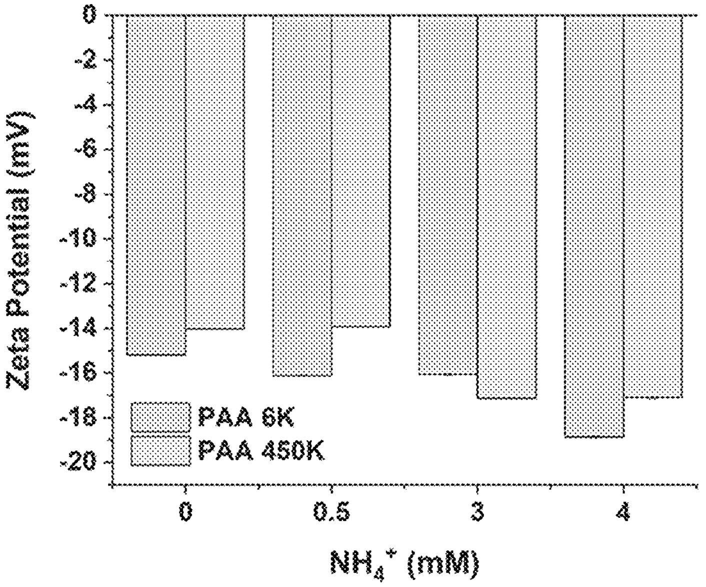
FIG. 7A is a graphical representation of zeta potentials of 6 K and 450 K-coated ferrihydrite vs. $NH^{4+}$ concentration.
Figure 7B:
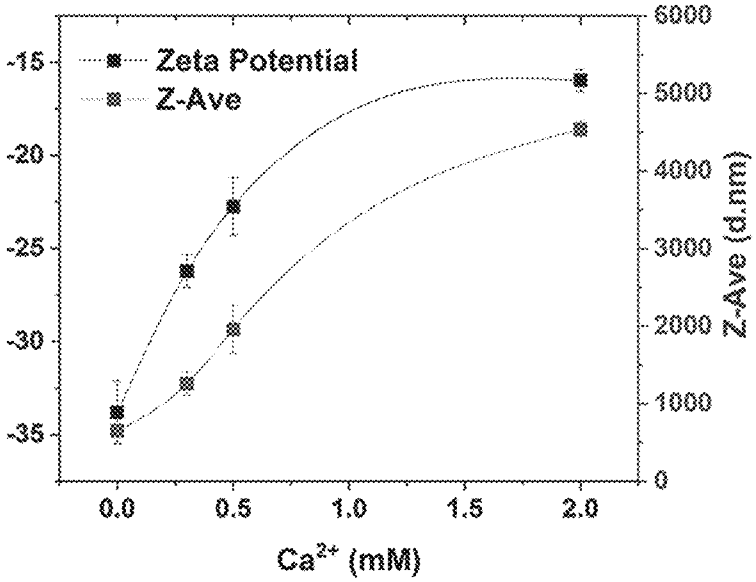
FIG. 7B is a graphical representation of zeta potential and average hydrodynamic diameter (Z-Ave) of 6 K-coated ferrihydrite vs. $Ca^{2+}$ concentration. All samples were tested in the A6 growth medium at pH 5.5.

FIG. 7 shows the impact of $NH_4^+$ (FIG. 7A) and $Ca^{2+}$ (FIG. 7B) concentrations in the A6 growth medium on the particle stability of PAA-coated ferrihydrite. $NH_4^+$ was selected because it is the electron donor for the growth of A6 and will have to be present at the millimolar level, whereas $Ca^{2+}$ is a common cation that can be present, also in the millimolar range, in many groundwaters. Results show that the presence of $NH_4^+$ has only a small effect on the zeta potential of the PAA-coated ferrihydrite, while the presence of $Ca^{2+}$ has a significant effect. As the $Ca^{2+}$ concentration increased from 0 mM to 2 mM, the zeta potential increased from −33.8 to −16.0 mV along with an 8-fold increase in the hydrodynamic particle diameter. Therefore, the presence of a divalent cation such as $Ca^{2+}$ may negatively affect the transport of the PAA-coated ferrihydrite in a porous medium, which has been shown previously. Specifically, previous column-transport studies revealed that the presence of 0.5 mM of $Ca^{2+}$ caused a significant delay in the breakthrough of PAA-coated ferrihydrite, while at $Ca^{2+}$ concentrations of 2 mM the transport of PAA-coated ferrihydrite was nearly completely hindered.

A6 requires acidic conditions for its growth, and higher $Ca^{2+}$ concentrations as examined above are typical for alkaline and not acidic groundwaters. Hence, for A6-based PFAS bioremediation schemes that may require the supply of Fe oxides, the lower $Ca^{2+}$ concentrations were a focus. Therefore, the $Ca^{2+}$ concentration in the A6 growth medium was adjusted to 0.1 mM, which resulted in highly stable colloids with negative zeta potentials lower than −30 mV in all PAA-coated particles (Table 1).

TABLE 1

Zeta potential and hydrodynamic diameter of PAA-coated ferrihydrite in the A6 growth medium (pH 5.5) after adjusting the $Ca^{2+}$ concentration to 0.1 mM.

| PAA | Zeta potential ± 1σ (mV) | Hydrodynamic diameter ± 1σ (μm) |
|---|---|---|
| 2.1K | −33 ± 2 | 843 ± 73 |
| 6K | −35 ± 1 | 923 ± 73 |
| 240K | −35 ± 2 | 1054 ± 120 |
| 450K | −37 ± 4 | 1081 ± 123 |

n = 3 for all samples.

Figure 8:
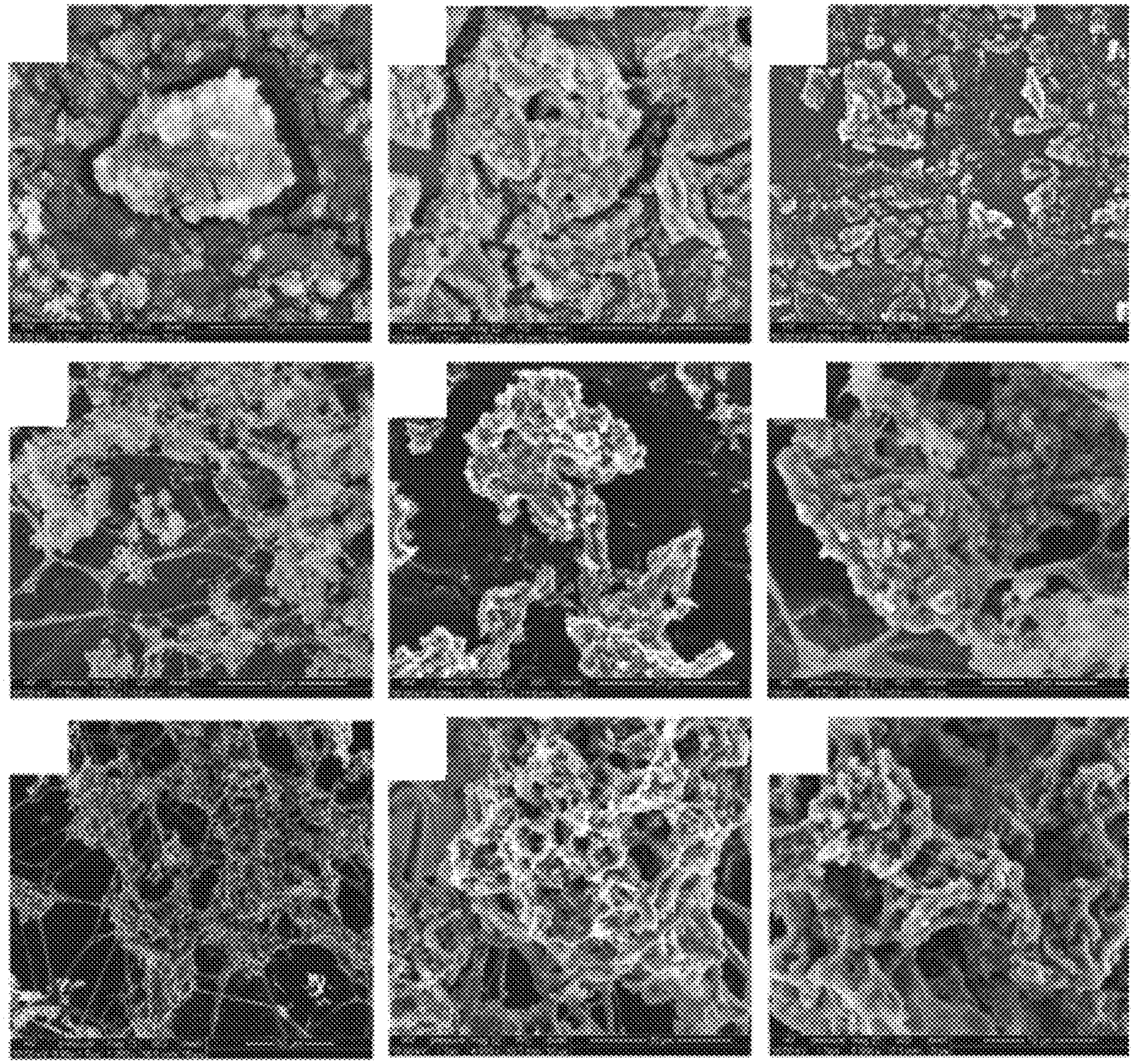
FIG. 8 is a series of environmental scanning electron microscopy (ESEM) images depicting bare ferrihydrite (top left), 2.1K-coated ferrihydrite (top center), 6K-coated ferrihydrite (top right), 240K-coated ferrihydrite (middle row), and 450K-coated ferrihydrite particles (bottom row) obtained at 1-torr of water vapor.

FIG. 8 shows the ESEM images of PAA-coated ferrihydrite prepared in the A6 growth medium (all images except top left), which followed the same coating procedure as described above, except that 250 mg/L of PAA was employed to coat the ferrihydrite at 1:5 ratio by weight for 24 hrs. FIG. 8 exhibits the morphology of bare ferrihydrite (top left), 2.1K (top center), 6K (top right), 240K (middle row), and 450K-coated ferrihydrite particles (bottom row). Images of the 240K and 450K-coated ferrihydrite are also shown at higher magnifications. In the absence of PAA in the solution (i.e., bare ferrihydrite), no apparent morphological differences were observed when compared to images of bare ferrihydrite reported previously. The micrographs of PAA-coated samples indicate the presence of PAA incorporated into ferrihydrite particles, forming flocs with surface porosity in the aggregates. Higher magnification images demonstrate that PAA-coated ferrihydrite flocs have different pore sizes of several micrometers. Moreover, the floc structure appears different depending on the molecular weight of the polymers. Pores in the flocs generated by the 450K coating are larger than those caused by other PAA coatings, presumably because the adsorption of large polymers on metal oxides blocks PAA macromolecules from entering the floc aggregates. Furthermore, the longer polymer tails and loops of the 450K PAA may induce a thicker adsorption layer on ferrihydrite compared to the smaller molecular weight PAAs.

Figure 9:
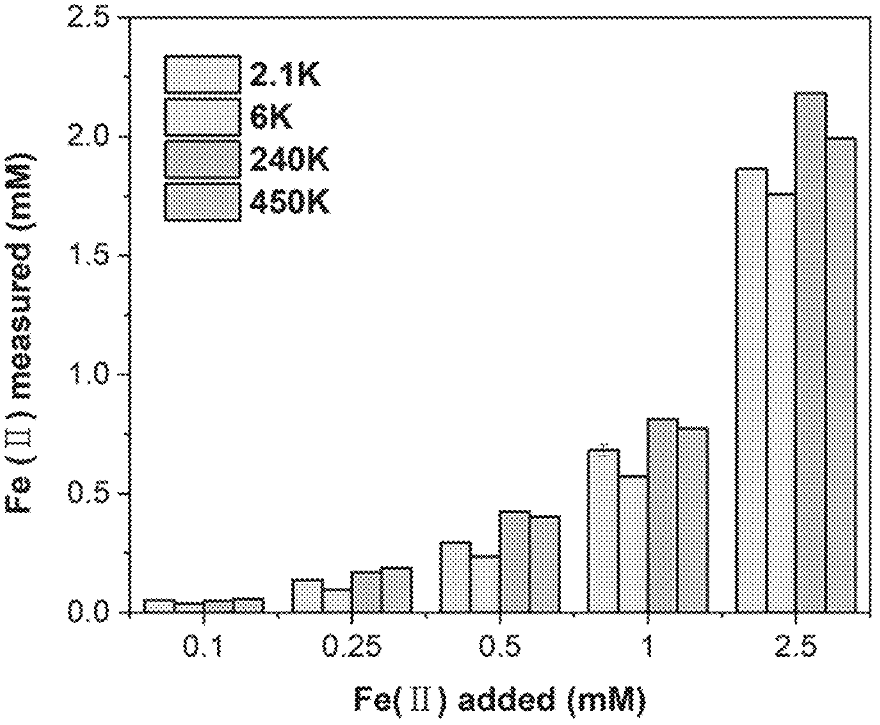
FIG. 9 is a graphical representation of free Fe(II) concentrations in the $FeCl_2$ solution in the presence of 250 mg/L of PAA.

Moreover, the carboxylic groups of the PAA chain have previously been reported to interact with multivalent cations (e.g., $Ca^{2+}$, $Mg^{2+}$, $Mn^{2+}$, $Zn^{2+}$, and $Fe^{3+}$) in the solution through electrostatic and hydrogen bonds, resulting in ionic cross-linking. Covalent bonding facilitates chemical cross-linking, and when combined with ionic cross-linking, it can form PAA hydrogels capable of retaining a large amount of water. Various compounds in the A6 growth medium may induce ionic cross-linking in all PAA-coated samples. However, based on the morphologies shown in FIG. 8, hydrogel formation appears only in the case of the 240K and 450K-coated ferrihydrite samples. As illustrated in FIG. 8, middle and bottom rows, 240K and 450K-coated ferrihydrite samples exhibit interconnected structures of polymer and ferrihydrite aggregates. In addition, PAA chains can form chelates such as Fe(II)-PAA/Fe(III)-PAA due to multiple binding sites. Therefore, dissociated PAA chains in the solution might not liberate free Fe(II) ions. As shown in FIG. 9, the final Fe(II) concentrations measured using the ferrozine method were significantly lower than the initial Fe(II) concentrations in the presence of PAAs, suggesting that the Fe(II)-PAA complex inhibits the formation of the Fe(II)-ferrozine complex.

Influence of Bare Ferrihydrite and PAA-Coated Ferrihydrite as the Electron Acceptor of A6

Figure 10:
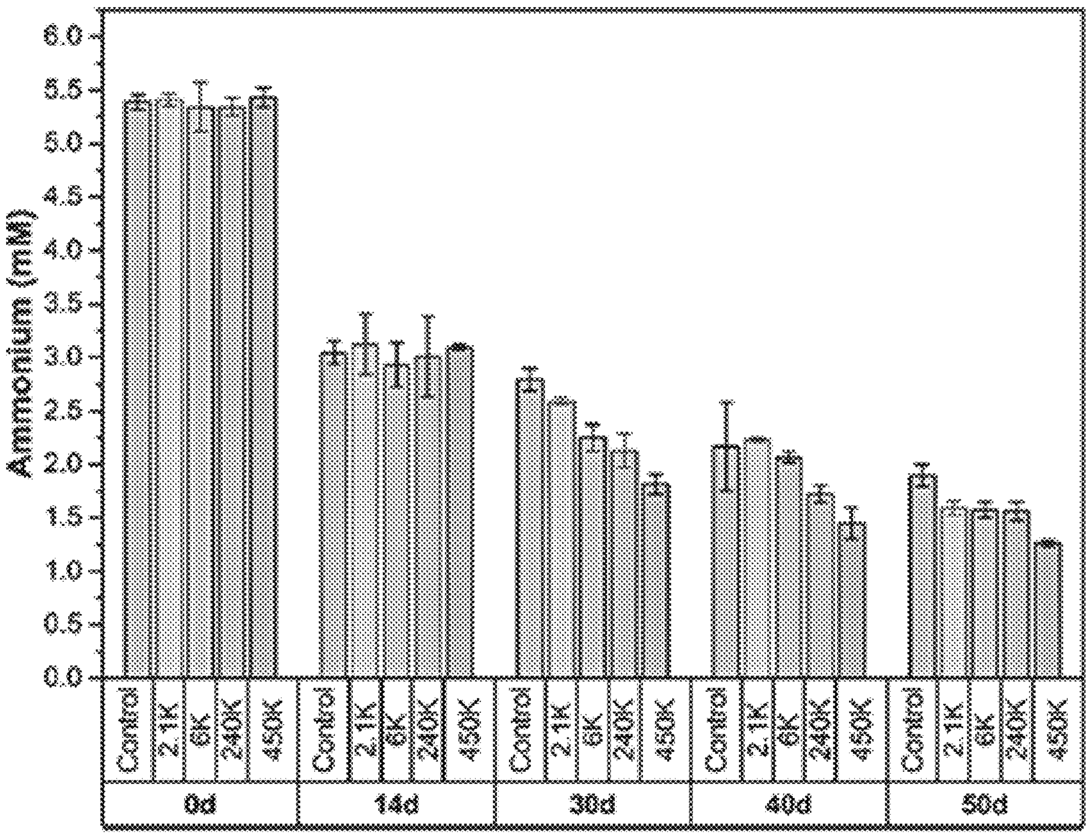
FIG. 10 is a graphical representation of ammonium oxidation in A6-enrichment-culture incubations amended with bare ferrihydrite (control) and PAA-coated ferrihydrite.

Changes in $NH_4^+$ concentrations were investigated during the incubation to assess whether A6 can oxidize $NH_4^+$ by using PAA-coated ferrihydrite as the electron acceptor (FIG. 10). By day 14, substantial decreases in the $NH_4^+$ concentration (~44%) were observed in all incubations. There were no significant differences ($p>0.05$) between the control (bare ferrihydrite) and the PAA-treated samples by day 14 of the incubations. However, the amount of $NH_4^+$ oxidized increased compared to the control after 14 days. At the end of the incubations, significantly more $NH_4^+$ was removed in all PAA-coated samples than in the control, which indicates not only that A6 can utilize the PAA-coated ferrihydrite as the electron acceptor, but that in these incubations the presence of the PAA resulted in enhanced A6 activity.

Without being beholden to any particular theory, one possible reason for the enhancement in A6 activity could be that the presence of the PAA leads to a lower increase in free Fe(II) concentration in the solution. As shown in Equation 1, this reduced free Fe(II) concentration may stimulate the oxidation of $NH_4^+$ and result in an enhanced Feammox process. In general, particularly for the samples collected on days 30 and 40, the amount of $NH_4^+$ removed showed an increasing trend with the molecular weight of the PAA. From day 30 to the end of the incubations on day 50, the highest $NH_4^+$ removal was observed in the presence of 450K-coated ferrihydrite, indicating that among the examined PAAs, the 450K-PAA-coated ferrihydrite enhanced the Feammox process the most. FIG. 9 shows that all PAAs appeared to form complexes with Fe(II), with the 6K PAA resulting in the largest decrease in free Fe(II) concentration. However, this did not correspond to the highest $NH_4^+$ oxidation. Therefore, these results suggest that other factors than the PAA-Fe(II) complex may play a role in electron transfer during the Feammox reaction.

The EIS measurements were conducted to determine if the PAA coating aids the electron transfer process to the ferrihydrite, enhancing the Feammox activity. The impedance data were fitted to an equivalent circuit model, revealing a charge transport resistance of $(4.8\pm0.34)\times10^{10}$ ohm for bare ferrihydrite. The charge transfer resistance values for the 6K-coated ferrihydrite and 450K-coated ferrihydrite increased PFOA degradation over 40 days compared to those with 2.1K and 240K-coated ferrihydrite, as well as the control with no PAA.

During the degradation of PFOA in the A6-enrichment-culture incubations, the production of various shorter-chain PFAAs (i.e., PFOA degradation intermediates) was observed. As shown in Table 2, the concentration of these intermediates was several orders of magnitude lower than that of the PFOA or the change in PFOA concentration.

TABLE 2

Fluorine balance of (A) control, (B) 2.1K, (C) 6K, (D) 240K, and (E) 450K-coated samples during 40 days of incubation. n = 3 for all samples. All error bars correspond to ± 1σ (std dev).

| | F in PFOA | F in PFHpA | F in PFHxA | F in PFPeA | F in PFBA | $F^-$ | Total F |
|---|---|---|---|---|---|---|---|
| Control | | | | | | | |
| 0 d | $(3.70 \pm 0.36) \times 10^{-2}$ | | $(1.47 \pm 1.39) \times 10^{-7}$ | | $(9.27 \pm 5.78) \times 10^{-5}$ | $(1.67 \pm 0.17) \times 10^{-2}$ | $(5.37 \pm 0.48) \times 10^{-2}$ |
| 30 d | $(2.52 \pm 0.52) \times 10^{-2}$ | | $(4.70 \pm 4.41) \times 10^{-7}$ | | $(4.06 \pm 5.66) \times 10^{-7}$ | $(2.72 \pm 0.04) \times 10^{-2}$ | $(5.23 \pm 0.51) \times 10^{-2}$ |
| 40 d | $(1.49 \pm 0.18) \times 10^{-2}$ | $(7.16 \pm 5.32) \times 10^{-8}$ | $(6.53\pm 5.06) \times 10^{-7}$ | | $(6.10 \pm 4.12) \times 10^{-7}$ | $(3.17 \pm 0.09) \times 10^{-2}$ | $(4.66 \pm 0.24) \times 10^{-2}$ |
| 0 d | $(3.70 \pm 0.36) \times 10^{-2}$ | | $(1.47 \pm 1.39) \times 10^{-7}$ | | $(9.27 \pm 5.78) \times 10^{-5}$ | $(1.67 \pm 0.17) \times 10^{-2}$ | $(5.37 \pm 0.48) \times 10^{-2}$ |
| 30 d | $(2.52 \pm 0.52) \times 10^{-2}$ | | $(4.70 \pm 4.41) \times 10^{-7}$ | | $(4.06 \pm 5.66) \times 10^{-7}$ | $(2.72 \pm 0.04) \times 10^{-2}$ | $(5.23 \pm 0.51) \times 10^{-2}$ |
| 40 d | $(1.49 \pm 0.18) \times 10^{-2}$ | $(7.16 \pm 5.32) \times 10^{-8}$ | $(6.53 \pm 5.06) \times 10^{-7}$ | | $(6.10 \pm 4.12) \times 10^{-7}$ | $(3.17 \pm 0.09) \times 10^{-2}$ | $(4.66 \pm 0.24) \times 10^{-2}$ |
| 0 d | $(3.70 \pm 0.36) \times 10^{-2}$ | | $(1.47 \pm 1.39) \times 10^{-7}$ | | $(9.27 \pm 5.78) \times 10^{-9}$ | $(1.67 \pm 0.17) \times 10^{-2}$ | $(5.37 \pm 0.48) \times 10^{-2}$ |
| 30 d | $(2.52 \pm 0.52) \times 10^{-2}$ | | $(4.70 \pm 4.41) \times 10^{-7}$ | | $(4.06 \pm 5.66) \times 10^{-7}$ | $(2.72 \pm 0.04) \times 10^{-2}$ | $(5.23 \pm 0.51) \times 10^{-2}$ |
| 40 d | $(1.49 \pm 0.18) \times 10^{-2}$ | $(7.16 \pm 5.32) \times 10^{-8}$ | $(6.53 \pm 5.06) \times 10^{-7}$ | | $(6.10 \pm 4.12) \times 10^{-7}$ | $(3.17 \pm 0.09) \times 10^{-2}$ | $(4.66 \pm 0.24) \times 10^{-2}$ |
| 240K | | | | | | | |
| 0 d | $(4.08 \pm 0.48) \times 10^{-2}$ | | | | $(4.15 \pm 5.61) \times 10^{-8}$ | $(1.57 \pm 0.06) \times 10^{-2}$ | $(5.65 \pm 0.53) \times 10^{-2}$ |
| 30 d | $(2.79 \pm 0.38) \times 10^{-2}$ | | | $1.91 \times 10^{-8}$ | $(3.86 \pm 4.00) \times 10^{-7}$ | $(3.54 \pm 0.12) \times 10^{-2}$ | $(6.33 \pm 0.42) \times 10^{-2}$ |
| 40 d | $(1.94 \pm 0.41) \times 10^{-2}$ | $(8.60 \pm 2.74) \times 10^{-8}$ | $(1.08 \pm 0.79) \times 10^{-6}$ | | $(1.33 \pm 1.77) \times 10^{-6}$ | $(4.39 \pm 0.11) \times 10^{-2}$ | $(6.33 \pm 0.42) \times 10^{-2}$ |
| 0 d | $(4.08 \pm 0.48) \times 10^{-2}$ | | | | $(4.15 \pm 5.61) \times 10^{-8}$ | $(1.57 \pm 0.06) \times 10^{-2}$ | $(5.65 \pm 0.53) \times 10^{-2}$ |
| 30 d | $(2.79 \pm 0.38) \times 10^{-2}$ | | | $1.91 \times 10^{-8}$ | $(3.86 \pm 2\ 00) \times 10^{-7}$ | $(3.54 \pm 0.12) \times 10^{-2}$ | $(6.33 \pm 0.42) \times 10^{-2}$ |
| 40 d | $(1.94 \pm 0.41) \times 10^{-2}$ | $(8.60 \pm 2.74) \times 10^{-8}$ | $(1.08 \pm 0.79) \times 10^{-6}$ | | $(1.33 \pm 1.77) \times 10^{-6}$ | $(4.39 \pm 0.11) \times 10^{-2}$ | $(6.33 \pm 0.42 \times 10^{-2}$ |

were significantly reduced, with values of $(2.0\pm0.31)\times10^{10}$ and $(1.7\pm0.71)\times10^{10}$ ohm, respectively. Although the charge transfer resistance between the 6K-coated ferrihydrite and 450K-coated ferrihydrite showed negligible differences, a significant decrease in charge transfer resistance was observed between the PAA-coated samples and bare ferrihydrite. This result is consistent with the improved Feammox reaction by A6 in the presence of PAA-coated ferrihydrite.

Figure 11:
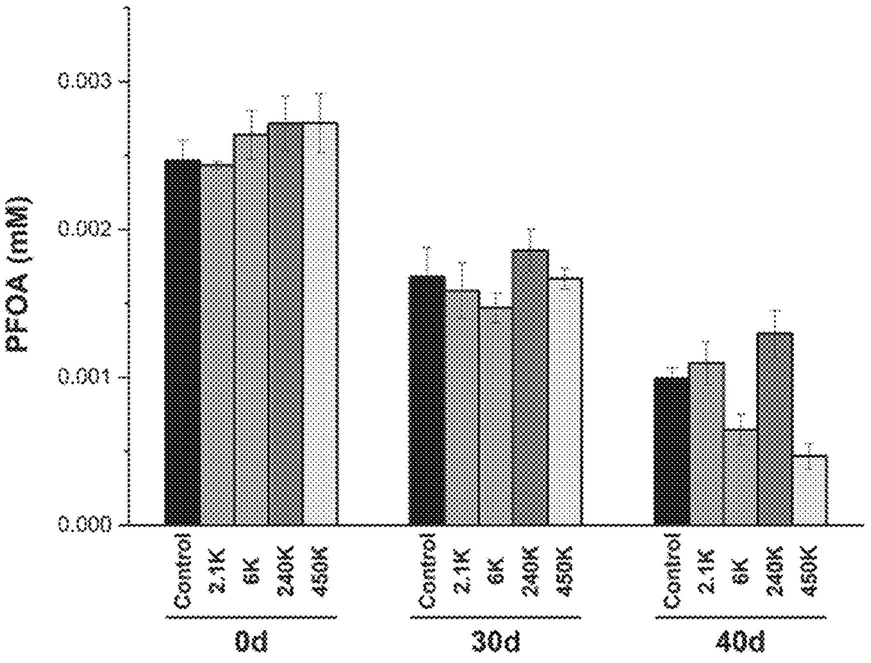
FIG. 11 is a graphical representation of degradation of 1 mg/L of PFOA in A6-enrichment-culture incubations amended with bare ferrihydrite (control) and PAA-coated ferrihydrite.

After adding 1 mg/L (0.0024 mM) of PFOA to the A6 enrichment-culture incubations, changes in the PFOA concentration were investigated over a 40-day incubation period in both the control incubations (bare ferrihydrite) and the incubations with PAA-coated ferrihydrite. The decreasing PFOA concentration over time in the incubations, as shown in FIG. 11, indicates that the presence of the PAA-coated ferrihydrite had a positive effect on PFOA degradation for the 6K and 450K treatments, especially for incubation times longer than 30 days. Specifically, incubations with the 6K and 450K-coated ferrihydrite exhibited significantly In the incubations conducted herein, as well as in previous incubations with A6 and PFOA, intermediate PFAAs with chain lengths of 7, 6, 5, and 4 carbons were detected, but always sporadically. It is worth noting that even in replicate incubations, the specific PFAA at one time point in one replicate did not guarantee its detection in the next replicate. Hence, the differences in the appearance of shorter carbon chain PFAAs in these incubations should not be attributed to a specific PAA-coating. Instead, it is understood that the accumulation of these intermediates was generally minor in all PAA treatments, providing additional evidence for the degradation of PFOA. Moreover, the production of these intermediates and $F^-$ at the concentrations measured indicates that the degradation of PFOA results in a relatively complete defluorination, as evidenced by the fluorine balance below.

Figure 12:
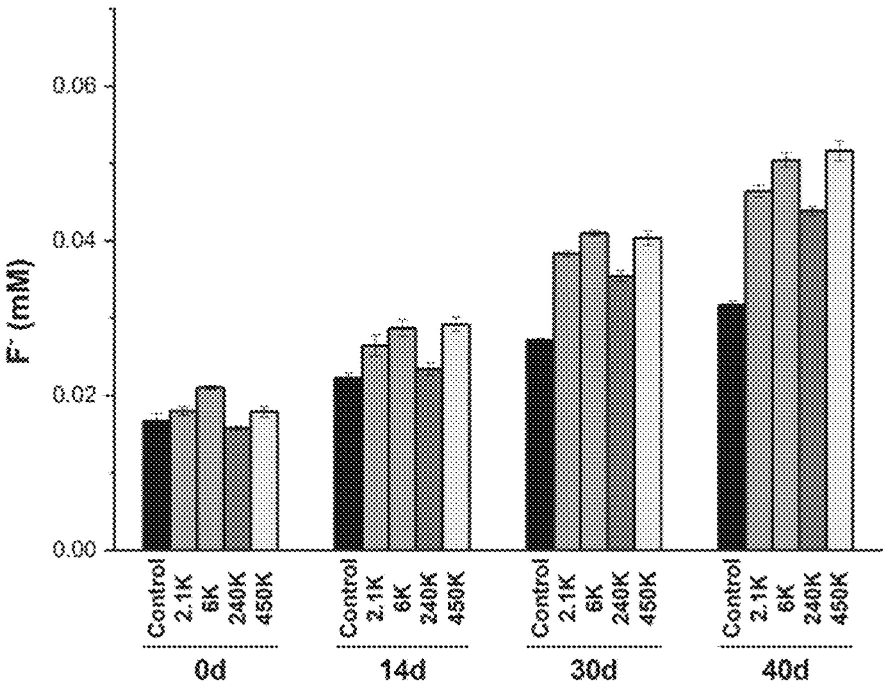
FIG. 12 is a graphical representation of fluoride production in A6 enrichment-culture incubations amended with either ferrihydrite or PAA-coated ferrihydrite. Note that the fluoride (0.018 mM) at the beginning of the incubation is due to transfer from the A6 enrichment-culture inoculation with active PFAS defluorination.

The concentrations of $F^-$ in solution vs. time in these incubations are presented in FIG. 12, showing a gradual increase in the $F^-$ concentrations as the incubations proceed. For incubation times of 30 and 40 days, significantly more $F^-$ is seen in the presence of any of the incubations with PAA-coated ferrihydrite than in the control. Consistent with the decrease in PFOA concentrations, the largest increases in concentrations of $F^-$ were detected in the incubations with the 6K and 450K-coated ferrihydrite.

The difference in the measured concentrations of $F^-$ in solution between the control incubations and those with PAA-coated ferrihydrite is larger than one would have anticipated based on the differences in PFOA degradation. One possible explanation for this discrepancy is that there was more $F^-$ sorption onto the bare ferrihydrite compared to the PAA-coated ferrihydrite. For example, the fluorine balance, which is further elaborated in Table 2, reveals that the incubations with the PAA-coated ferrihydrite exhibited a close fluorine balance, with similar total fluorine concentrations at the beginning and end of the incubations. In contrast, the control incubation displayed approximately 14% less fluorine at the end of the incubation period than the initial concentration. This discrepancy suggests that some $F^-$ might have become associated with the solid phase in the incubations with bare ferrihydrite. In previous studies of PFOA degradation by A6 enrichment cultures, significant adsorption of $F^-$ adsorption (ranging from 4.8% to 47%) onto sludge samples at pH 5 was observed, and this adsorption increased with higher pH values. Therefore, without being beholden to any particular theory, it is plausible that the negatively charged PAA-coated ferrihydrite prevents $F^-$ ions from adsorbing onto the ferrihydrite surface, which could explain the improved fluorine balance observed in the incubations with the PAA-coated ferrihydrite compared to the control without PAA.

Based on the concentrations of PFOA, the shorter PFAAs produced during the incubations, and the $F^-$ concentration, a fluorine mass balance was performed and is presented in Table 2. The results indicate that a relatively good fluorine balance was maintained through the incubation period. Most of the fluorine in the system was found either as organic fluorine in the form of PFOA or as $F^-$, with a relatively small fraction of the overall fluorine present in the intermediates. As mentioned above, some $F^-$ might have sorbed onto the ferrihydrite, as evidenced by the results in Table 2. In the presence of the PAAs, the fluorine balance was close, while in the incubations with the bare ferrihydrite, approximately 14% of the F was not accounted for on day 40.

These results indicate that no significant degradation intermediates were missed in the analyses and that since the F balance was conducted on the aqueous supernatant, there was little if any loss of fluorinated compounds or $F^-$ in the presence of PAA due to sorption, and that the observed decrease in PFOA concentration was due to degradation.

Figure 13:
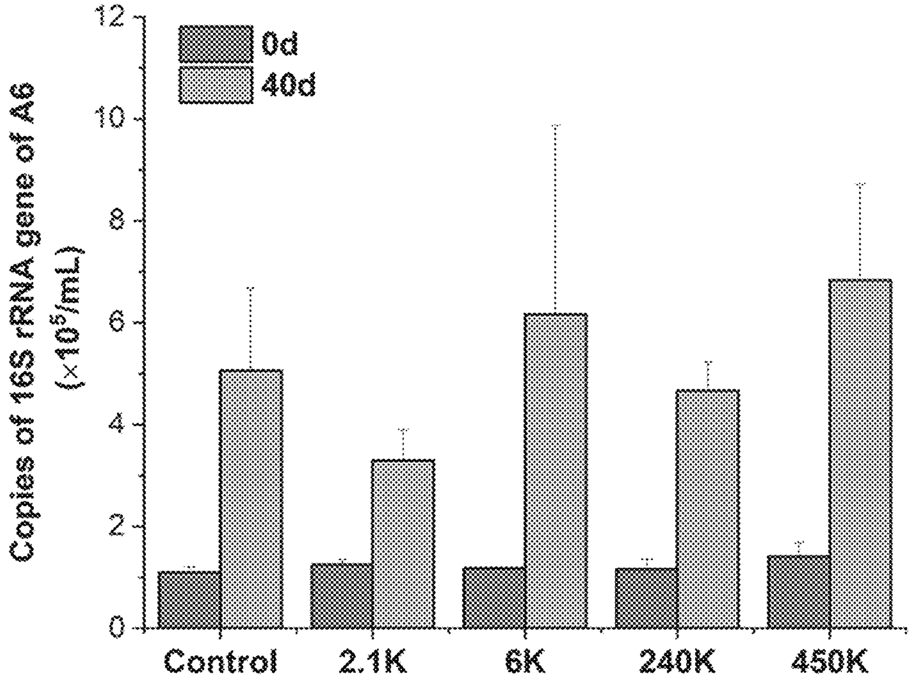
FIG. 13 is a graphical representation of 16S rRNA gene copy numbers of A6 in control (no PAA) and PAA-coated samples on day 0 and 40 of the incubations.

The qPCR results presented in FIG. 13 show that the 16S rRNA gene numbers of A6 appear to have increased during the 40-day incubations. However, it should be noted that this increase is not statistically significant due to the relatively large uncertainties (standard deviations) associated with the qPCR analyses. Nevertheless, the PAA-coated ferrihydrite did not hinder the growth of A6 over the 40-day incubation period.

Results of the 16S rRNA sequencing (Table 3) show a noticeable increase in the total bacterial population in the PAA-coated samples compared to the control over the 40-day incubation, indicating that the presence of the PAA may be beneficial for the growth of heterotrophs. Over this period, A6 remained the most abundant bacterium among these microbial communities, revealing that increases in heterotrophs did not negatively affect the A6 growth. Moreover, the most abundant phylum consisted of Actinobacteria and Firmicutes in all samples before and after the incubation, suggesting that the main microbial structure did not shift much in the presence of PAA over the duration of these experiments. The abundance of the phylum Proteobacteria was prominent in all samples except for the 450K-coated sample, suggesting that the 450K coating may have distinct effects on the microbial community compared to the smaller PAAs. While the results presented in Table 3 do not have replicates, they also indicate that A6 numbers were higher at the end of the incubations when the PAA-coated ferrihydrite was present compared to the bare ferrihydrite control. This observation aligns with the increased $NH_4^+$ oxidation observed in the presence of the PAA-coated ferrihydrite, suggesting a correlation between A6 abundance and the enhanced Feammox process facilitated by the PAA-coated ferrihydrite.

TABLE 3

Comparison in the total OTUs and relative frequency of A6 among the incubation samples.

| Sample | Incubation days | Total OTU | A6 OTU |
|---|---|---|---|
| Original | 0 day | 2413 | 1063 |
| Control | | 4353 | 2472 |
| 2.1K | | 7200 | 3176 |
| 6K | 40 days | 7079 | 3083 |
| 240K | | 6269 | 2275 |
| 450K | | 8733 | 4249 |

Example 3

This present disclosure characterized the impact of coating ferrihydrite with PAAs of different molecular weights and varying PAA:ferrihydrite loadings on particle stability. Additionally, the bioavailability of PAA-coated ferrihydrite for the Feammox process and the degradation of PFOA in A6-enrichment-culture incubations were assessed. At pH 5.5, which was chosen to ensure optimal conditions for both the stability of the PAA-coated particles and the growth of A6, highly stable ferrihydrite particles at zeta potentials of more than −30 mV were observed in all PAA-coated ferrihydrite samples when the solid ratio of PAA to ferrihydrite was 1:5. A6 enrichment-culture incubations, conducted over 40 days, using either bare ferrihydrite or PAA-coated ferrihydrite revealed that coating ferrihydrite with PAAs enhanced $NH_4^+$ oxidation, PFOA removal, and $F^-$ production compared to the incubation with bare ferrihydrite. The incubations with the 6K and 450K PAA-coated ferrihydrite resulted in statistically significant increases in PFOA degradation over the 40-day incubations, compared to the incubation with bare ferrihydrite. 16S rRNA sequencing and qPCR data demonstrate that the PAA treatment does not adversely affect the growth of A6 and may even enhance the final numbers of A6. PAAs-treated samples also resulted in a higher total bacterial population in the incubations than the non-PAA-treated sample, indicating that PAAs may stimulate the growth of heterotrophic bacteria. Although a noticeable shift in the microbial community structure was observed in the 450K-treated sample compared to the other PAA treatments, the dominant bacterial group was A6 across all samples.

The present disclosure demonstrates that the PAA-coated ferrihydrite particles can serve as electron acceptor for the Feammox reaction and PFOA degradation by A6. Several factors, such as the formation of PAA-Fe(II) complexes in the solution and reduced charge transfer resistance for PAA-coated ferrihydrite, may contribute to the enhanced performance of A6 in the presence of the PAA-coated ferrihydrite.

As will be understood by those familiar with the art, the present invention may be embodied in other specific forms without departing from the spirit or essential characteristics thereof. Accordingly, the disclosures and descriptions herein are intended to be illustrative, but not limiting, of the scope of the invention which is set forth in the following claims.

SEQUENCE LISTING (49 sequences)

SEQ ID NO: 1 - DNA, 2165577 bp, unidentified
  misc_feature 216..577: note = Acidimicrobiaceae bacterium A6 genome sequence
  source 1..2165577: mol_type = unassigned DNA
gactcgtcgcgtcgacccggagacgttgtccacaggacagtgtccacagctgtggagcatcttgtggataggaggaggttagaggagtgagcgcacccgaggcatcgtgggaggcgatcgcccaggcgttccgaacggcgtcctgaccacaccgtcaccgctcgccaaggaacgtctcgagaccaagtaccgcgacgtgctcgaggacgtgtcggggaagccacgtggctgacgtggttccgaaccactaatctttgaccctgcgacttgccccagccccctggcgccccaggagctctccgaccagcagatcgattcccgttacccagggtcggagggcttcccatcgatcctgaccacaccgtcaccgctcgccaaggaacgtctcgagaccaagtaccgcgacgtgctcgaggacgtgctgacgcccatcatgggagcgcgagtgcctgtcgcggtacgggtccgcgccgatgtccccgacgagacaccgaccacggcgcattcgctgttcgactcctcacccacatcctcgcccacaccgtcgcggcgtaacggtcgcgggtcctcttcgaccttcgatccccgctataccttcgaagcgttcgtcatcgggtcctccaatcgcttcgcccacgccgcggccctgtccgtggccgagacgccggctcgctcctacaaccccctcttcatccacggcgacgctggtcttggcaagacccatctcctccacgcgatcggcaactacgcccgtgagaactatccgaacctgctgacgacctacgtttcgaccgagaccttcctgcctagccctccgagccctcgtcgggacttttcacccaacgagttcgtcgacgccatcaagcgaaaccagacgcccgccctcgaccgcggtaaagtcgattcgtgagagtgagttcaaggcccgctaccgtgcgtgcgacatcctcctcgtcgacgacatccagttcctcgagggcaaagaagcgatccaagaagagttcttccacacgttcaacacgctctacggggcacagaagcagatcgtgctcacctccgaccgtcccccacgtgcgctggcgacactcgaggatcggctccgaagccggttcgccatgggcttgatcaccgacgtgcaaccgcccgatctcgagacgcgagctgcgatcctccggcgaaaagccgaggatgcgggcgtcaccgtacccgcaacggtcatcgagttcatcgccgcctccatcaccgacaacatccgagagctggagggagcactcactcggctcgccgcattctccacgctcagccagaccggcatcacgctgacgatggccgaacaggtgttatcggatctcatctcgcagcacgccacccaacgtcaacgcacgcctgccgaggtcatcgctgcgacggcggccttgttcaacctcacccctgaagacatcaccggcgcatcgcgcaagcggccggtcgcggtagctcgccagatcgcgatgtacgtcgttcgcgaactcaccgaactcagctacccggagatcggccgcgccttcggcggcaaggaccacacgacggtcatgcacgccgtcagccgggtacaagagctgatgcaagagtctgtggagatctacgaacaggtcgatcagctcttcaagagtcttcgaggtccgcggccgtgagcctgtggatgtccctgaggacggacggtggacgaccgcccgctcatccacaggctcgaggagcccgacgagtccttcgaacgacgacggcctcgcggctccacagcactgtgcatgtcctggggacgagttcatggccgctgcgctgggaaaacgggtgtcgtccacagttcacaggccttactaccagtgctaccgtacacatagataggggaggacatcggtgaagtttctctgtgaacgcgacgaactcgcatcggcgctccaggcggcgtcacgagcgctctcgtcacgctcctcgctcgcgggtgtgcgctggacgcttcgaggcggcgaactcgaggtcgagggacgagagagcgacctcgcgattcgcagtgtgctgggtgcgatgggaaccgagggttcgttccagacgccggcgtcgctcgccgtcgatctcgttcgtaccatgccgagcgaccaagtcgaggtggtggtcgaggacgcatcggtcgtgctccgatcgggtcgggccgaagtgtcgctgcagctgctcccgacgctcgaactccccggaatcggagagggcacgacgccgagtgcgacggtgccggctgccgcgctggcccaggggattcgtcaggtggccgtcgcggcggctcgcgacgacggtcgcgacctcatctattccagcatgctcttctcctcgaccaatgacggcttgcggctggtcgcgacggacgggacgaggcttgcgcttcgtgacatcgcgaatctctctgtcgcgggttcggaagctcgcgacgtcgtgatcccgaccagggccgttcgcgagctcgagaggctcgtcaccggtgcgggtgtcgacgagatccacgtcggtatcggcgagcgcgatgccgtgttcgtggtcggcacgaccacgttggccacccggctcgtcgacgagccctttcgcgactatcggcggctcgtggaggccacctatccgaagaagctcctcctggatcgattgtcgctggtcgatgccatgcggcggcttcgccgtatggccaaggaggcgcggaacagttcgtcgatccagatgaacatgacgccgacggcctgcgagctcagcgtgcgcatcccgtccgtcggccaggtgcacgaggtcctcgacgcgaacttcaacgatgccgagttcaccatcaacttcgacccggacatgctcgccgatggcgtcgacggtgtcgagggcgacgtcatccggctcgagttcatcgaggccaaccgtgcggcgtgcgtgagttcggcggacacccgcgagtacctgtacatcttgatgccgatcgtggcccgctgagtatgtgggtgcgcagtctgcgcatcactggcctgcgcaatctcgacctcaccatcgatcacgtccccgacgacatcatcgcggtggtcgggagcaacggacacggcaagacgagtctgctcgagtcggtcagcgtggtcctggcagggcgatcgttccggacccatgatcggtcggcgctggtcagggtgggccatgacgaagcggtcgtcgtcgcggacgtggagcgcgagctcgctccgccggtgcgagtcggccgtcgggtcgatcgggagggacgactcgagacccgtgtcgacggacagcgggagcaacggggcccgtcgttgccggtggtgagctttcatccagacgacgtccagatcgcgagcggcggcccggagcagcgccgtcggtttctcgacgagtgcgtcgtcggactcgatcgaggggcagcgatccggctgcgtcaggcggagcgtgtcctgcggcagcggaccgaggctctgcgggcgccggtcttggacgaggtgacgctcagcatcctcgaagagcggctcgcgcgcgcgtcggtggaggtagccgagctccgggcccgtgctgccgaggtgatcgctccgcacgctcgggcggtgatcgacgagatgctgatgtcggcgggtcgcgtggtggtgacctatcgaggcgctggcgacgaggcgacgctcctcgaacaactgcgtgcgcgtcgcggagacgatcgacgtcgtggcgtcacgagcgtcgggttccaccgcgacgacgtcgagatcctcctcgacggcgagccgatccgtcgcatgggatcgcaggggcaggtgcgtaccgtggtcgtcgccctcaaggtggcgctggcacgcgcgatggaggcggtgacgaaggagccgccggtgctggtgctcgacgatctgctcgccgagcttgatgccgagcgggcgcggcgagcggtcgcgatgatggaggggatgcaggcgttcatcagtcacaccgcaccggtggaggggtcgggcttcgagcttcggatcagccatggagccctcgtcgacgcgtgatcgaggacgagtgccggggcccgtgcccatcgctgaggtgctcgcgaagctcgataccgctcagcgggccggcgtggacgtcgtgcgtcgtggcgaactcaagaccgtcgtgcgcgaggcgctgggaccagccctcgtacgtcgatgctcgttggtcaggctcgccgaggacgagatcgtcctcggcgccggtggtgccggtctcgtcgccctacgtggtgcggcagcacggctccgcgtggcgcttgcggaggcgggttaccagggtgagctgcgtctcgttgcgatcccgggagagccgcgaccctggtcgcagctaggctgaggtgggctcgagcgcccgtgggtgtgagtctgctcgcagtgtgtctgcatcgccacgagcgtggatgacgcatcgagcagcgtaggtggtcgatcgaggaaggatcaagagcttggagcccgaggcaagctacaccgcagccgacatcgtggtcctcgagggcttggagcacgtccggctgcgcccgggcatgtacatcggctccactggtccgagcggactgcaccacttggtgtgggaagtcgtcgacaacgcagtcgacgaggtcatggccggcgcctgcaccgagatcgacgtcaccatcctcgccgacggcggctgtcgggtcgaagacaatggtcgcggtattcccgtcgacccacatccatcagacccgtcgaagtcggcagccgaggtggtgctgacgcagctcaacgctggcggcaagttcggcacgggtggttataaggtttctggcggtctccatggcgttggcgtgtcggtcgtgaacgcgctgtcggcacgcctcgtcctcgaggttcaccgcgacggtagcacctatcgcatggagttcgtcaagggtgggacgccgacggggccgctcgagcggatcggctcctctggaggccggcgaggcacggtggtgaccttctggccggatccgacgatcttcgaggacactgagttctctgcccagaggatcctggagcgcctccaggtcatcgccttcctcaacaagggcgtggtcgtgcgcttccgcgacgagcgtcctggtcgagaacatgaacagacgttctcctacgcaggtggcatcgtggacttcgttcgccacctgaacgagcccaagggacccctctttgcgaaggtgggctactacgccgcgagcgaggaggacatggaggtcgaggtggcgttctcgtggaacaccaccttctacgagacgctgttcaccttcgcgaacggcatctccaccgaagaaggcggcatgcacgccgagggcttccgcaaggcgctcacgcaggtgatcaatcgctacgcgagggcacggaacctgctcaaggagcgcgatgagaatctcgaggggaacgacatccgcgaggggatgaccaccatcgtgtcggtccgtctcgtcaacccgcagttcgagggccagaccaagacgaagctcggcaacgtgtcggtgcgatcgttcgtcgagcgtgtgaccaacgagcacctggcgacctggctggaggagaaccctcgcgaagcgcaggcgatcgttcagaaggccatcgtggcacagcgtgctcgcttggccgcgagacaggctcgcgagctcacgaggcgtaagtcggggctcgagagcgcgggtctgcccggcaagctcacggactgcacctcgcgcgatccctccgagtcggagctgttcatcgtggaggggaactccgctggtggcacgaccatcaagggacgtgatccgaagacccaggcagtgcttcccatccgtggcaagatcctcaacgtcgaacgtgctcgactcgacaagatgctctcgaaccaggagatccagtcgttgattgcggccatcggcgctggagttggtgacgagttcgacatcaagaaggcccgctaccacaaggtgatcatcttggccgacgccgatcctgacggatcgcacatccgcacgctgctgctgacgttcttcttccgtcagatgcggccgctcgtcgaggcggggatggtctacgccgcacagccgccgctgtactccacgttgctcggcacggagaaggtctacatcaagaacgaagccgagcgcctgcgctttctcgaagcccaccccaaccacaagaagccattcctgcggttgaagggtcttggcgagatggacttcgacgagctgcgcgacaccacactccatcaggatcggcgaaccttgctgaaggtcaccatcgagcaggcggcgatcgccgacgaggtgtgcagtgtcttgatgggcgacgacgtcgagcagcgccgtcgtttcatccaggagaacgcgggcgacgcgcgtttcatcgacttctaggtaagcgacatcggcccacgaggagatctgcgtgcctgacgaacccacccccgacgcttcgaacgtcgagctcatcgagttgcaggaggagatggagcgctcctttctggagtactccctctcggtgatcattgcgcgagcgctccctgacgcgcgcgatggtctcaagccggtgcatcgtcgcatcctctactcgatgtacgacgctggctatcggcccgatcggccccacgtgaagtgcgcgaaggtcgtcggggacgtcatgagtcgcttccacccacacggcgacgctgcgatctacgacgcgctcgtgcgcatggcgcaggacttctcgctgctccatcccttgatcgatgggcacggcaacttcggttcgcccgatccgtcgacgggtcccgcggcgtctcgctataccgagtgccgcctcgccccgatcgcccttgagctgctcgcgggtatcgacgaagacacggtcgacttcgtcccgaactacgactcacagaccgtcgagccgtccgtactgccggcgcggttcccgaatctgctcgtcaatggatcacaaggcatcgccgtcggtatggcgacccagatcccatcgcacaacctcggtgaagtggtcgacgcgattgcgtacctcatcgaccaccccgaggccaccgtcgacgagctcatgcgcttcgttccgggccccgattttcccacgggtggcatcattctcgggcgagatggcatccgcgacgcctaccgaaccggccgggggagcgtcaagcttcgcgccgtggccacgatcgaggaggctcgatcgggctaccagatcgtcgtcaccgagattcccttccagacctcggtcgaggtgatcgccgacaagattcgccacctcgtcgaggagaagctgctcgaagggatccgggacatgaagaacttctcggcagggtccgagacgcgcttcgtgatcgagctcaagcgtgacgcgaatccgaacgtcgtgctcaacaacttgtatcgactgacgccgctccagacgagcttcccgatccagatgctggcgctggtcgatggcgcgccgcgcaccttgaacctgcttggcttgtgccagatctacgtcgatcaccaacgcgaggtcattcggcgtcgctccgagttccgtctcggcaaggctcgagagcgactccacatcgtcgagggtctcctctcgtgcatcgaccaactcgacgccgtgatcgcgaccatccgagcctctgaggatcgtgcggctgcccgtgccgcactcatggccgagccgttcgggttctctgagctccaggcgaaccacatcttggacatgacgctcgggcgcctgacccgtctcggacgtgaggagctcgaggaggaggcggcgacgctccgagcaaccatcgctgaactcgaagcgatccttgccgacgcccaacgactgtccgcggttgtcaaggacgagatgctcgcggcgactgccgagtaccgccaggcgcggcggacccgcttcgaggtggacccgggcgacttcgccgcggaggacctcatcgaggacgagcccatcgtggtgctcatcagccgttccggctacatcaaggccgtgcccgagtcctcgttcaaggcgcagggccgaggcggccgaggcgtggtgggggcgcgagtcaaggacgaagacgagatcgcccacgtcatctcgtcgtcgatgctctcgaggctgctggtcttctcgtcgcgtgggcgggtctaccaactccggggttacgagctgcccaagctcgagcgatcggcgcgggggacggcgctcgtcaatctcgtcccgttggccgacgacgagcgcatcacctccgtcatgggcacgaaggacttccccgaggacgctgacctcgtgttcttcacgcgcaacgggatggtcaagcgaaccgccatggccgagtacgcgcgctcgcgtcgtgatgggatcatcgctatcgacgtgcgaggcgacgacgagctcgtgagcgtcgtcgtcgcgaccgaagagcacgatggcgtcgtgttcaccaagcgcggccaggtcctgcgcttcccactcgctgaggtgcgtcgtaccgggcgcgcgacggcgggcgttcgctccattcgccgagcggacggcgactggatcgtcgcgggcgggctcatcgaagacggtgtcgaggtcctgctcgtcacgagccgcggttacggcaagcgaacccccctcgattcgttcccggtgcaccatcgaggcggcgccggtatcagaggcatcggcttgaccgagcgcaagggagagctggtcgccgcggccttcgtgaggccggaggacgaggtcctcatcgtgagctcgcagggccagatgatccgcgtgcgcatcggcgacatctccaaccagggtcgctacgcaaccggggtcaagctcatctcgctacaagccgaggagtccgtggcgtccgttggcgtcgtgccagagagcggtacggacgcataaagattcgaatcggtccgtgccgatgccatcggtgcaagggagtgcgcgatggcacggtggaccgctcggtggcttctacaagtcgcctcgactgtcgcgatggcgggcgtgctcgccgtggtgcccggtgcccgcggctcgggcacaaagaccctgaccggatcacaggtcagttggagcatcgcctgggtgccggcttcggtcccgtcggtcgcgctcccgagcgtgagcttcgccagcttcgaggaccccacgaacccgaccgagggtccccagccgacgttccctcatcccaacatcgctacccccgaaggcgccgccctgtccgtgggccaacccatcatcgtcgcgccacagacgagcgagctcgggacgaccctgtcgggatctgcgaccgtcgccggtgggatcgtcgtcaccgtcacggtgaatggggtggccgagcccccggtcaccgtgtcgaacgtggcgagctacgcgatgagctggcaggccagtgtcgaggacgtctacgtgtcggccggcacggtgccggcgtcggccccgatcctcgctggcacgaacgtgctcgcgcccaccgccaacgacgtcacgccgacaggctcgctcgcaccgggcacgtttgggtccctgtgcgacgctggcgcggtgagcgcatccagtgatctcttctcccgcctcacgccggccctcgcccagtcggcggcgggcaagctcagtccgctggtgtcgacgccgaccagcgaggatccgggcacgtgcgccatcgagttcgctgcaccgtctggactctcgggtggttctacctggaccgtaaacgctcagctcgccgcggccttcaccgcgacggcgacggcacgactccagaccgtgcatctgtccgtcgatggtgtagccgtgacaattcctggcggtacctacagcgacgtgacgctcgacgttccaccttgggtgctcggcccggcgacctccatcgacgagcaggtggccaccgtcgagtcgcttccggtgggcgctgcggtgttcggaggctagggtcgtggccaccatcgcacccggggtcggacgaaccgagagccttgcgcctcgatcgctcgccgagctgatcgagcgcggcccgttcgagcgctacctgcgcgagacgctcacctggtcgctcgtgtcacgcttcctcgtcgatgcgcagcgccacgctgacgacgagcgtcaggccgcagagttcgaccattggcacgagcgttatcgggctctcttctctcgggccgccgacgaggttctccagacggtgagccaggagatgctcgaccacctgagtgtgctcgagaagcgggcggccttcaacgccaactacgtcgccatcggcgagcgcatccggacgctgctgcaagcgcgtccggatgccgacgagatccagcggctgccgaacgtcggaccgctgctcaccatccgtctctacggggagatgttcgatctcgggatcgtgttgctgtactacttcgcgtccgaggtggagaacatccacatcgtcgacgagcgcgtcaccgtctacacgagtgatggtcgagcgtggctctcgatgatcgatgcggccgccgacgggcgcgccctcaaggaccgtggtgcgcagttcgcacagatctccgggggaggcgtacctcaacggttcgaccccgtgcaccacgccccgaacctgacgagcccctacgggatccgcatggcgctccgccagcgcaccactcgatcgggggagtttctcgctgcgttgcgcctgcaccatgcgaccaatatcaccttcgatgccctcatcgaacagggggtcctcagcgaagaagcgggcctcatgctcgcgcaggcggtacgagctgcggtgccgatcctgatcgcgggggcccctggatccgggaagaccacgctcctgcgcgcgctcacgaagttcatcccgcgcgccgaaccggtgctggtggccgagaactacgaggaactgcatctcgaggagctggtcgacgaccgcggcaggccctggttctacgtgctccacagccacgtcgagcaggaggccaacgccgagggtgcgggctcggtcacgatgaagaccatcctcgaacgcggtctccaggaggatgtccgtcggctcgtgatcggtgaggtcaccgacccggagacgatggaggtgctgttgcaggccgccaacacgggcacgagcggcgtgctggccacgatccacgccgagagcgcgctcgacacggtgaaccgcgtcttcgggctgttgctgcgcacgacccgttacacggaccgggccgctgcctatctcatcgagagcacgttgaacctggtcgtgcactgcgccttggtgcgcaacgagcagagccgtcggcgggtcgtcacggggatcgggtgggtcgttccccatccgggccaggtcggtggcatgccacggatgcagatggcgttcgtgcgcgaggggtcggctctcgtgcgtgccgtggaccatgccaacgtcgcgcaccggctggaggagctcgtcgcgcggaggcgctcgtgagcgctcaagttctgacgccgagagtgacgatgcttactacgacgggtggtcaagcatcgtccgtcgagagacggcgcgagcgaaaggagcgtcgaaatgggaaggcgcatggtacgtggcgcagcgtggtggctggcctcggtggttcggtcggtgatggcagtggtcaccggtgggcctgctgcactggtgtcgctggcgagcgacgagtccggggcggagacctcggtggcgacgatcgcctgggtcgtgctcgggctcatcgtggtggcgttcgtcgtgttcttggtgttccagttcacgggcagcgcaaccagcgcggcatccaataccaacaatcagctcagcacccttccacagggatagcgggcatgttcgctcgtcgcctgctcgtcgacgagcaggcgacgagcacggtcgtggggccggtggtcgtggtggtgtttctcatgctcatcgcgctgaccatcggcttcggcgcgttgtgggtcgggcacgtcgaggccgtgtggggtgctgaggcgatcgccgccgacctcgggatcggtggctcgcccgcccaaggtttcgccttcggggtcctgcgcgacgtgacctggtcgatccagccggtcagcgtgagtggtccggacgcgccgggagctgcgtccatggtggtcgtgcacgccgatctcggcggtctcgtgccggtgacgagccaggtcgcgctccagccgcccagccagctcggaacgggagcgtgatgcgacggctcctcaccgacgatcgagccgagagcgatgcggtggttgcactgccagcggtggcggccgtgatggtcgtgctcgcggtctcggtgggcgtcgtggtgtggtgggcggccgcgcaatcggcccaggcgatcgccaatgccgccggattcgaagccctgagtctcccggtcctcgggactccggccgccgagtcggcgctcggtgccatggtcgcggccgagaccgcagcgcgctccttcccgccgctcagctgcgccctgagtgggctcgacgtcgccgccgcccagattccagcgtcggtgaccgtcacggtgacctgttcgacgaccgttcccgtgctcgggttcgtgcacttcgagcggtcggtgacgctgggcctgaacccctcacacctcatcgccgggagtacgccgtgagggcgccgagcgagcagggagacgcgacgcccgcgctgctcgcggtcggatcgatcctgctcgtcatgggactcacggtggcggccctcgtgctcgagagcatcacgatggccgagaccatggcgcgggcggcggcgcgggcggcggcgcacgccgctgccaacgtgctctggcagacggctgggaacgcggggtcgccagggctcgtgacgatgcggaatccgtcgttctacgatcccaacctccagagcgcggcctcggcagcgctcgcgggggtcccacacggggtcggtacgagcgtcgtgtcgtgctcgggcgggctcgtccccaacggacacggcctccagcgctattacctcgacgtacgggcgacctgcaccgtggtgttcgtcccgcccatgagcgatctcatcaccgtggtggccatcagcccgatcacggtcacggcctccgcccacctcgtggggagcctcgcgtgagcgcgcgtcgtgtggccatcggtctcgctgggtcgatcgcggaggtcctcgtcctgacaccgtggtcgctcccgaatgagcgcgtcgtggcccaccccgtcgtcgtcggggccgcggcggtgtgcgccatcgctgcgcttgcgctgtggtggcggtgggtgctggggcgaggtggtggcgaccattcatcgatccccgacggagtccgcgccccggcgcgagcgtcggtcgcggtcgatctcgatctcgacgcagtcccagccatcgaggtgcccggcgtcgggatcgtcgcgatggaacgctcgacgtcgcagtgggtcctcgaggtcgccgccgagcaggagctccaccgcgtggcggagcacgcccggctgcatcggccgcgagggatggtgccgctcgcagtgccagatcgcaacccggccgccgaggacctccgcgccctcgtccgccttgaccatcgcgtccgctcctcgccagcgcacgagggctcgctcacgccgctgcgctctggcgaggtcgtagggggtcagcgccacacacacgccgacgcagggtcggcatgcattcgcgtcgtcgaccggctgggccagcttcgcgtgctcagcggactcgtcggcatcgagcccggcaccggtctcgacctcatcgtccagcatcggctcttgccgtggctggagccggttcgctgtgtcgtggtcgggatgcgacgtgaggaggtcgtggccttggcacgatcgtcggtgctggtcgtgtccgacatccggcgggcacaggcggtgctcgacgaggcagtgagtgcgacgaatggattcccggtgctggtggtcgtgcatggtgtcaggcttgcaatggatgacgtgcgtgcgctcggtgcggccggacgcgtcgtggtcgtcgagacgagtggacctcccgacgtgtccttcgcctccatcgatcgtgggcgctggcacggcgcagtggagcggttgagtacgttcgcgccgaccccccttctgccaggtcaactgccaccgcccccacgacccgggagaccctgggtgcgcctgtgcggcctcgagccacggctcgagggcgtcgccgcgagccgagacgccgcacagttggtcgctgcgctcgtgctcgacggcggccgcgccacgatcgacgcgttggccgacgcgctcgagcgtccggcgcggaccgttcgatccctcgcacgcgaggtgcccacctgtgtggacgacgagcgtgacgggctccggttgcgcccaggtgtgggatccgatctcggcctcgtccaccgggtcgacgaggcgatccgcatcgtcgacctcgtggcgaggccgccacttgccgcctacgagcagccgtggtttcgcgctcgagcgccggtcctggaggcggtcctcgtcgactccctgctcgccaccgcggaggcactcgagcgcgcggacgctcgtggtgaggcgaaggtgatcgtgcggctcgtccgccggacattcggaccgctcgagcggctcgaaggcggcggtctgcgccccgacgggaccacgggtgcagacgagggcgtcgcccggagcgaggaggtcggcacccacgtgccacgagcggcgttggtgaggccaggagccgtggggtcgtggtgagtagcttcgatgagcggcagccatcggccctcgggtgggagggtgtcgatcaggcgccgtcgacgggcctgtcggagaccgaccaacatgtgttctgggtcgaggtcggcgatcggatcggcgaaggcctcggcctgatcactgctcgcagcgaggttgccgaggtggagctcatcgtcgggccgggtgacgagcatcgcacggtggccgagccggtgggcggcgccccgtcgaactggggcgacttcggggatctcggaggggtcgctcgggacgaccgcgacgacgagccgcggaggctggtcgtcgcggcgacggaacccacggccgagaccggaacggtcgcggcggtcgacgtcgtgacggcgccgctgatgacgcgtccgcgacgctcgcgatggcgcacctggtcgatggtgctggcgtcggttgcgctgatcgtcgcggcgcgcctcctgctcttcgtcgccaccaccggcggacggcacccatgatcgcagcggtgtggctccttgctggcgtcggcgtgatgggtgcgcacctcgtcgggcccggacgcgaggacgctcggagccatcgcctgcgccgacgtggttcgctgtggatcgttactctcgtgtcggcgctgtacgccgtcgccggcctggcccttgggttcgagccgcttgggtggctcccgctcgcactcgggctgtggctgatcctcgtcgtcgcgttcgtggtgctcttccagcgtcgtcacgtgggaggtgccgacgtgcgctacgtcggcggggcgctctggctggtcgccgtcggactcggtccggtcggtctcgtgtggttgccgctcaccttgctcggcgcaagcctcgcgcagctcgcgtggtcggcgatctcgggtcagcgagggccgtgggcgatggtggcgtggctgagtgcagcaggactcgtccttgcggtcgttgctctgattgctgaggtggcactgcgataggcgctcaatgggagccgtcgtcgtgccgacagtagtcgagagcgaaggaggcggacgtggctcgagatgacgccgcacggcgactggtgatcaccggcgtcggcatcgcgttcctcggcttggcgatcgccgggacgagtgtctactacctcgagacgcgtgtctttcgcgaggtccagatcgtggaggccgccgccgagctgctccctgggcaaccgatcgctcgatcggagctcaccgtcgtgacgaccccggcgcagatcgcctccgggagcggggtcgtgctggccggtgcgctcgacgccctcagctcggggagctataccgtgtcggtgccggtcgcccccggcgcgccactcgaggttcgcgagctcgccaagcgtcctcctcgaggggaacgcgtcctctacttcacgccgcaggtcgcgccccccaacctggaggcgggctcggtgatcgatatcctcgtgcctcagccgagcaccgtccagacgcagtcgtcggcgcacgtcccctacgacgttccggtcgcgaccggcgtgacggtgctgtcggtgacgcatccctcgtctggatcatccggttcgctcggcatcgaggtcgcactacctcccgccgaagtcgcggccgctgcggccgccgcgaccagctcgcagtgcgtcgtggtgttctcgttccctggtgcccgacccgttccggtgggctagccatgctggtggtgttcgggctcgatgcgaacgtcggtcgcaagcgagtcgccgctgccctgacacgtgctgttccggggacccgcctgctggtcgaactcggcgtgtcgggtacgacgtggtccatggcgggagccgagttccagaagcgcaccccgaccctcgaaacgatctacgaggtcctgcgcgagcgcaacgacggcatgcggcgggtgcgcgtgcacctcgacaccgtggtaggtgcgctgagcgacctcgagagcgcacggcccatcagcgccgccgatgcgtcgcgtcgcgatgtcgtgcccgtggtgcgcgcgcccgtcagttcgaccgaggccgccgagcgcgcgctcgagttcggctcggcgctcgtcgagctgttcgtccagctggaacgctccagcgttctcgggcccaccaccgtgctcgccgacgcgggctgggtggcgccgggtctcgtcgggcaggcggcgtgggccgctgcggcgagcgatctggtgctcgtggtcggggagcggccggtggcgatcgcctcgctcggctacttcgagcgggcgttcccgcaggctcgggtctgggtcgtcgcgctggcggcgggtcgtcgtcgccgtcgtctcgctgaagtggctcgcttcgcactgcgcgcgcgtcacggcgtcgaggtcatcgccgtagaacccgatcagctcggatcggggaccgccctcgagcaggtcctcgagcccatcgtcatgggatcggctggttcgaccctcggggagctcggagcgtgacccgggccctcgtcatgatcgccgggagcttcctcggtatcggtgtcgtgggggcgttgatcgcgatcgccgtggctctccgccccccgagtgggggtcgagtcgaggaggtcgaacgcgtcggactcgtgtcgcgtcggccatcggcgctccggtctgcgcttgcgacgatgcacccattcgccatcgaccatcgactcgccatcggcgtcgcgcttgcgctgctcgccgggctggctggggcgtggttgctggtcgtcccgtcgatcctcatcggctacgtgctcggcgacctgttcctacggccggcgctcgccgagtcggtcgacgagctctcgtcgatgctccagttcatcatcgactttcgctcagggctcctctccggaggtgtgtcggttccggcggcactcgagctcgcgatcgatgcacaaccagcgggtcgcttcacgcgagatcgtcgcgtgccgtaccaacagatggccgatccctccgctcgcgagggggaggctcgtgttgcgttgagccatctcatcgagcgcacgaccaatccgttgatccacatcaccgacgtgttggtgtacctggcgctgcgtgcgacgaacctgcgggtggcgaaccagctcgatctcctcggcgacgtgctgctacagcaggtccaggcctatcgagggctcgtggtcaccgagctgctctcgtcgctcggcgaggtgcggctcatcaccatcatcaccatcggggcggtgtatgcgacgctcctcgcactcggcggctcgctcggcagcgacatcggactgtcactgctcgcgcaggtcgtcgcccttgcagggagcggggcgcagctcttgtgggccctctcgttgcgtcgtgatctcgagttcaaacttcggtacctgtgaggtcgtgacccatggatgcacggtggctgatcatcggggtcggtatcgcgattggtttggtcatcgccggagccggcgtcgcgctcgccggaggcagcaccctacttgcgctcagacgctatgcggcagcgctgccctcgatcgcgtcgcgctcgcgtgtgccgctcgcgcggcgagtcgttgccgccctggcgcgacggcaagccgacttcgatgccacgctctggatcgcgcactggtccaccgaggatgccgtcgcgcgcctccagcagctgtggctggtgctcgctgttctggctggtggcctcgtgctcctcgcgaaggccgtcgtgccgaacctgtcaccgttcgtcctggcgatcgtcgcggcggcggcgctcgcccttgccgcggtcgttgctcgcgtggtgctggtgtggcaggttcgcgccgaggcccgcatcgcgcgccagcgcatcgacaactccctggccaacctggcgctcttgatccgggtgtacgtccagggcggtgcatcggcgaccgaggcgctgaccgccatcagcgagcttcgaggcgtcatgagcgacgccggtgcgcgcgatgtcgacgcgtggatccagggatcccagcgcaacgaccagaacatcggggccgtgctcgagcgcttcgggaacacctatggtgtgccccgcatcgcgcaactcggctcgtacctcgagcagtcgatcctgtcgggtcggccggtctccgacaccctggacgtggccattcgagacgcttaccaggccctgttcgagtccaccgtcgcggcggtgaaccaacgggtacgcatcgcgtccctggtgttcatccctggcgtcatcgcgatcggcgtggtgttcatggcgtcgatgatcgcatcgatgcacggcatcgggcaggtgacgaagctgttcggcggcggaggcctctagcgagatcagttggtggccgtcagcggcggctcacccgggtagctccagagcggctgccagggagagatcgtcggatcggccatcgcggaggccgggctctgggcctggttggcccacttggcctgataaggaagaccctcgaactccacgacctgaccgggttggtacgtgacggtgggctcccaagtcggatcggcccctggaggcagcgtcgggagtgtcggtgcgtgatcgctctccagcaccggtccgaggagttcccatggcgtctggtaggcatactcgaactgctgcgtgggctgttggccctggttgtaccacttggcctcgtagatgtagccaccccacaccaccttgtagccggcgggataggggaaggacgcgctccagatcgggaagggcgcgttggctgggttggcgctcaccgtggtcgtgacctggatcagcccgcgaccgcgttgcacggacgcagggatctgatgctcgatctcgctcgagaacgcgagcggggctgtctgtgcgtcggagcaggtgttcgagtagacggcttcgttcgccagcgatgcggcgcacggcgcatcacggttcagcgaccagaacgagacccgcccgatcgcctgtgacgtcgaccacgccacgagctgcgacgcgccctggaggctcacccgttgaccgacgacgttgttctgaccgatctggaacgtcacacccatgtggttccagatctggtgggagttgagggggatacggtactcggcgaacagggtcgtgagctgctggtgtgccgccgtgagtgcgctctcggcggtttggacgaggcccccgggcgtcgaggtgaagtccattgtcatcacgttgacgccagcgagaggaacccgcttgaggagcatcgcgcggatcgccgcgatgcctgggtccgacagtccctggggtgtcgctggtagcgtgagccagatctggatcccggggtcttcgtgagccacgatcgacagcgcggctgcccgtcggagcgtcgccgcttgactcgtgagcgcggggccctcgatatcgaagtcgacgatgtgttggtcgtactggcggatgatctgctggtacgcggcggccagcgacgtcggcgtcgtgcacgccatcgacaagtgggtgtgggcttggccgccgaaggacacgatcgcggtcccgccgatgctggcgtactcggcgagccgggagttcagggcgaggtcctggttggcggcgctcggggtatagacgccaccccaggtgggtgagcagccgttcgtgccgctcgcgacgacgaacccgagcaccgtctgcttcgcgtcgttctgggtcggatcctggaacgcataggtcggcgacagcgtggcgtcgacgtacggggcgaagtaggtcgcgtggaccggcgctgcgtcgatgatccgctggtggatgcgccacgccgccagcgagccagctccaccgagcaccatgaggcccatgaggatccgcacagggctgtagcggcgcaggcgctccccgagcggcggcttccgatccggaccgtctccctccagctcgtgcggcatcacgagatcactgacagtgatcaaaggctgcaatgagtggtcaccaagcggagagagctcgtcgtgtgacatcgctactcctgtcgaaacgggtcgttgtcggtacggacgagtgtagcgtggagcggtcgtgtcgggccctcgatcaccctccgtggggttcaattctcagttgagcccacaatgtgggttcgagtacggtctttgccctccgcaacaagctacactctgcgtgagggtggttctaccgtggtgggcggtctgcggtcggtctcctacgagcacgggagggagaacaggttgagtcgccaaccagccggtacgcatggacagcgagcgcaggttcggctcgtcggtcaggccgctcaggtccccgagtcccgcatcgtgacggcgcgcctcgcaattatgaccactattggtggttgggtcggttacctgatctactggttctactcacagttcctgcgccaaggggcctacacgacgcaggcgaaggccgaggcgatcgcctacctcgccatgatcaccctgctcgaggcgtcgtcgttggcgtacctcgtggcgaggctcggccatatttaccgagctcgcgagcatcgtcgggtaccgcgggctcacctcgacggctacttctggcagcgtcgaccgagcctcaccatgatcatcccctcgtaccgcgaggagactcgcgtcattcgcaatacgttgctgtcagcggcgctacaggagtatcccgacaagcgcatcgtgctcctgatcgatgatcctcccaacccgacggaggaacgccatcgcgtcctcctcgaagcggcacggtctctgccgagtcagctcgagtcgctcctcgcgtaccctgccaccgcggctcgtcgagcttacgacgagttccgcgagcgtgtcggttccagagtgagccagctgcccgcgatcgttcacgagggtggatcggactccggtgccgcgtgggacggcgtggtggtcgacccgagcgagctcgaacagctcgccgatacctatgccctggcggcgagctggctcacccttcagagcgaagaactcccgatcatcgaccacaccgacgagttccttcgagacgaagtgttcgtccggctggcccacgaatttgcacagatcgccgacacgctgcgagagggcgcgagctacggccgtgaggtcgacgcggctcgcctcgcgcagctgtacgaacggctcctcaacgtctttggcgcgcgcatcacgagcttcgagcgcaagctctacgcgtcactctcgagcgagccgaacaaggccatgaacctgaactcgtacatcggcttgatgggcggtgcctatagcgtccatcgcacgctctcgggtcaggtcctcgtgtccgacgaccccgagcacgcggacctcgtcatccccgacccggactacgtgctcaccttggatgcggactcgaccctgctccccgagtactgcctccggctcgtctacttgatggagcaggaggcgtacgcgcatgtcgcggtcgcgcagacgccctactcggcctatccgggccccgcgtcgcgtctcgagcggatcgcgggtgcgaccaccgacgtccagcatgtggtccaccaagggctcgccaactaccgggcgggtttctgggtcggcgcgaacgccgtcattcgcaagcgcgcgctcaactccttggaggagatcacctgggaaggcggctacccgatcaagcgctacatccgcgaccgtaccgcgatcgaggacacggagtcgtcggtcgacatcgtcgcccagggctgggaaatctacaactaccccgagcggctgagctactcggccacccccccgacttcggtgccttgtgcatccagcgtcgccgttgggctgatggcggcctgctcgtcgtgccgaagctgtggcgttaccacaagcgggccaaggagaccgggcgtcagtcgttcgccgagttcttcctccgcatgaactacctcgcgtcgatcacgtggacgaccgtcgccctggtcgtcctcctggtgttccccttcgcgaacgagctcgtgagtccctggatcgccgtgctcgccctcccgtacttcttcgcgatgtcgacggacctgaagtacgccggctatcaccgtcgcgacatcttctcgatctatggtttcaacctgatcctcgtcatggtgaacctggctggcaccgtcagctcgatcggccaggccgtcaccggggctcgagcttcgttcgcccgaaccccgaaggtgcgcaagcgcacagtcaccccgctcatgttcgtggtggctccgtacgcgctcgtggtgttgtcgatctacaccctcttgcatgactgggagcaccacgcactcaactcgatgctcttcgcggcgatcaacctggtcctcgcggccgttgccatcgtcgccttcatcggcgtgcgcaacagcatccaggacgtgtggatccagatcctcccatggttccagcggcgcacgaagaaccgtcccgtccgcacgacacgccatcaagaggtgcccgtcggagtcgggggcacccaactgggaacctgggagcacgtcctcgatctcggtgcgtcctcgatcgggttgggcgaggccgtcgataccgacgggcctggtcggttgcgcgtcggttcgcgagcagagcgcgaacgggcgcggcgccggctagccgactacgggctgagcgcgctcgcccagccgatccgtgacattgaggccgacgagatcgtcggctacgagatctatcaacgggtcaacggtgaggcaccgccagcccagctcgccaggctcgacacggtcgaagcggccagccttgagcagcggctcctggagcgcgccgcactgctggcacgtgacatccctgagggcgcgtggctgagcgtgaatgtgtcgtcgcgattcttgaccctgatggaagggcggcgacgcttttccctgacggcgcgcgaggggctgttcctcgacgtgtcgttcaccggcgtgctcgacggccctcacgtcgcggccacagaggacacgctctcgcgtgcgacgaaccggttcgcgatcgccctggacgatttcgtccccgatgcaggatccctggcggtggttcgtcgggtgcggccgagcatggtgaagctcgatcccgactgggtgcatgatctccccaagagtgccgcgaagcgtggccagaccgaactcctgctgcgtctcgctgcgccgcgtacgctcgtggtcgccgagggcgtcgaggacgagcgagagcttgcggcgctgcgcgcgctcggggtgcggtttgcccaggggtacctcctcggtcgaccggtcccgctcgaggagaccaagagcatcgctcctcgcgattaggcctcctcgcccgagtgggaccgccaccactcgaggaggcggcgcctcgcctcgtcgggatcgttcagcccctcgtcgatcgtgaggtcggtgaggaagcgcatcgcgcggcccacggcaggacctggtgggatctcgaggatgcgcatgacctccagtccgtcgatcggaggccgacgcgctcggagcgcgtcgcgctcggcgagctcccgtgcgcgctcttcgaacgtcgccatgcgctcggcgaacatgcgtcgtcggcgctcgttgcgggtggtcgcgtcgcaggtggtgagctcgttcaggtcctcgaggagctcgcctgcgtcgcgcacgtagcgacggacggcggcgtcgctccaaccctgagcataggtgtggaagcgcaggtgaagctcgacgaggcgagcgacgtcgtcgacgaggtcgttggggtagcgcagctctcgcaggatgcgacgggccatacgagccccgacaacgtcgtggaagtggaaactcacgccgttcggcccgatctcgcgagtcgcaggcttgccgatgtcgtggaggagggcggcgagcctcaggcggagccgcggtgagcagcttgcggtgaccgcgatggtgtgggcgagtacgtccttgtggtgatggatggggtcctgctcgagcctgagcgccggaagctccgggaggaactcggcggcgaggggcgtgtcgacgaggaaccagagacccttgctcggatcgggcacgacgagcagtcgagagagctcgtcgcggatgcgctcacgcgagacgacctcgaggcgcggggcgagttcgtggaccgcgtcgacgagcgcgcgctgcggctcgagatccaagcgcgcgatgaagcgtgcacagcgcaacatgcgcagcggatcgtcgctgaaggagcgtcgggggtccatgggagtgcgcaatcggcgcgcgagaaggtcctccatcccgccgaacgggtcgatcagggtcgggtcatcgctcgtgacctcgaccgccatggcgttcaccgtgaagtcgcgtcggaggagatcctcggcgagcgccgagacgaagtgcacggtcggcttgcgggtggaggagtcgtaggcctcgcctcggtgggtcgtgacttcgagcggcacgccgtgatagtggaaggcgaccgtcccgaagcggaggccggtcaggttgaagtgcgtcgcgacgggtctgacgatctccacgatctcctcgggcgtcgcgtccgtcgtggcatccacgtcaccgttcggctcgatgccgagcagtgcgtcgcggaccacgccgccgacgaggtagaggtggcgttgtcgttcgtcgaagcgtgcggcaagcggtcggagcgcctcgatgagtgggcggagtagggcggggagcacgtgccgagaggctacccgcgctcgttcgcgagacctcgctcgagtgcggcacgatgcagccgttggagggtcgtcacgagctcgtggtcgacatcgcggctcggggcctcaccgacgtcgaccgccgcatgcaggagcgtcgcgaacgtgaccagcgtcgagtgctcgagcgcttcgaggtcgtagccaccctcgagcgcgaggatcaggcggcctgggggaacggcgtcgcgcgcgatggcgatcaatggtgcatagtcgggggcgcgaaagtcgagttcggtgagcggatcgtcgcgatgggcgtcgtagccagcggacacgatcgcccacgtcgggccgaacgtggtgatggcggggagcgcgatggtttcgaggagtgcccgtgccgtctggcccgacgtctgcggggggagcggcaggttgatcgtggtgccgaccccagggccatccccgacgtcgccgatgcgcccagtccctgggaacaaggggtactggtgtgtggagacgtagagcacacgaggttcgcgctcgaagatcgcggcggtgccgttgccatggtgcgcatcgatatcgagaatgaggacgcgctcgccctggtcgatcagcgcctgggcggcgatggcgacgttgttgaggaggcagaaccccatggcctggtcgaccgtggcatggtggccgggcggtcgtacggcgaggaaggcggcgtcggcctcgccctgtcgaagccgctcgatcgcgtcgagcccagcgcccgcggcgagctgggcggcctcgaacgacgcgtcgttcaccgaggtgtcggggtcgatcggaccgccacccatgaggcagtaacgctccagtgcctcgacgtgcgctggggtgtggaccgcttcgatggcggctcggggtgcaggtgtcggcgtgacgatcgtgacggcgtcctcgaagtggctgagcgcatggcggacgacctcgagtcgctcggcacgctctgggtgccacgctccagcgtcgtgctccaagaaccgttcgtgcgtggcgtagaggatccggcccacagcgtcatcctacgccacgggggcttctcgacccgagtcggaggtcagctaccataggcctcatcggaaccccgttcgctcacccatacccagagccggccaccgtgcaggtcgcgggccgcagtgtccggctgtctccgtggtatggcttcgacggcgccgtgctgctcggcctcgcaccggcgctgtggctgcgtgatccggcgtggctcgacatcgctcgtcgtgcagcagccgcccgcggttggcgccgatttctcgtacaggcgacgactcctgcgcagcgtcttgcgctcgacgcagcagggtgggtcctcgtcgacgaactctacgtcttgtttcgacgagggtcactcgagctcccgccggtaccccacacggcccggggcgtcgagatgcggcgcgggagggcggccgacaccgcagagctgctcgaggtcgaccatcggtgcttcgagccgttctggatgatgaacgaggcggcgcttcgcgaggcgctccaggcaacgcctcgcactcgcttccgggtacttgcgagcgccgacgacgatcgagttgttgggtacgctatcttcggccttggcgccggtgagggctacctccaacgcatcgcggtcgaccctcgctaccagggccgggggctcgcgacgcgattgatcgtcgatggcctgcggtgggcgaagagatggagagcgcgccgagtcggtgtcaacacacaacgatcgaacgagaccgcccttcgcctctaccagcggcttggcttcgagatggagccgaacggcatcacgatctatgcctggccggatcactagtcgtctcgtcctcctcctcgccctcgtcgtgctgggtgtgtggttgcccaggggcgcagcgctcgtcagtaccgcgcgggaggccgtgaccgtggtctcggcgcccggcgtcgtcgtcggctcgcagccgatcgcggcgacctttcgcctcgcgcatcgtctccacgacgcggaggctttcttcgtcgtctatcccgccacgacgtcggtgagcggccttggtgcggtgctctcgggcgcacagctcgggtacccgatcgggatcacccacgccgtcgccgtgtccccgcacgcctcccagatgcacctggtggtgccagacccgatccctgccagcggctgtggcacgagctgcagcggcgtctacccggtgcagcttcgggtcgcgagcgcggtgagcgggcagaccctggcgtccgtgacgttcgcggtgccgtacttctcgacgctgagcggcgtcgttccgctgcacctcgccgtcggggtcatcgccgagacccctgccgtgacagcgtcggcgatcgaggaactcctcgcccgagacccgagcgtccaggtcggagtgagcgccgaaggcccggttggcctcggagcgctgcgctcgctcgcgcacgccgtgcctcttcgtgcatctctgctcgcgcccaccgttggcgtcgcacgcgcgtgtgtgggggcgctcgggcccttgtcgtcgttcgcatcgtcggttcagctggcgcgtaccgtcgttggcacggccagcgcgccgctcgcgttcgccaccgtgccgacgtcggacgaactcgaaagcctccgagcgctcggtatccacgaggtcatcctcccggcgtcggcccttgcgtcggcgtcgccggtcctgacgctcagcaacgcggtgcgcctcggcgcaggtgtggtggcactcggcacctctgcgatggtcagcgacgggctgagctcggtgacgcagcctctcggggcgcagctgctcatggccgaactcgcacaggtctacttcgaagctccctcgagacctgggcgggtactcgcgggtctcgtcgccgtcgcgagcgatgcgcgtatggcggcgttcgctcgcgggttggcaagcctgggcagcctccccttcctccagctctccaccatcgatggcgcgatggccaccgcgagctcgaccgtcgttcggccgaacgtcgccgccgagagggcgtgcccgcgcccactcgaggccctgcgcgtcgccgcgcgtcgtgccgcggccctcgccgaggctgcgcccggggtccgcccggagctcacggcgttggtgctcggtgccctggctcatcccgaggcaagccagctggcgcgtcacgccatcgatcgcaccctggatgcgatcacggtcgcctccgatcagctgacgctcacgagcgctcgcgagacggtgcccatcgacatcacgtcgcatctatcggtccctgccagcatccgagtcgtgctcgtcgacaccaagctccggttcccggagggctcgacacgcacggtcaccgtggcgtcgaagaccgtgacggtgcccatccctgtcgtggcacgcacgctcgggacctcgccgctcctggttcgcctcgagtctccctccgggcagctcatcgggcagaacgtcctcgtggtggactcgaccggtttctcggtggtgggcgtcgtgctgaccggttcgtccgcagccctgctcgccgtgtggtgggttcgcaatcggggtcggcgccagcggggccgacacgcgaagcggagctgatggtgcaggcgcgtctcgtgcggctgctggccggtcgcggtcgttcggtgggcgagaacgccaccgccatggcgatcgggacggcggcaagtcgtctcagcgggttcgtgcgcctgatcgtcctcgcggtggtgctcggggtgcgtccgttggccgacgccttcaacctggcgaacaacacgccgaacatgctctacgacctgttgctcggtggagtgatcagctcgacgatccttcccgtcgtggcggctcggatcgcgagggcgggggagcgagccggcgagcgctcgctcgctgcgatcatgacgatcggggtggtgggcctcctcgtggccacggtgctcttcgaggtcctcgccccggccgtcgtcgatctctacctcatcggcgaccatcttgcggctgcgggcacggagcgcgcggtcgcgatcgagctgttgcgcttgtttgcaccgcagctcttcttctacggcacgatctccctcgccaccgcggcgctcaacctgcggggcaactttgccgcccccgcctttgcgccgatcgcgaacaacgtcgtggcgatcgcggtgctcgtcgcgttcagggtcgctgacggctctgccaccctcgacgaggtcgcctcccgtccggacgcggtgctgctgctcgggctcggaacgacgctcggggtggcggcccagctcggcgtgctcatgccggtgatggcgaggctcggtctcggactgcgtccacgtctgcgcgtcagcgaccccgcggttcgcgaggtcgtctcgctgtccggctggacggcgggctacgtcgtcgccaaccaggtcgctctcttcgtggtgctcgcccttgccgcgacgcgggccggctacgtgtcggcctacaactacgcctacctgttcttccagctcccgtatgcggtggtgtcgctgagcgtgatgagtgcgctccagcccaggctcgcacgctcgtgggcagctggcgatcgagcgagattccggcgtgatctcgccaaggcgctcgccgtcggcgtcggtgccaccatccctctcgcggtgctcgcgtgggtggggggacctgccggcctcgatctcctcgtcggctatggggcggtcaacgagcacggcgtcgccctcatcgcgggtgcgctccgcggcatggcggtcgggttgcccggtttctcgctctttctgatgctgatccaggcgctccaggccatgcgcaatgctcgagctgcgttcgtcgcctacctggtcgagaacggattgaacatcgtcctcgccgtcgtcgcgctcggtccgctgggggtcgagggcctcgggctcgcgctgggactcgcctacaccatcggcgccatcgtcgcgatcgtcatcgttcgctcgctgcggggactcggccccatcgcgccgctcctcggctcgtgggtgcagctcgccgtcgcaagtgtcgtcggtggcgccgtgctggccgcgctcctccctagcacgctcgtcgcgccgaaccttggttttgccctgcgtgtcctcggcgggttggtcgcgggggtggtagtcttcggcgctgcggtgatcggcctccgcacaatccgagtggccgtggcgaggggagtcggacggtgagcgtcgtcgtcgttgcggattcagcgagtgatcttcctgccggggtggcagaggcgctcggtgtgcagatcgtgccgctcaccatcgaggtcggtggtcgggactgggccgacggcaccgagctcccgcgcgagcgtttctgggagctccaggcggcccagtcggagctgccgaagaccgcggccccatcgtcggcgcagttcgcggccgtcttcgaacgcgcgctcggtgagggcgctgaaggcgtggtggccatcaccttgacgcgcaagctctccgcgaccttccaggctgccgagcacgcctcgcgagactatggcggtcgggtgcgggtgatcgactccgagaccctcaccctcacagaaggcctgatcgtcgaggaagcagcacgcctcgctgcgagcggtgcggatctcgaggaggtcgcggcagcggtcgaggacgtgaagacgcgcgcgagaacccgtggcaccctcgacacgctcgagaacctccgccgaggcggacgcatcggcgcggcagcagcgctgctcggcacggtgatgtcgttcaagccaatgatcgacatcaccgacggcgaggtgaagccgggcggtcgccagcgcacgcggcgtcgagcgatcgacgatctcgtcgactgggtcgagggcctcggtccgctgacgcggctcggcgtcgtgcacgcgctcgctgacgacgtcgacgaggtcgtcgagcgcgtcgctcgcgcagcggcagtcgatcccgccacggtggcagttgcggtgatgggtgcgacgatcggcacccacgccggtccacgagcacttggagtctccgctctcgtggcctccaggtaggctgggagcgttccacgcgagagcggccacaccagagtccgtgagacgagcccagagaggagccagcatggcgaccttcgaaacgggaggggagcagccggacgtcgcggctcgcgtcgctacctgggttggcgaagcggtgtcgctcattcggtcgcggaccgtcgatccggcggcgttcgtggcccgtgtgctggtgtacggactgctcgcggctgcggtcggtgtcgtggtgctcatcttgtcgatcgacgccgtcgtgaagctgctcgatgcgtatgccttcggcaatcgagtctggatcactgagttcgtcgtcgcagccctctcgctcgccggatcggccgtggcgtggcggcggatgggacgtgcgcgtcggcgtctcggcgcttgaaccagcgcaccacgttgaggaggtagtcgtgcctgagcacgtcaaggtcgtcatcatcgggtcgggtccagctggcctcactgccgcgatctacgccgcgcgagcgtcgctcgagccggtcgtcatcgagggagagccctcctcgacgtccgaccagcctgggggccagctgatgctgaccaccgagatcgagaacttcccagggttccccgaaggcatccttggccccgagctcatggccaacatgcggcagcaggcggagcgcttcggggcgcgctttcggggcaccaaggtctcccggctcgatcttgcggagcggccgttcgcggtccacaccaacgacgatcgaagcggcgagccggcttatctcgccgacgcggtgatcatggcgaccggggctcgctcgctcatgctgggactcgaacgcgagtacgaactgatcggccacggggtgtcgacctgcgcgacgtgcgacggcttcttcttccgtggccacgacatcgcggtggtcgggggcggtgactcggcgctcgaggaggcgctgttcctcaccaagttcgcttccagtgtgaccatcatccatcgccgtgatcagctgcgtgcgtcgcgcatcatgcagcagcgggccttcgcgaacgagaagattcggttcgcatggaaccgtcgcgtcgtcgaactgctcgagcgcgacggtgtcctggtcggtgttcgcaccgaggacaccgtgaccggcgagcgcgaggatctcggagtcactggactgttcatcgcgatcggccacgccccgagcacggagatcgtcaagggtcagctggagatggacgatgcggggtatctgatcacgaagcctggctcgaccgagacgagcgtcgacggcgtgttcgcagccggggacgtgcaggatcacacctatcgtcaagcgatcaccgctgcgggctctggctgtcaggcggcgctcgacgtggagcggttccttgctgcgcgcgagtagcgggaagcatcgggtcgcagggggcgttcgttgctgatgcaacaagataagggaggtgcgcgatggcgggacatgaggtcatcctcacggacaagaacttcgacgagacggtcaaggcatcagagctaccggtcctggtcgatttctgggcagagtggtgcgggccatgcaagatgatcgacccgatcctcgaggagctggccgacgagatgagcgacaagctggtgatcggcaagctcaacgtggacgagtcgctcgagatcgctcgtcgcttcgagatcatgagcatcccgacgctgatgctcttcaaggagggcgagccggtgaagcgagtgatcggcgcgatgccgaagcgagccctgctgaaggaactccagccggctctcgaggactagcgcctgggcacgtccccgtgccgttcgtctctttgcgagggggcgagcgcagcgagcgtgtcgaggacttgtgtcgacggttgcggcgcctcgggttcgagctcgaggttcgtgacgagttcgacgatgaggtggccgaggccatcgtggccttccaacgacgtcgcggtctgccagagaccggggtggtcgatctcgtgacgtggcgcgcggtcgtcgaggcggggtttcgtatcggtgatcgtctcctctatctcaagcggcctgcgctccgtggcgacgacgttgcctggctccaaggcaagctgggctcactcgggttcgaccctggtcgagtcgacggcatcttcggtccgcgcacgcgcagtgcgcttatggagttccaggccaatatgggcctgcctgccgacggcatgtgtggtgcggcgaccatcgaggagctgcgacgggtcgatctgcatcacggtgcgcacgtacatggcgtgatcgagcgactcagccgcgccgaccgtcactctcggttcagtgacgtcgcggtcgtcgtcgccgccgaggcggcgctcgaaggcgtcgcggatctcgtcgcggctcgggtgcgtcgccgagggggccgctccgtcgtgctcgtcagcgacgtgcagtcggaacttgcccggacgatcaacgatgtcgcgccagacgtcttcgtccatctcgggtactcgctcggtggtcgttacgtggcctactactcgggctacaactacgtctctccggtcggtcggcaactcgcagaggtcgtctcccaaaccgccggtgcggtgcgaggactggtggagcgaggcatgagcatcccgatcttgcgcgagacgcgtgctcccggcgtctccattgcgttctccaacccccacgagtggtggatgctggcccccgatctcagcgacatcatcgtgacgagcgtggaggcggtggtgtgtcgagcgaggccgacgggaaaccatcgcgactgagtggctcgtgcgtcgtcatgagcgaactcccggtccgtgccgatggcacgccttgcgctggtccgcgggcgcgaacgggtatgatcggagatcccggggctatagctcagccggttagagcgcagcactgataatgctgaggtcgctggttcgattccagctagccccaccgtcctgacgagggttgtttcggcggaccggtcggcgatccgggcgttcgcaccgcatcggcaccacacgaggtcgcgggcctgtcgcgggacggctgtgtcggggtgccagctggattccttcgaaccgcagccccagtctgctggaaggtccttccaccctgactgcgatgctcgacgcgtcccgctcgagctgctcggaccgtcgatcggtggccttcccgccgtctgctcgacagtccgaggtgaagccagggccatctccccgcgggcccaggcaagctccgactcgaccggcggcacgtacccgaggcgcgagtgcagccggacagtgttggggcgccggatccagggagcgatgccagagggggccccggcgaggttggcgaagcggccgcaagctaccagctcgcgctcgcaagctcccgaagaaggcctcggccacggcgttgtcgtcgcaggtcgcgatcctgcctaccgactggcgaagcccgagcatcgcgctgagcgcgcgtaccgtacgggagaggcatggctccagtgcaacgaccggtcgcactggacggtaaccgacacgtccgcaccttggaatatcgacaatccgctatggtggcggcatggacagcgtcggcgaggtgctgagggaggcccgacgtcgtgccgggctgacgcaggcggaactaggtcgacgcgccggggtgacgcagagcgtcgtcagtgcgtacgagtccggtgcgcgccagccatcggtgtcgatgctggctcgtctggtcgccgccgcgggcgccgagctgcggatggagctgtccgaacctgcgggggccgcagcgccaggcggtgaactcggccagcggctgcgagaccgccgcgccgagctccagaggatcctggcccgctacggactgcgcaacgcccgcttgttcgggagcgtcgcccgcggcgatgcgggtccagacagcgacatcgatcttctcgtcgacgtgcctggcggagtgggcctcgtgactcttggacgctgccaggctgaggtcgaacagctcctcggagtccacgtggacctggtaccggcgagcgatctcaaggctggcgtcgctgccgaggttctcagcgaggcagtgccactgtgagccctcgggaacgtcagcgccttcaggacattctcgtcgccatcgccgtcatccgctcacacctcgagcgtggtgacctcaatgacgggctcgtcgtcgacgcggtacgagtccggctcatcgagatcggccaagccgtcaaggctctcccccaggagctgctcgcacaggagccagccctcccctgggcgcagatcgccggcatgcgagaccgtctcgcccatcgctacttcgacgcctcgcacgccatccttgccgccaccgtcaacgaggacctccccatcctcgaggcggctgttggccgtctcgagcggatcgtggcggatgcggccgtctggccacggccgtgaacttccgccgagcgagcctcgcagccgagagaccggctggcgaccacggccgtcgctcgggtctggctaggtgtctcgttcatgccttcctcctctcgcaggtgtcaccctggaggggggacagcaacggtcgtgggaggatccgctgcggcgatgagatcgcctccgtggacgccacgccctcgaccatggccgccggtgcctgcgccgtgcgtgggcggcccaggcgatggcgatcgcaggaggtgaggcgggggagcgagctcaccaggggcgtcgtcgacgcagctacgccctctcgcgcagtgcggtgaggaactcgatgagccccgccatgtaggtcgcctggtcgtcgtacatgcacatgtggctcccgttcggacataggaggaactggccctgcgggagacgctctgccatctggcgcatgtggtccgggtccatggtgtcatgagtcgcgccgatgacgagcgtcggcacctcgatggataccagatcgtcgaagcgatcccagtccttcagcgaggcgtcgcccgccatgcccatctcgctcgggccctgcatcggcacgtagatgtcgcgattggtgtgggcgaaggcgcgtaccaccggctcgggccactcgtcgagcggcatgcgcagcgtgtgttcgaggtagtagctccccatgagcagttcctcgtagcggccgctctcggtgtcgccggcggcctcgagcgctcgtgcttcggcgacgatcgctgggtcgagggccgggatgaggacctcgtcggcgtaacggttgtaggcgggagcactcgccatcatgttggagatgaccagccctcggagcgtgtcgccgtgtcggatggcgtactccatggcgaggatgcctccccaggagtgcccgagcagcacgaagttggacgcgtcgaggccgagggctcgtcgaacctgttccacctcgtcgacgtagcgatcgagtgtccagaggctggggtcgtcgggacggtcgctgcggccgcagccgagctggtcgtagtagatgtactcgatcgcagcgagcggcaggtagctgtcgaagcactcgaagtactcgctcgtcgcgccgggaccgccgtggagcagcaggactcgcaggtcaggggcgttgcccactcgcttggtccacaccgagaaggtccctcgaggcgtgtggatcgggatgcggcgggcaccacccgagagagcgtcgtcgcgggtgcgcgcgtcgagatagtcgtgcaggtccatcgctgcccccttgcggtcgagacgtctcgacgctagtgcgacgagcggggcgactggggccgaaacccctggcgagcgatcgcacgtaggctcgatgcatgacccaagcagcaacgtggcgtaaccgtgatgtgtggctgatctcgttgtccgctggttttgccgacctcggctaccaggcgatcgtcgccggagtaccgctgctgatcgtcgtcgacctgcgtgcgagcgccctggtgtacggcgtcgccgccggcctcggctacgggctggggacgttcgcgtcgctcgcgggtggtcggctcgccgaccgcatcggtcgacgtccggttgcgatcggcggcaacctcggcatcttgctcctgtcgctgatcgctctggcgagaagtgtccccatcgtcgtcctgctcttcgtgctgggctggctcgcgcgcaacttccgctcgccggttcgccgggccatgctcaccgaagccgtcgcgccggagtggcgccgcaatgcattcggccttctgcacgccgtcgacgtgggtggcggcgtgctctccgcgcttgcggcggtcgtgctcgtcggtgcgcacgtcgtcggtctgcggggcctgttcgccttcaccgcgatcccgatcgcgatctcgagcctgctgctcgccagcgcgcacccgcaccgtacgggcggcgccggcgcgcgtcgcgacgtcccgacggcgccggcgagcacgcttcgtcgtgcagtcctcgtcgcgaccgccctctatggcttcagctcctatgcgctcggctttccggtcctcgcggtcgcggcgcgctcaggatctgccaccgagggcttcggcgcctatgccttgttcctcggcgcctcggcgatcactggctacgtcatcggtgcgcgccgcgggtccccgatcggttggctcgcgcttggcggctacggcctctcggcacttggctcggcgctcctcgtgcccgagagcgcgatggtctcgatcatcggggttggactcctcggggtggggctcggcgtcatcgagacgttggagccgaccgtcatctcgcgactggcaccggacgcggctcaaggaggtgcgctcggtgcgctctcggcggcgcggagcgtcgggctcttcgtcgctgacgtcgtcgcgggtctgctgtatgcctcccacggaggtgtggcgttcgtctacggtgcggtgctcgcggcggtcgctgcgatcatcatcggcgcccaagcgccgctggcccgccggacgttcccagcgggccagtggtgagcgaagagcgcgtctagcgatcggcgtcgccgcgggcgaactcctccaccgcgcgtcgcgcatcctcgtcgtggagctggcgcggcggtgacttcatgaagtaggccgagggtccttcgaggggcccgccgatgccgcggtcgagggcgatcttggcgcagcgaacggcgtcgatgatgaccccggccgagttcggcgagtcccagacctcgagcttgagctcgacgttcagcggtacgtctccgaagttgcggccctcgaggcggatgtaggcccacttgcggtcctcgagccacgcgacgtggtcggacgggccgatgtggacgttgtgggagtcgatgccgtgctcgatctggctcgtcaccgactgcgtcttcgagatcttcttcgactcgagtcgcgagcgctcgagcatgttcatgaagtccatattgccgccgacgttgagctggtaggtgcgatcgaggacgagtccgcgatcttcgaagaggcgagccagcatgcgatggacgatggtcgcaccgacctggctcttgatgtcgtcgccgatgatgggaacgccagcctcacggaagcgctctgcccagaccgggtcagaggcgatgaagacagggatcgcgttcacgaaggcgacccccgcctcgagtgcggcctcggcataggcacgttgggcttgctcggagccgaccggcaggtaggcgacgaggacgtcagcacgggcctctcgcagacgcgccgcgacgtcgacgggcgggaggggcgactcggtgacgacttggcggtagtaggtgccgaggccatcgagcgtcggtccacgatcgacggtgacacccgcctcggggacgtcggcgaacttgatggtgttgttgtggctcgcgaagacggccttcgacacgtcgaggccgaccttctcgtcgtcgacgtcgaaggcggcgacgacctcgatgtcgcgcacgtggtaacccccgagcgtgacgtgcatcaggcccggtacgtcttggtcgtcagtggcgttccggtagtactcgatgccttgcaccagcgagctcgcgcagttgccgaccccggcaatcgcgaggcgaatcgttcccattctgttccccttctcctttctgagcgccgatggtctgagcgtcgatggctcgccgtcgtcggccgcatgtgacgacgttcgcatcgtcacgaggtcgtcgatgcgccgtagccagccggcgcggcgtcgaggaccgcgagttccgaggccgtgcgtgcccggacgatgtcgagccagaggtcgggcatctcctgctcgagccggtcgagctcctcgagacgctcgacgaggctgcgccgacgaccgcgcagcagtgcgcggcgcgtctctggcgcgaccagcgaactcgccaccagcgcgatggtcgcgatgcgatcgtcggccatgtcggcgaactcgagcgcggtgcgcaggcgcgcacgtccctcgtcggtgatgcgataggtccgtcggctccggccacctgcggtgctggcagccaggaccaactcggccgcgaggacgccggggaggcgagctggatcgaggcgacccaccgcaccgacggaggcgatgagcccactgcgcgccaagcgagcgagcgccggatagatcgaaccgtacgagaagcgaccgatctccccgaaggtcgcctggagccgacgggcgacctcgtacccatgggccggcgccgcctcgagcacgacgagcgtcgcgagttcgaccgccgtcagctctttcgcgcgctcggacgagaccatggtgcgtagcatagtggctgatacgagatatcgattcgatatagcggccgaaaccctgattccggccatcgtgcggtggaggcgctaccatggcgtcgtggatcaaggtcgcgcgcgcgaggtcggtggtcggctggccaccagcgtcgatcaccgcctactcaggtggcgaacgctgcgcgccctcgctgccggaaccatcgtcagagaagacgtgtgtgatgccggtttcgagctctcgcgtgcggcgagcgcgttcggcattccccgaggggtcgtgtgtcctgtgtgtgctgccgatgcgttgcgtgaggttgcattcgccttcggcaaggggctcccgcacgagggccaggtcgtcgggggcacgctcgtcgaggaggcgctcgacgcggtgccggatgttcggctgtttcgtgtcgaggtctgtctggcgtgccgttggaacttcgtgatcgaagagcgcggtcacaccggcgtgcgatagggttggatcgatgccggtgtcacccccggcagagcgcctgtagcgcgaggagcgcacgggacctcggagagggggaaacatggagtcagcgtcgatgagcgaccgtatcgcgacggtcccggccatcgctggatcgaaggtacgctccgggagtcggccactcgtcatggtgaccgcctacgacgcgccaggggcgcgcattgccgacgacggtggcgtcgacatgatcctcgtcggcgactcggtggcgatggcggtgctcggcatgcccgacacgctcggggtgcgggtccgtgacatcgcccaccacgtagcggcggtgcggcgggcgcagccgagagccctcgtcgtcgcggatctgccatggttgagctaccaccgcggacgtcgccgtgcagtcgaggccgccggcaagctcgtgcgcgccggcgcgcaggccgtcaagctggaggggggtcgcgaacgccttgacgtcatcgacgcactcgtgcgcgcgcagatcccggtgatgggtcacctcggcctcaccccccagagcgcgaacgtcttcggtggcatggtcgtccaaggccgttcgatcgtcgcggccgaacgcatcctcgcagacgccatggccctcgagcaggcgggggtcttcgccatggtcctcgagggaattccggccccgatcgcctcggtcgtgacggctcgcgtcggcgtcccgaccatcggtatcggtgcgggcgcaggttgcgatgggcaggtcctcgtgttccacgatctgctcgggttcgccgatggccatcggccgcggttcgtcaagacctatgcggagctcggcgccgcggctcgcgaggcggtcgccgcctgggccaaggacgtgacggagggcgcctatcccgatgacgcgcatgcctaccgcgcctctaccgagctcgctgcgtgggccgagcgacagctcacgagcgaggagcgtcgtgggggcgcgcctcgctcctagtcgctgggcgcgatatctgcgaagcgggtccagtcggcgatgaaggccaggttgacggtgccctggggaccgttgcggtgcttggcgacgatgatctcggcgacgccgcgatcggtggtgtcggggtggtacagctcgtctcggtagatgaacatgaccacgtcggcgtcttgctcgagagagttgtgcacgatgacgccgtcggcgacgaacgcatgcgtctcgggtacctcgatatcgaagacgagctccgtgccgagttcgtcgaccgactcgacgacggtcgtcgccaccgtagtcgcatccaggaggacgtggaccacgtcgccggatacgagggtcccggcctcccgccatcccgacgatgtggcgatcgggtgattgccggtcgcgcggaggatcgagccgttggcgagggtcaggcgtcgcagtggcttgaggccggtggccacgacgcgtgtacccatggcgaccgtcggcacgccctcgggggtgacggatgcgagcggaacggatctcgcccccttgctccagagcatgccgatgggaacctcggtaccgtcggcgaggcgtaccttggcgtcccacgagaggcaaccggactcgcggaggtccgcgagttgcgggcgacgatcgctgcgtgattcgaggttgcgcgacagctgggagagcgcgatgatcggcacgtcgagctcgcgggcgagcagcttgaggccacgggagatctcggagacctcgagctgccgtgactcgctctggcgtcgactgctcatcagctggaggtagtcgatgacgacgagcgagagtccttgctcggccttgatacgccgcgcgcgcgtgcggaggtcgaggacggtcaggttcgggtcgtcatcaatgaggatcgggcgcgtggcgagttcgccggcggcgttggagacctgatcccactcgcgttcgttcagacggccggagcggaggcgttgcgaattgacgcgcgcctgcgacgcgaccagccgctggccgagctcgatgcggttcatctcgagcgagaacagcaggacgggctcgctctggttgcgggcgacgttcagcgccatcgagagcgcgaaggacgtcttgcccatgcccggtcgagcaccgacgatgatgaggttcgatcgatgcaagcccgtgagcagctcatcgaggtcgcgaaagccggtcgggacggcgaaggcgcccagatcgtcggagccggcgacctgctcgagctgctcgaggacctccatcagcacctgctcgaggtgcgccgcggactcgtgactcgtgccccgcgcgacgttcaggatgctggcctcggcgtgatcgagcagcgcgcgtacgtccttcgggaggccgtaggcctcctcggcgatgtcagaggcggtccggatgaggcgccgaaggatcccgtagtcgcggacgatctgggcgtagcgcccggcggacgcgatggctggggtctggatgaccagacggttcagcccctcttgaccaccgagcgcctcctcgatgcccaggcgacggagttcgtcgcccaccgagaccgggtccgtggtctcaccgcgggcgtagaggtcagcgaggacgcgaaagagctctcggtgtgacggtcgaaagaagtcgtcggcttcgacgagttcgacggcgtccccgatcgcttctcgcgacagcagcatggccccgaggagcgactcctcggcctcgatgttgtgcggcggcagccgatcctcgggcccttgcgagcgggccatcgcggaccggggctcagcgctcgctggccgcgaccgaaacggtgatcgccacgtcgacgccgtggcccagcgcgatcacgacggggtgctctccgacctgcttgatcggagccggaatgcgcacgtgctcccgttcgatcgtgacgccggtggcttcggcgatcgcgcgcacgatgtcggcggccgtgatcgacccgaacagcgtgccctcctcggaggcgcgagcactgagtgcgagctcgatgccggcgagctgacgcgccgtggcctcggcctcggcacgctcgcgctcgcgtgcgagctgtgccttcgctcgcatcgcctcagcttggtgggcgatcttcggcgtggcggcaacggccagccgacgcgggatcaggtagttgcgggcgtagccatcggcaacgcggacgatgtcgccacgatcgccgaggccttggacccgcgcgcgcaggaggacgttcatgcctgttcctcctcggctgctggcgtctcttcctcgtcggcgctggtgcggtcggtggcctgggcgcggttccgcgagcgcagctcgcggtcaccgacgggctggtcgccctggttgcggcggcttcggtcggagaccggacggatcacgtagggcagcagtgcgagctcgcgcgccaccttgatggcgttggcgacgtcggcttggtgctgggcacagttacccgtgacccgccgggcgcggatcttggctcgctccgacgtgaaacgacgcaggagatcgacgtccttgtagtcgacccagtccacgtgctgctggcagaaaacgcagggcttcttcttgatgcgcttggtctcgggtgcctcgcggccccgacgcttgcgcttggtcgctgtcttcggcattgcttagaacggctcctcttcgtatcccacgcccccgtcggcgacaggggacggctcgttcgtcacgggtctgcccgatccggtccgacgctcggtgcggtgcacctctgcggttgcccaacggagcgacgggccgacctcttcggccacgacctgaaccttggatcggcgctctccctctggcgtttcccagctgcgctgttcgaggcggcccacgatgatggcgcgagaacccttctcgaggctcgtcgagacgttgtcggcgaggtcgccccagcagatcacctcgaagaacgaggtggactcttcccactcctgggtctgctgattgaggcggcgtcggttcaccgcaatggagaagagcgcctgggcccgaccctgggcggtgaagcgcagttctggctccttcgtgaggttgccgacgagtgtgacggagttacctgctgacatggtggcctttcgctcggttcacccggcctaggcgcggcctggcgcgccgaggagggggatcttgccgttcgcggcgagcgcgtcagggagccgaatggtcttgtgacgcaggacaccgtcggcgatcgagagcacacgatcgagttcatcgatcgtcgctggttcggcgtgcagccgaaggaagctgtaggcaccatcggtgcggtgtgcgatcgggtaggcgagcatgcgccgaccccagtgcgcttcttgggtgatggctccaccgccctgattgacgatggaacgaattcggtcgaagagcgcggtgcgcgcttcctcgtcgagcgctggtgacgtgatcagcgcgagttcatactcccgcatgtgggttcctcctgtggacctgggatgccagggccccatgatggggcagggtggcgccgagcgccacagcgagcatagcgcacctaggagtgcgcccgcgcctgaccgatcggcggttcgtcgtgtcgatggaggggaagttgcgcctcgagctcgtcagggatcagtcgactgagggaatggaagaggaggaacgagaagccgatctggaagatcacctcaccctggaacagaaccatgatcccgtcgttcggcagcgagagcagcgccatgacaccaccgacgatctgcatgacgatcatcgtcgcgttgaaccaggagcgcgcgtagcgccaccagatccaccccgacatgagcagttgctcgacgaagaggatggagccgagggtctggtgggtccagtcgaagagggtgccccaggtgtagggggtgaacgcgatgccgacgatcagcaccgccatcatccggagcgcacggcgcagcacgccgagcccgccggtcgtggggaggtcacgtccagccctccacgagaggacggcacagagcacgaagccgatcgcgagcgggatgaagctgtcgaggtgggtcaggtagtagctgatgccgtagccatcgatcgccgaactcgggtaccagatcgcgacgagcagcagggcgccgaagagggcgaggtcggcagcgaggagccggtcgagtgtcttcgtccgaagcatcgctcgcctcccttcgcggtcaggacttcatcgtcgctgtgccatctcccaataacgttgcattatacaaccgtaatcccgccccgcgaagccacagctggtgttcggtcgctgaactgccagcatggctcatcgatggcgtcctagactcctcgcggaggtggtcgtggtgggacagcggtgggccgccctcggtacgtcgggccggatcgtcacggtcgtctccgtgatcgtgctgatcgctctgttcctaccgtggtacggcgtgagcatcggatcgctgagtgtgtccgtcgatgggttgcactcctacggcctgctgaccgccctcggtgtggtcgtcgtcgccgtcggtgtcggcgcgaacgcgccatgggtgcgtggtgcgcgtcttgccggggtcgtgctcgaggcggtcggcgcagtcgcgttcctcgccgcctaccatgcggcagggtcgacgagcgcgctgtcggtgtcgttcggacccgagatcggggtgtatctcgcgctgctcgcgagcctggttggcgtggtcgcggcgttgaacgaacgccggcgtgccgtctgatgcgtcgcctcgcgtggatgatggttgctggcgccacgctcgcggcgtgtggtactgcgaccgcccaggtgaccggtccggtcgctcgtgcggctcgcgcgctcgcatcggtgccgttgcacttctgtttcgtcatcgacgcgaccgcgcaggacgcgcaggagcgcatctcgggttgtggtgacgagtccgccggtgcccgtcggttggcgctgacgcagaacctcctcgagcaggtcggaagccaacgccagcagagctcggagggtgtgatcgagattggctcgaaggagtgggtgagctcgagcaaggtctggcaactcgtgacgccgaccacgaacgtgatcgagccgctcgccgtcgcggacctcgtcgacgcagcgcccggcttcgtcgtcggccgtggcagcgtcgtcgacggtgtgcaggcgctcgcctactcgacggtgctcgagggatcgtcgctcagtcggacgcttgcgcgccttccggcggcgctcgcggagcagtatcgcggtgagaacctccgcagtgacgacctcaccgtggagctcagcccgcaggggcggttgctcgaggtcgaccagcaccagtcgctcgtcgtgtcgggtcaggcggtgaccgcggtctcggttctggtgctgtcgcgtttcggccagtccgtgacggtcacgcccccgtctccggtcgccggctgagtcggtggccggccagcacggcagcaacggtggagagcagcaccacggcgaggagcgcttcgccgcccgcagcgccgatcacactccgcagcgccgtcgcgatcgcgatcgtgacctcgccgcgcgggagcatcccgacggcgatccagcggtcggggcgtgcgatgagcaggtagaggccaaggcgtgagatggcgagtgcgaccaggaggccgacgacgacggcgacgttcatccgccagagcggaccgagcgagccgagcacgaaccctgccgtcgcaaagaacatgaggccgagcgtccggcgcgaccacgtgaccacggcggctcgaggaacgaggtcgtggaggagcgcaccggcgagcgcaccggcgagcgcgggtgacgtcccgaacgcacaggtcgccgtcacgacgagcgctccgaggagtcgtggtgctcgcgcacccgtttgtcggaggaccagtgcgatgacgacggcgacgacggtcgcgaccacgctggtgggacgggcgccggtcgggagcacgaaaggcgcagcggcgagcagtgccaagctgacgaggtcgtcgccgatggctgcctgcaggatcgacgtccgggagcctcgtggaacgtgggcgagcgggaggacggtggccgccaacgccccgctcgtcgggatggctgcaagcgcgatggcaagggctcgaacggcacccacgccacttacgaggacggcaccgaaggcgccgaggccaaggaggctcgcgccgatcccggcgatggcgaggccgcggcccgcgatcgggtggctgccagagccttggagctcctcaccgatcccgaagagcacgacgtagacgccgagcgactctgcggtcgtcgcgatgtgggtagcgacggccggatgggggagcagagcgacgagtgtcccgacgacgagcatcacgagtgcggttgggatgcggctcgaggagtgccgcagggatccgacgatgctcgcagcgagcaggaccccgagactgagcgccgtcatcgccgacctccaccgtcgaggtgctggcacgcgagattcagagcctagcctggaggggtatgcgacgcagacctcgacgcctgagcgcgcttgtcgtggtggcagcgccgttggtgctggcgagctgtcacttttccaacggcgactacggaccggcgggtgccggtgggggcacgacgtcgtcggcgagctccggtccgatcggcgcgaacacgaccgcgccggacgcaaagctgctaggtggctcagccgccccgaagacagcgtcgacctacgacggtgctggctttccgattccgacgtatccgccggttccgtgcccgagggcaacctgcctcaacgggtcgcctctcgagccggtggagatctcgtggcgcaactcgccgtatgggccgatcctcacgacggcgagcggggagaccctctacctgcgccttggcgacggctttcgggagtcgggctgccatggcatctgcctccgagcgttcccgccgttgctgacgaacggcgccccgcaggcggcccctggtttgctcgcggcggatgtgggcgacttgaccgcgtcgaacgggaaggagcaggcgtcctacggcggtcacccgctctacacctaccgtggcgatacgaaaccgggtcagtacggtgcagagggcaagggcggcatttggtacgtggtctcgatcacgggcctaccggtcaaggcgccggtgcattctggcacctcatcgagctcggccactacctcgacctcgaacggctgatcccgccctggggcgccctcagtcgactggggtcgacggcgtgcggagagcgccgaggagcacctggctgatgtcggcgacccgcacatgctcgggtgcgtcaccggtcgcctgacgagccttcagcccatcgtcgagcatgatcatgcagaacgggcacgccaccccgacgacgtcgaccccggtggcgagcgcctgtgtgacgcgggcgtcgttgacccgctgtcccttcgcctcctccatccacatgcgcgccccgccggcaccgcagcagaagctgcgcgaccgattccgctccatttcgagtggatccgcaccgagtgcggcgccgacgacggctcgcggtgcgtcgtagacgccgttgtgacggccgagatagcacgaatcgtggaaggtcgctgaggcgatgctccctgcctcgaccgggagacgaccgtcgcggacgagctccgcgagcagctccgagtggtggcggacctcccagttgccaccgagggctgggtactcgttccgaatggtgttgaagcaatgcgggcacgaggtcacgatgctccgcgccccggcctcggtgagggtgtcgatgacctggcgagcttgcatctggtagaggtactcgttgcccatgcgtcgtgctggatccccggtgcaggtttcccgcggaccgagcacgccgaagcggactccggctttggcgagcagcgtcgccgtggctcgggtcaccgcctgggcgcgttcgtcgagcgccccggcgcacccgacccagaggagtacctcgacatcagctgggatctggccgtcgaagacgggtacctcgacgtcgagccccttcaaccagtcgagccgatgcgaagcgccgagaccccacgggtcgccgcggttttcgaggttgcgcagcatgccaccggcctcagtggggaaggacgactccatcaggacctggtagcgccgcagatcgacgatggtgtcgacatgttcgatgtcgacaggacaggcggcgacacacgcgccgcaggtcgtgcaggcccagagcacctccggatcgacgacatcgggcacaagggacgtctcttgggcttcagggttcgctccgtgggcgagcaccgcctctcgcaggctcatgatgaggagcttcggtgagaggggcttgcccgttccccatgcgggacagagctcctggcagcggccgcactcggtgcaggcgagtgtgtcgagccggtgcttccagtcgagctgaccgatggtgccgacgccgagcacggtcgcttcatcgaacgcttcggggtcgaggtcgggtgtcgttgcgagcgctcccagggctcgcgggcgccgcgcgaaggcgacgttgatcggtgccgtcgcgatgtggaggtgcttggagtgcacgatgaagacgaggaacgcgaagatcaccgcgacgttcgcaacgaggaagatcgattcgagttcgtagttcgtatgggcacccatgtgccggaatggcagcgccacgatctctgacagccaggcaccggaacggtacgggaagtcgccgtcgttcacctgggttgctcgataggcgacgagggtcacgatgacggcggcgatccacccgagcgtgagccacgccacaccggtgtgcgaaccgtagaagcgcgatgctcgttcgcggcgctggggtgcctcccgaagccgaatgacggcgaagacgacgagcgaaacgagcacgaggaacgccatggtgtcctcgagggcgccaagccagggctcgtggccgatgatcgggaaggcaaagtggcggtcgaacagcgccccaaccgcctccaccaccgtgacgagcaggatcgtaaagccccagaacgtgaagaagtgggcgaggcccgggacccgtttggtgaggagccgacgctgaccgagcacctcgacgacctcggcgcgggcccgtcgcgcgaggctcgctcgacgcccgggggaggcgggcccacggcggacggcgcgtatgagcaccacggcccgtcggatcgtcagggcgagcgcgacgacgatgatcgcaaggccgatcgcaaggcgcatctgagcctccttgggcgtcaggaacgaatggatgttaccactcagtagcttcgtggtggcggcggtcgcccttgatgtcgtcgtgatcgaggtggtaacgagacggcgtcgggccgcgttgaccctggtacttcgaggccagtgcggcactaccgtaggggtgctcggcagggctcgtcatctgcaagaacgagatctgcccgacccgcatgccgggatagagcgtgatcggaagctgagcaacgttcgagagttccagggtgacgtggccttcgaagccgggatcgatgaagccagcggtcgagtggatcagaagaccgaggcgtccgagggacgacttgccctcgagtcgtgcgacgagatcctcgccgacgcgcacgtgctcgatcgtcgagccgagcacgaactcgccgggatggagcatgaacgctcgcccgaaggggacctcgacgagctcggtcaagtcgtcgggaatggcagcaaggtcgaggtggccggctgagtagttgcggaacacccgaaagagtgcatcgagccgcaggtcgatcgatgacggctggatggcaccgggcgagagcggatcgaccgagatccgaccagccgcgagggcgtcgcggagcgagcggtcagagaggatcattggcgctacactatcgcgacgcagctcctgtcgcggaggcagggtgcccgcgggcgtagttcagcggcagaacatcagcttcccaagctgagaacgcgggttcgattcccgtcgcccgctccacgcgtagcaccagctcaggggcatcctcgatagagtgtcgactccgccgagaagccgagcagccctgctcagaccacaaatagaccacatctgcggctgggagcacaccgcgaggtgtgcttgcgcgacggggtgcgcctcgtggcggcgtcgtcggcgctacgaaggagagcgcttccacactgcctggcccgaggttcccccaagacgtcggtcgcttcggtctcgtccgatgggcttgcgtgggcagatgcgaggtccgacagagccgcagcgattgccttatcgcgttccgcggtggcgtgctgatagatcagcgcggctcgtggtgacgagtgtccgatgcgtgccatgaggtcgcgcgtgctcgcacctgtcgccgccgcccacgtattactagagtgacgcaggtcatggaggtgcaggtcagctctcccgatactgcgccgtgcgcgatcccaggtgctctggaggacgtgcacgcgaagcgggccgcccatagcgccagtgaacagcagggcatcgggttctgccccgacatagcggtcgaggtgttcggcgaggccccggatcgcgtgaggaggtatcgcgaccgtcctcagcccggcttgcgacttcgggggccggtgatcacggtgccatcgcgaagctgatggctggtgcgttgaatgcggagcggtccgtgcggcaggtccacgtcggagcggcggagggcgagaagttccgatcgtcgcaggccgctccaagcagccagcacgacgagcatcgcgagcctctcgggcatggctgcggtgagtgcgtccacctcccggatgctggcgatcggacgctccgtgggctgctcgacgcctgcgccctcgacgcggcagggatttcgcgtgatccgctcgtcggccaccgccgtgttgagaattgcgcgcagcaaccggtaggccttcgccgctgtggatggatgctgcccagccagctcggcatgccacgtacggactcccaacggggtgatcttgctcaagtcggttcgcccgaaggctggcaggatgtatcggtccaagagatagcggtacagttcgacggttctcggccgtagatctggacggtgtgcgagccacagctcggcgtaggcacggaatgcgagctgacctagccgcgggtcgacccactctgcccgttgcatgtccgctcccacccgctccaggaagcgacgtgcttcgatcttcgtgggaactgtgcgtccacgttgacgcccgtccggatctcggtagcgggtttcccagcgtccggatggcttgcgctggatgcttgacaccgatcgctcctactcgtgcgtcctcagttgggagatgctgctggcagactgatcgcaaccagtgtcttgtcgtcatggcgcttggcccgagggaggagcgagccgttggggtctcgctcgctctcccagcgatagcaacggtctcgcgcaaggcagccaaccatgtcttcgcccatggcagcggtcgtctcgtgtacggagacgtgcgggggatcgagcaagcgaccaaggggcgccgctcagccggtcgtcatcaacgccgggagccttcgcagtggtcgagaggacgccacgaacggtacctcgacgacaagaccggcctgaaaggagagcacgtagacgaagctgcttcaacgaagacatgcccagcgtgtggagcacgcaaccgaccgagcggtcgggactaccggtgtgcgaacgctgactgtgggtttgcctaccaccgagacgccgtaggagcgatcaacatcctgcagaaagcgatccacgggacctatgtcccaattggaccggatgtcacgatccatgtcacgtatctccgggctgtcgagcgttggtcaccacgccagagcgaggcacaccgcaaggtgcagtaccgaagggcgagagccctgagtagcgcccggaaccgggcttcgtcaggagcagtcccgacgtgcgagcaaaggcaagcccaatcatccaccagcttctcggggccagaccagttagtcgcggtggcatgaggacggcgatgtcgagcaaccccaaccgtatggacgggctagaagccccgtccgtaagggcgggaagggtccccgacggcgcgcctgtgtggctcaagagggacgtggctgctcgagagaatgaggtaaaaggtgtccgaaaagctcttcgaggaggaagcgggttcttgcaggcacgggccgattgggatagacggcttcgagcagcgcaagtccgtccgctgccgtcctcatgccgcaaagaccatagagcagtttgatgtcgtcgacgtcctggtccgctcgcgatgcgaggagtttcatcgccaagagctgacgtggggaggcaacagaaacggtcagacccggtcggcggatgacgacagtcgatgcaggatcaggaccaggaaagaacgccctcgctccgtcgttgagccagtcctccggtagacccatctcgatggctaccgttgatgcggcctcacgaacggttgccttcggctcaaagacggcatccacatcccgcgtgattcgccgagcctcgtacgcgagcgcaagggcgttcccaccgacgacgtagatctcggctacgaccccacggcgctcgagctcgtcagcgagacggttgaacgcttcgagaatgagtgtcgcgttgaagcgtggcctcggttcagacacgatcgaacgcgccttcgttgacgaacacgccgtggcgtttgagctcgaccgggctgtctcgcagggccatcgcctcatagcccggcaagccagccacgaaccaccacggctcgacgtagcgtgtcgcttcggtcgtccacgacggcgcagcaatgccagcctcgttgcagaggaactcaacgatacctgcaagcgccgcgtcgaatcgtgtgtcgccgcacagcggtggcggatctgcgaccagccacgccttcccgagacgggacgatcctcggacgtcgtcgacgaagtcgagcacctctcgccacgccgaacgcacgccctcggtgtggagaagttcggtgatggtagtcgcgacatccgcgactggctttgcacctcggcgcacctgcggacgcaggaccaaatccacatcgaagccagcgacggcaacgatgcgttgcagcgtgctcaacctcggctcgatcctgccgcgttcctagttggcgacagtcggttgcgaggtgcccgcgagcagtgctagctcctcctgtgtgagctgtgcttgggcgcgcaggtcgcgcagcaacacgctgatgcgctgatagctgcgcgacgcgggcatatcagaaagcgtatcgtgcccgatgcccggcactgttgagtctgagtggggaggagcgcctcgacaaggagatccgccgacgtacgaacgtggtgggcatctttcctgaccgagctgccatcatccgcctcgttggctcggtgctcatcggcgagaccgaggagtggatggaacagcgtcgctccatgagcgctgaagcccttgccaaggtgacccgggtcactgtggccgagaccgaggaccccgccacagaacaagcacaacgcagcctgccagagccgatgggggcgtcggctcgagggaggatccgcggtggccaatacaccactcgtttggacgcgacctggcgagtacaggaacaggttggtgggaaggaccggcgtcgtcaggtgcgcacgcacttcgtgcccgaggaaggcgaaggatcggtgccggttgatcgcgttccagaccgatggcttcgtcacaccgatggcttcgtcacaccgatgacttcgacgtccgatcactcgggacgccctcgttgagcgtggcgacgaagttttcaggaccagacgtcggcatggtcttcaggtcagcggtgagctcggcggcggtcagctgcgggtagagcggctcgagccgactgaggtcgatggtgcccgggtgatcgacgcagaccagtccgtctgggcactgcatcgacatcgccggcacggagaatccgagcggcaccgtgatgtagagcgggtcgaaggaccgtgccagcggcgcctcatagggtgcaccgacctcgcagcccaatgatgcctctgagctcacgtgcaggtcgcagtagaggcctcgggtgtgcatgaacggtgcgaggtgaccgtcgcagagggcgtcggtcacgccttactcgttgacgccttggccggcccgcacggcgttgctcgggggcggcgtggacgccgccgccgttgcgatgcctgcaccggtcgcaagggcagcagcgaaggcgactgctccgttccgcattcgtcgtcgtgcgactcgtcccatctgtcctcctcttccctccgtcggggtctcgtgggatccggattcgaggcggtccttggatggagccagaggcgccgttgaggcggaagggaccgaccttggagcgtgcggtgaaccgctgggcgtaggtgcggcgcgggtgagtgctgaatactgctacagtacgtcacgtaatgatatgcggagagcatggaatcgagagggtcgacccctctgcaaccacggctcggcctcgaccgggacggcctcgggatcggcgtgtcgacgcctccgtcatgggcgcaaccctggcccttctcgacgaggtgggctacagcgcactcagtctcgagatggtcgctcgtcgtgctcgtgttggcaagccgagcatctaccgtcgctggccgggcaaggcttcgctcgtcgtggacacgatcgtcacgatcgcgggcaccgatccggcaccggacaccggttcgctccgcgacgacctcagggcggtcgccctggctatggctgcgctgtatcggacgccgctcgctcgcacggtcgtgctaccccttctcggggatctcgccgacgatcctgatcttggcgagcgcttcaggcggcgctacgtcgcgccgaggcggggctcggtccaccgggcgctcgagcgtgcgcaggagcgcggcgagatcccgcgggtggacgaccccgagctcatctgcgatctgatcgcagggccgttgttccaccgtgcatttcttgttgccggagagatcgacgaccgcttcgccctggcaacggtcgacgcggtgctgatcgtgctggagtcggggcaagccggcgaccgcaactcgggaacaggaaaaggagcctcccagtgagcgcagatgcccagagggcgttagaggcaaccagagcgcccggtacacgtccgccgctgtggcttcgaacgtcggtaccggtcggggttgtgtcccagtgcgccgccgcagcgctcggcacggggctcatcgcggttgcggccgactcgtaccggctgggggttgacctccgaggggcagcgctgatcgttgggttcatactcatctatctcaacacccatgcggtggctcactggttcgtcggccggatcgtcgggatcaggtttcgaggcttcggactgcgaggaacggatcacccggagaactatccgccgggccttcgccacctcatgggggtactgccgatgtgggtggcgatgaccgagcccgagagtcggcgccgcgcgggtccccgagcccgcgcggcaatgtacgcagccggggagacgtccaccacggtgtgctcggtggcagcggctgcggctgcgttcctcgcgcacgcaccatgggcgcgcggcctgctcgtcttcgcggtcctgtggaaccttggtgcctcgattgtggtcagcatgatcgacaagggggactacgcgaaggcgcgtcgtgccctgcgggcgcggtagcacgtgcgccccactcgggccgtacttcttgcgatcgcgttctcgttcaagcggaggtttcgcggcggttcgtgtcccgcctggcgccttgtgagtgtgcggctggacgagctggacacggggctttgccgcctggcagcgtgctcgatgagggctcaggtcgccgctggcgagtaggagatgagacggccgtcggcggagctgcgtaggtgcagctcgaaggtgtgtgcccgcaggatgagtgagaaggcgtcgaagggctggcgcgaggccgcgtaggcaacgccctcgatgtcgatcacccactcgctgcgcgcgagcccgagcacgccacgctcctgcccctgtggtgggcgcgccaccagccactgctcctcgtgggtctccgcgagcccgaagtggtgctcgagggcggcagagagcggatccctcgatgggtcgaacaccgcgtccagggatggggcgaggaccgtgggcacgagcgcgcgctcaagcgcgatggggtgcgccccccgcagacagcgcagagacctatcgcaaggcgcaagtcctcgctggatgcaggggagtcccgggcgagcgtcatcgtcgtaacctgctcttcgtgcaggtcttccggtccgggatcgcctggatctggagtcgtagcggcgtaccgacgtcctcgggatggcctctgatcgcagtgctgtcatgcaactgcctgacctagtgacggcgaggccacgactcgcaatggcccaggcgctcgaagacccgcaatggtggtcgctcagaccgacgagctgcttggggtcgtggtctgcgttgggaagctcgccgctcgggcttccggaggtgtgcatggttgggttcgggtcgggtcgtgcggaggcaacagaccacgtcggttggcgtaactcgacattcgggtacgcgttacctgccgtctgtgcgcttcgccgaggtcgcgagggcgtggctcacgctgcccgacgcccgaagccaggtagcaggcgctcgacggacgaggtgacgagatgcaggcccgcaaggccaggaaggcgttcgatacgacgatcgatgcgtgcgaccacctcgggtcctcctggaccggtgaagagtgtgctgatgagcgcacgtacttcctcgttcgacttgacccccgaccctacgggtgcccaaaaccgcgcgagagccgatcgtacgatgcgctggtcgcggggacgctcgagcagggcgcgggcctgcatggtgtagaagtcgatgtggcgaccctcttgcttcatgatctcggtgagcacccccgtgagggcggggtgctccgctcgtgccacgagccgcgcgtaaccagcctgcgtcgtgagctcgttgaccatcccccatgccatgaggagcccgggcaacgccggagcgatgggcgagaagacggagaagccaacgagccggagccaatctcgagcgcgacgagcgcgtcggagcgttgcggccgcatcgggggcacctgccagcccatgcgcggtgaggatcttcccgatggcgtcaccgtgaaactgctcttcgtagacccagcacgcaagaaaccgcgtgatcgccgggtcggcgtggacgggtgtggcgaggagttcgcagaggtagcagaccgtatggctctcgatgtcacacatgtaacgaaggcatgcgaggctcgcgtcatccagcgggtgcgatcggaacgcatcgatgtcgatctgctcgacctcaatgcgtcgagagcgtgcgacgagggcatccaaggttgtcggcatacgtacctacttcggagcaacggtcggccgtggatggtacgaggactgtaggcaccggccttcttttgacccgagatcaccggtcagaactgacccatccgcgacacacgtttaggtgatgaccttggggtcggggtgctcggcctcacctccctgtaccatgccagcggcttcctgccgcagcacggatgggcttgtggagcgagaaagcgtagcggtgccgcgcaggacagcatgggctgacttgctcgccgcagacgggagagcacgtcaaggaagcgggggccgtaggctgcctcgagcgagggcacggctcgtcgcttccacgaccaggcctccctcgaatggccgcccggcctcggtggcaatcagggagggaaagccgcaccctccatcccaccaggcccacgccgtccagccgatgccgtgtccggcgaggaagtccacgatgtggcgttccaggttgagcgggtaggggttgctgcagccgaggacgccgaactcggtggcgatgactggccagtgtcgccacgtcgaaccgagctcgtgctgccagagcgcgggccctgtcggttgtgctgcttgtacgtagaggtgcagcccataggcgacgttggtaccggccaggtgccagcgcgtcaggcccgcaagcgtccccgcccaatcgatgccgtccgcgatcacgaggtttcgcgcacccgtggcccgtacggtgtcgaggagcgtctgttcgccgatcgcgtcatagcgtcgtccggtcgctgggcaggtgatcaaccctccgtcgcgccacgtcgaccacgtgatgtcgtggggttcgttgtagagctcgaagaccaccccgggccaggtgcggaagcgctccgcgagggtcctccagaatgcgatgctcggagggtctggcgcacacgaaggccctgctgcggccggggcagtcgaggtgtcagccccgatgacggtgtgcaggtccaagatcacgacgagaccgactcgtcgtgcggcacgaaccgcgcgctcgacgagttccccgtactccggatcgtagcgtggggatccgcgtaggaggaaggcctcgttgagcgcgatgcgaactgcgttggcgcgaaagcgcgtcaccatcgagcggagctcagagaggtccaggcctggggctccgtcggcgtgctgccctgcgggtgcccagtcgagactcggccagtcgacgccatggaggtagatcggcgttccgcgctcgtccacgaccaagggaccccgactcacgagctggccggtgacggcacccggcggcgaggggctgaaggtgggccgcctgtgggaatgcagcacgacaacgaggagggttgcgatgccgagggcgaccaacaccacgagcgccgccacaccgcggcgtctgcggacgcccgtcatggtcggtagatgtcgatgcgggagagtccggagccgaactgcgcgacgaggtggtcttcatgctgaacagcgctaatgaacggtaactgtgtctgcaccgcgcgcatctgaggagtcacgacaatgaggtgcatcgccttccagccctgagggttgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcaggtagcgacgttcgacctccgggtccgtcgtgatcttccaataccacaccacggcctggtaggggtgccaacccatgtcgacgacgtcgacccacatcgtatcggcgacgaggatgggggcggaacggtcgccatgggcgcgtagccaggcctctgcggcaagctgggcctggtctcgaggggcgagcaacgtctccgcgtcccgggcggaccaggcgaaacctaacagcagcgtgagtgtggtgacgagcacaccaagggcggttcgagccaggcgtcgccaggagacactctggctgaggagggagtcgaagagcccgccaccgaccagtgcaaccgctgggaacgcctcgactgggtaggtcgaggggagatacccaggacggaaggccatggcagtgtagacgagcgcagcgatcccgaaggggcgcgttcgtcgagcgatgacgccgatgcacgcggccggcaccaggaggacgagaaccgggtcgaggtgaagccacccctggagcaggccccaggcggccgtgccgtggcggaggatgaagccgctgcccgcacgctcgaagacttgccacgctgcgctcccgagcaaactcacgtgaccgggtccggggaggagtgctcccttgagcgtggcgtagagcaggtacaggctcccgatactcccggtgacgaggagaaaggtccacattgcgaccgagcgccgttcatcgcggtagcgccgagcgaggagccagagcacggtgggagtccagaggagggccgtctccacggacaggatcgctgcgccgaacgcgatgccagcgatcacgacggcgtgcaagcggcgccttggatccgagagcgaccagatcgcgacgagaaccagagccatcgcgacgttgtcgagttcgacgaggcgctcgagcgtgatggcaagcggggacaggccccagaggatgacggctatggcggcagcaccagggtgccagcggagcctcttcgccgctccgaccagcgcgccgagcgcgacgagcgaccagatccacatcgcgaagcggagctgggcgacggcgtcgaggccctggggcaggacatgggcaaggagccaccacatgccggcaaggaggatccacgcgagcggtggatgatcgtaccagtacgtgtaaggggcaagccgcccgaggtgcagcagagcccacgcctccgcggcataggtaccctcgtcgagcatcggggtcgggttgtgtgcggcgcccgcgacgtgaacgagagcgacgatggcagcggttccccaggcgagcgtgttgcccgccaccgaccaggtgccccgagccgcggtctgtgtcgaatccggggcttccggaacctcatgcgttcggacgagagtctcaaccacggctacgccacctgctgttcgctcaggacctcgtcaggagttgacaagcgacggtgtgcgccgacatgctccgtctttgcccaaccgcgctcaccgcggagctcgcgcaccagcgctacgagcagggcggtcacgagcacgagctggtaggggatgagaccgaggacgagggagagcgcatctcggatgcgtggccgctcaccgcgtaggcgacgcaagcgagctgcggcgatgacctcgaagctgagggcgccgagctccgcgaagagagataggaaggcgaagaggacgaggtcgacggggagtcgacgtgtcaagccccaggcgagcattgcgaccgggatcagcacgcccgtgagggcttgctggaacggtgccgccaatgtgaagagcgcaagtgcccttctccgccaggggagtttgcgccaagagcccttgcggagcacctggatgaagccctggtcccatcgggtgcgctggcgaacgaaagcgcgcaggctaaggggtgtctcctcctgcgtggcgagtgcctcctcaaagcggactgcgatctgagcgccgcaggtggcgagtcgaattcccatgtcggcatcctcggtgagcgcgttggggtcccagaggccgacctcgtgcagggtatgggagcgaaagacgcacgtgttcccaccgagcggtacgacgccgtggcgggcttgccacggaaggcggctcgagtaccacaggtagtactcgaccgcggatcgggttgcgaaccacgagctggacaggttgacgaggaggacgcctccctgaagcacgtcgagaccgggacgcatggcgaactcggcggctgcaagcgcaaagaagccttctgcgacgtcatcctccgcgtcgacaatggcgatgagctcggcgctccccgccgcctccatcccagtgatgagggctgcaggtttcgatttaggccagtggtggtcgacgacgacctcgatgcgatcggggtgcgccgaggcagcacgttccgcgaccgcatgggtggcctgatcatcgtggccgacgatggcgatgatccgcagcgcgtcgtacggttgtcgcgcgaggcgctcgagggtcgccccgaggaccgtctcctcatggcgggctggtatgagcacagccatcgtcggcagggtcgtcaaactgtcggcgctgatttggaaggatagctgacgtcgaagctgtgggtcttcccacccgaatgctgcaagtgcaacagcggagagcgaggctgttagcacgattacagcgccagtcaggtagagccaatccccgatcgtcattgagaactcctcgatccccaggtcgtccgctgacgtagtgtagagccagctcagaggggatggaactccaggcagatctcgcaacgatgtggcaatgaaagtcgggcactggtgcatgggatgcgcttgtggcctctgcacgtgatccatgaacaactcgaaacagattggtgaacagtcgcaatgattgtcatcaaatcagtcggatcggcgcggcatatggccgtgaaatggtcgctcagagtggtgagttggctgcggaaggtcatgcttccagatgcgcaccgccgcagcgacggcggtgtcgaggttgaacgcatggtgatcccgtgggcagatgcgacgagtgaatccgcatcgatcgacggtccttgcgacctacgagccgtgatgccgttggtatcggcgatccttcgtcgctcgttccgatccgtctgcaccgccgaagtggtcgaaacgccccaactacggatgagaggcgtagcggagttggtgatgaggcatgtggggtcagtccaagtgacgtggggtgaggtctcacctgccacgtggcgtcatcggttcacggagagcattccctgggtcgcggcatcgacagcgctctccgatcggcgacgacccagcgaaggccctgtccgtctgcgcgtcgaggtggtgaggagtgtcacgggttggtcaagggcgaggcatcagctgcacgaacgtggcggcggcgaggatactcctgctaacgcctggctaacgctcgtccaggtgagccgctggcgagcgaggtaggacttgagtcccgaggaccgatcgagggaaggggggctcatgcgcaggtgggcgggtgtgccggtcgtgaagaagctggcaagtatcggagcaggactcgggctggttggcgcaggtctgtcggtgccgttgacccatgcggcgctcgcgggttcgaactcgtcgagtgagacgttctactacaccgggagtcaacagacctttactgtgccgatgggggtcacacagcttgactacaccgtggctggtggggcaggaggagcaggttacgcagcgctcgcaggcgagttaggtggctcgggtggcgacggttcggtcgtcaccggcacgctgacggtgacgcccggagagcagctgatcatcgaagtggggtcttctggtgcgaacgcgagttccaatcagcagagttgtggtggtcccttcagcctctatgtcggaggtgccggcggatcgaacccggattcgagcttcagcggtggctcgggcggcgacggcaattgcgacctcttcaattctggcggtggtggcggcggtggtggagcggcgagcgccatcctcgacagtagtaacgctgcgctcgtcgtcgcagcgggcggcggtggtggtggcggcgctggtgcggccgcgggttacgacggcggcgcgggtggcgccaatgcctctggtggccccggagggggcgacggagcaggtagtgggggccaaatcggtgctgccggcagcagtgctggtgggaccggtggatacgacgacgtagcgggacatgagtccggtggtggcggcggcggtggtggtggcctcgacggcggtgacggcggcagcgcaggacagattggtggtggcggcggtggtggcggcggctccgggagttcgaccacgggtagcggcgtcaccgtgtctgcgaccaacaacggcaacggctacgtgacgctgagttggtccacctctccaccgccccccgcgctgagcgccacgctgagcgccaccagttcgccgagccctgcctatgcaggggacaccgtcagttttgcggttcacgtgtcggggagcgggtcgtcaagcccggtgactggggaagccttcattgaagccccgggcaagaccgatcagacggaattcatccccgttgccgaggtcccgatctccgacggggctggaaccgttcaagagtcggtggatcaggtggcggcggtactcgaggcggagggcgagagcgttccgtacgggacattgaccctgccggtctacttcatcggttcgggggcctggcagggggtcggcgcgacaggttccgtcggtgtcgacctgtccatcgaccccacgaccacgagcctctcgctacagccgtcctcgccggtcgtcggccagccagtgacgctcacggcgacggtgacgaaccagtcccaggccgcacccggccttccgccgaccgggagcgtgaccttctcggcgacggacagcgccggcacgacgacgaaactcggtacggcgtcggtcgacggttcgggccaggccacgctctcgggcctggagctgccagcgggtgcggacaccatcaccgcgagttactcgggggatcccacccacgatgcctcctcgaccacgagctcgatcgatgtctcgaacgcgctggcgctgttcgcctcgagcaccccgtaccctgcgtacttcggcaatgacgtggccgtcaccgccaccgtggccgggggcgggtcgctcggtgcagcgaccggcacggcgtgcatcgagggtccgtccggaggagtgacgcttggctgcttcgtcgtcgaccagggttccgggagcttcacgatcccggtcgaggaagcggcgacgctgctgggtgcgagccgggcctacggtccccgggcgttgcccgttacgttcacgggttcgggcgcctggcaaggtgtcgacctcaccggctctgtgaacgtcgacctctcgctcgaccccacgaccacgaacctctcggtgcagccgtcctcgccggtcgcccgccagccagagacgctcgtggcgacggtgacgaaccagtcccaggccgcacccggccttccgccgaccgggagcgtgaccttctcggcgacggacagcgccggcacgacgacgagacttggcacgtccacgctctcgagctcgggccaggcgatcctcaccggcatcagccttccggctggcgtgcacgtcgtcaccgcgagctactcgggggatcccacccacgatgcctcctcggcgtcgagcacgatcgtggtgacgacaccggtacggctcgacctcgcggcctcaccgacatcgtcgtccttcggttctgcggagacgctcaccgccaccgtgcatggccaggcgcgtgggtccgtcaccttcagtctgatccagggcaggaagaccaagcggctcggcacagcgccggtgacctcgggccatacggcgcagctcgtcacctcgaacctgcccgtcggcaccgacgagatcgtcgctacgtacacgccgtcgagcggctccgacgtcgcgcccgcctatgccgacaccacgttggtggtggtgcaggacgtgcccgcgatcacgatcctcggaccgacgagcgtggcagcggggtcgtccgcgtcgtacaccatcctcgtgacggcgaacgggagcccggtcgacggtgggacgctgctggtccagctgggcgacacatcatccaccgcgaccgtggacgccaacggactggcgaccgtgacactcaccttccccaggaccggcggcacgcaggtcctctctgccatgtacctggggtcaccgacggtggcaatggcgtcgaacaccctctcggtgacggtgacgtccccctccccatcgacgtcggcgcagagttccagcacgccgcccgctggctcgtcgtcgagctcgagtacgaccaccgcgtcgtccaccagcacgagcacgtctccgacgagcccgggaacgaccagctcgacctcgacgcaagcagtgcggccggtgacggcgagttcggcagtgacggtcccgaccgcctcgaccggagaacccttcgcgtccccgtggtggtgggctctctccgggttcggcgtcggaacagggtcgacgctggcagcggtccagatccgtcgccgccgcaacacgcgcgaggccgtgtaagcggcagcagggactcagccggtcgtctcgcggttcggccgtggtggctccagcatccgaccgagagctcagtctggttcgtacagccgaagcctctctatcaaggggttgagggaactcgagggcttcgtcgttgtggctgagcgcgtaacgtcgtgccggagccggcggtctcgcccatgtctcgagcaccggctcccgggtgacgagctcgtgagcggacctgtccggtgtcggagacgcgcactcaccgcggagtcatcgaacgagtcgatgcgcccgaacgtgagcacgtcccgtacgctcgcaccacgctcgccgctggggcggggacggagatcgtcagcccggcctgcgccttcgatgtcgcggcatcctcgagcgctcgcgggccgtgatcgccgagggtccccagtggatctccgagtccgtcgagcatcgggaagctcgtcgaccgagcagtgaccgatcgggccttctagcaggtcaccgacttgctacagtccgtcctgggggtgatgcagggcggcggagggtgcacaggtggcgacttgggtgttcgcagatcggaagcacgggacgcggaccgctgcgcacgacgcacggtgaatgggacagtgttccaccgatgcggcacgacgatgccagcgatccggaggtgaccgtgcgtcagcccatgggggcgtacgggcgcagcgcaacagggcgacggacgggtggtccgcgggtgaaggtgcgtgtcctcggacagccgcgcgtagagaccagtctcggatccatcgcggtcggaggtcagcgggccaagttcctcgtcgggctcgcagccgcaggaggcgtcctcagcgtcgaggaggccgcgacgcttctctggccttccgtacgtccaccgagctggcgcggcgcgctgcgcgtcctcgtccatgagcttcgcgacgcgttctcgcgagttggcgcaccacgggggctcgtgcagcgttccggccccatcttcgtgctcgatactggcgatggtgaggtcgacgtcgacctctggtttgcgagggacgccgcgcgggatggacgtgcggcctgggaggcgggcgacttcgtgacggcacgcgcgcgagctgaggatgtcgagtcgatcctcgccgagggtgtgctgcctgggctcgatgacgaggccgtccgtgacctgcgcggtggcgtcacggcggagcgcatacggaacctcgaggtgctcgcacgcagcgcggcagcactcggcgactgctcgagtgcccttgagactgtcgagggtgcgctcggcctcgaccccaccaaccagcccctgtgccaagtcgggctcatggccgcggagacattgggtgcagtggctcgcgggctcgcgctctacgcccgtctacgcgccgccctcgcatcgggcctcggcgtttctccgagccccgcactcgccgcaagctacgcgcgtctcattgctgcgcaaggtgggcaagcgcgaggcgccgacgagccccactccctgcccgaggccatgaggtcccgtcaccgtgtcgttggtcggacgaccgaactcgctcacctcggcgtgttgtggggcagggtcgagcgcggcgaggggctcgcgtccgtcgtggtcggtcccgcaggcatcggcaagacagccttgctcggcgagctcggtgcggtcgtcgtgagtcgaggaggcagggtgctctacgggcgcgagtcggatccgccttcgcatgagctcgcggcgatcgtcgaggcactgcgcgcctatcagactcgctgtgcgcgggtcggcgtgccttgcaacctcggaccgctcggagcggacctcgaaaccctgctcggaagcggctcggacaacgttcgtctcgcaccgcggagccgacgccttcgactctcgcaggcagttcgcggatggtgggcggcagtcggctctgagcgcccgacgctggtcgtcttggacgatctccactgggcctcggcgacgacgacagccatcctggccgatctcgccgtcgatggcccccctgagggtgttctcgtcgttggcgccgcacgctcgacgggatcggcgctgccaccgagcatcgggtcattggtctcgtggggcgctcggaccatcgaactcggaccactggcgctcgacgccgtcgccgacctcctcggctcgaccggacatgacgccgcacgagtcgctgcggaagtctggctcgcgagcgggggcaatcccgagagagtgtgggaactcgctgagctcgtcgtgaatcccggagcccgaggtcgcagcggtctcgcgcgcctcgacgtcgatcgcctctccccacccgcacgacggatcgtccgagctgcggccgtgctcggtcgcgcaacgcccgcgtccgtcgtgttcgacgttgccgacactgacgatgtcgccgcgctgcaggaggcgcaggctgcgggcgtcctcggcctctcgcaggggggttccgtcgtgctacgacacgacctcctccgtgaggacgtcctcgcgcaggcagggaccgatgagaaggtccgcttgcacgcccgagcggccgaggcgcttgccaagggaggtacgtcgtcgcacaccctcgtccaccacctcgctcgagcggcccccgtagtgtcgcccgagcgactcgccaaggcccgtctctcggcggcgcgcgaagccgccagcctcggcgcgtacgaggatgcactcagtgcactcgacgcttggcgggtggagcggtcggacggtggagccgatgacctggatgccctcgtgctgcgagtggagtgcttgagtgccctcggcgatccacggctccgagacgccgtggtcgagctcttggagcgtgccgtggttctgcgtcggatcgctgcggcagcgacggctgccgagatcgtcaccgcggcgctcatcccgaccctcgtgggtcgagaggatcccgccatcaccacgcggttgcaggccgctctcgagcgagcccgtcgaccggagcacatcgcctccttggcgtctgcgcttgccctgtcgcgggtctggacggcgtcggccagggatcggcgagcgctggcgaggcgtgcggtcgcggccctcgaccgtcgcggcggccagggtgccgacgccctcgcactggcgaccttgacgcgagcgcacctcggcagcctcgaggcagcccacccagcccatcgcctcgccagcgctcgccgcatcctcgcgcttgcgaggtcgactcatgacatcgagggcgttgctcgcggccatctactggcgcacgacgcgctggtggagctcggtcatctcgacgaggccgacctcgaactccaggctgcccggctgtgcgccgcagctctcgacgaccaggtgcgctgggaggtggagatccgtgaggcaggacgtcggctcatggcggggaggcttcgcgatgccgaggcagccgctgagcaggcgctggtcacggtccgggccgagattctccgcgaaggcgctgcggcggtctacggggcccagctgatgatggtgcgcgaggccgagggacggcttggcgagctcgcggacgccgtcgcagagtttcgtcgggtccagcacgagtggacggtgtgggacgctgccgaggcgagaatcgcggtcgcgctcggtgatcaaggccgtgcgcgcgagctcctcgcgcgcggtgtcgccgagctcgaggatcctgtgcgcaccgacatcacgtggctcgcgcgtgccgtgcagtacgcgtgggtcgctggcgacgtccgcgacgtcgagatggcgcagcgcttggtggcactccttgcgccctaccgagggacggtgcactggtcggtgtgcgtcagcctcggtccggtcgacctactcctcgcacggctgttgatgctggccgacccgcgacgtgcctcgacaccgctcgagcgtgcgcgtcggctcctcgccaacgatgggctcgcatactggcgcgcacggcttgccgacctggtgagctgagtcttggcgaggtgctgagcgctgtcggtcgtcctcggcgctggcggggcgttgtctcgtctctgggccttcgctctcctcgcgcggacgctgccccgtgactaccccttggcaggggcgtgtcgcgatgtcgccgagcgcggcgtgatcgtgtcgtccccggggccgaccggtgaccccttgtccttggcgcgaggcctgacgcgcacggtgccgttagtgcgccgttagcgccgacccgcggaactggatcggagacgttgggtgtgagtctcctgcgagcacggtccgggcggtcgcgtgcttgattggcgaagatggtcgcggtgctggaacgtgcgggactggggcagcatcgagggcgtcgattcgtcacgcgtcacccgaggtcgcgacggcggttcgctgtggcgagcctcggctttgtgctcgcggggcttggcaccgcaggcatcgtgtggccggtgacgtggctgcagcacgccgaggcgcgcgggacggtgtcgattcgacgcgtcgtgcggtctgagtgtgacgccgtaccagcgggagcgatcggcgtgttggccatcccttccgtaggcgtcgttgcgccggttgcccaaggactggcccaagcgaccctcgcgtgggcggtcggccatgatccctccacaccgttgccaggtgaactgggcgtctcggtgctggcagctcacgacgtgagctacttcgcgtcgaacgcaacgttgcggaggggggccgccgtgctctacgcacagggttgccggacctacgtctttaccgttgcagatcgcttggttctgcaccctggccaactcattccgccgccaggtccgcgtgggctcgccctcgacagttgttggccgagcgacgcactgttcctgacccctgatcggctcatcgtcacggcgcggttggtggcgatcacccggggcgatcgactcacgctggcgagcacaggcgtgacgccaagcctcccagccggtgtcccccagcccccgaacctcttcgcctcggggtggcttggcgggacgctcaccatcctgggcgcagcgtcagtaaggtggcgagacagtcgtgctcccatggcgtgggaggccgaggcattggccagcttgtcagccgcccgggtgggcctcgcgcaggacgcgcgctggacttccctcgtcgtcgcggccgggaccgtgcgcacggggctccttctggctccgtatacgtccgggacaccagtgagcgtacgtgaggtcgtcctaggggatcgcgttctctccgtcgccgtcacggttaccttgggcggcaacccgctgaccgtgaccgaggttccgagcgcgggcacgctccgcatcgtctcggtcgatcccgtctaaggatccggcccctcgctcggcctcggagacgacgccatcgagtgtcgatggaccaggtccggccacgtggcgggtgtcccgcgacgctacggatgggtcgtgatgtcggtggcgtctgcactgggacggatgggccgtagcgacaggtggccacccgtgcttcggcccagccacgtggtcggacccgcacgaagacgccccttgcgatgcttacgcaacggacgcggcctctcgcggaccgtcgccgctcgtggtccccggtcgtcgagatggcgcggttcgactctgtggaactgccgtggacgccggttccgtcgccgttggcggcgtcgagcggttctggcactcggaatgcgggcggtgcagagtgcaacagcggcctcgagaccggtcgcttcacgatcgtggtcttgaccagcagctggggggtccggcttccgaggacgaaggttgtgctatcggctccggggaggtaccgccgaggcggcgtgcgtccagacggcagaggcgcccgaccacggcttcgcgaaggcgcgcatcgagggacgccgggacggccctcgacgtgggtacccgagaggtggcaacggctggccggtcgtgcagcagccgctgcctccgtctcgttcagcgtgcggcttctcgtgcgggcgtgccttccagtgaggcggcgagggtccgcaccgccgtccgatagcccgactcgatgagcgtcgatgtctgagagaagtcgagggcatcgagggcgttggcggccgggcactccagcacgatcacctcggcacgttctcgtgcccacgcgagctcagtggcgagctgtgctcgcttggtgagcgtgatcgagcgcaccagggcctcgagagggcgctcgtggacagggagcggatcggcgagcgtgcccgtcaggagcacgacgatgcgcgtcgcaccgagatcggcggcccttgcgaccggggtgtcgtggaggacaccaccgtcgacccattcgcgtccatcgtgaacgagtggcggcaggacgccagggatcgcggcactgccgtagagcagggcgacggcgggaccttgacgctcccatcgtgcttcgccggtgcgcgggtcagccaagacgagttccatcggcaccgtggtatcggcgaggtcgacgaccggcacgtgggctgcgataaaggtcatgagcggttcggcggggaagacgctcgcccggcgcgtcgcgtaccggaggagtgtcacgagcttggtcgccgggaacaggcgcgcggctctcagcgactgccagatgctctcgaggcgctcgacactgcgcgacgtcgggtcggctgcaacgatcacgccgttcagggcgccgaccgatgcgccaacgacgagatcgggtctcacccctgcttcgaacaaggctcgtagcatgccgacgtggcatgcgccccttccaccgcctccggcaaagacgaacgccgtgagctcgtgctgctcgtctcgcatgcctgcaacgctagctcaggacgtcggcgtgtctttcgcagtctgtgggcccttggtccgctcgtcgtcgctgccgcagttcgcacacgaggacgcgacgtcgagctcgcggacgaggtccgcgaggagggcaagcagcatctcgcgacgatccggtccccagttctgcagcgcgcgctccagaactgcatggcgccgagcgcggagctcttcgaggacctgcttaccgctcggcgtgaggcgtaccttggcgacacgtgcgtcctcggcgtcagcgaccttctcgatgaggccacgatgcgcgagggccttgagctggcgtgagacggtggagatgtcgaggttgagttgggtggcgaggtcgctgactcggatctcgccgtggtgggcgatggcgacgagctgccagaaaccggctccgatggcgtaggtaaacgtggcatgctcgcccgagctcacgcgaagtcgacgcagtgactgccccagtcggaagagcagttcgtcgagcgtgcgcgaggcatcggagtcgggggatgacgccatcgggtccgagcatacccgtcgcctcgatcgacgctcgggctcggcgcctcatgcagtgttcgcatactttgagggtcgctaggatcgccacgtcttccctcaccagagaaggaggggtcgtgcaccgactcgatgatgaactccggtcgctccaagcgtcgatcgttcgctacgccatggaacgcattgctctccagccaccaccgctcgacgggccgaagagcgccgacgaactgcgcgcgctctacggcgcgaacgtcaccgaggacggtatcggcggcgaagaggccttgcgccgcttcgtcgagggctacgcgccggccaccctcagctcggatcaccctcggttcttggcgttcgtcccggtcgctccgaccaaggcagcggtgctcttcgacatgatcgtctcggcctcgagcatctccgggacctcgtggctcgagggcgctggcgcggtgtacctcgagaacgaggcgctgcgctggctcgccgacctcatcgggttccccgagacggctggtgggacgttcctgtcgggaggttcgctcgcgaacctttccggtcttcacgcagcgcgtcaggcggccaaggagcgcctcggcggtgtgcggcccgatcgctaccgcattcttgcctcgaccgaggcgcactcgtcgattcgcacggcagctgacgtcatggatctcgaggtcgtcgaggtcgaggtcaacgatccgggacggttgcgcggtgaggacctcgtacggacgtgggcaaagctgaccgatgccgagcgcaactcggtggtcgctgtcgtggcaacggccggcacgacgaacgcgggcctcgtcgatgcacttgacgaggtcgccgactttgccgaggtcaacgggctctggatgcacgtcgacgctgcctacggtggtgctgcgctcgcgtcccatcttcgcgagcgctttcgtggcatcgaacgtgcaggctccgtcgtgatcgacccgcacaagtggctgttcgctccgttcgatgctgcggccatcgtctaccgtgacccgaacgttgctcggcgggccctgacgcaagaggccgcctacctcgacgagatcaatcgtgcgcccgactggaacccgtcgagctacggctatcacctctcgcggcgagttcgaggtctgccattctggttctcgctcgcgacgcacggcacgcgccgttatcgcgaggccatcgaagcgtcgatcacgcttgcccacgagagcgcccacgagatcgagcgacgtccctacctcgagctcgcgatcgagcccgaactgagcgtcgtggtgtttcgacgcctgggatgggatgccgaagcgtacgagcgatggtcgcggcaggcgctggtcgacggggtgggcttcgtcctccccacggcctatcgaggggagaagctgttgcgcttctgcttcgtcaatccactgaccaccctcgacgacgtacgggccatcctcgacacgctcgcgatcgaccctcggccctggtgagagccgtgagctgtccgttgtgcggcgcggcggcgagtgcgctccgccgttcgaccctcgccgcggtcgtcgcggatcgctatccggtcgcagcgggccacctcttggtgctgccgctgcgtcactgtggccggctcgtcgatctcgacgacgaggagcgagcggatctctgggcgttggtgcacgacacgctcgatgctccaccgccggtcgttggtgaggcagatggctggaccgtcggtgtgaatgatggagcggcggcaggccaggtcatcgatcacgtccatgtccacctcattccgaggcgagctggcgacgtcagcgacccgcgcggtggcgtgcgctgggtccttggggcgaaggcgccgtggtgggacgacgtcggagtcgacgacgcctcgcgtcaccgttgacgtcggcgagctgccagggcgagctgtcagcgatatcagggaggggccgcggctcatgcggacccgagtcgccggctcgacgatcggccccgacaccagcagcggagcccccatccccgctgctggtgcgtgcgccgcgacccatcggcagcggcgcgtggccccccaaaggctgcctaggcgatgcccttgagcatcccgtgccagtagagcgcgggcagtccgtagcgcttgagcaaccacattgagtagtgctccttcgtcgtgtcgatcagcggcacggtcgggtgcggattgccggtgtagtcgaactcggcgagcagcatgcggttgcgagcggtcacgagcgggcacgacccgtaaccgtcgtagtgcgcttcgggtgtgcgccctgccatcactgcctttaggttcgcgaccacgacgggtgcctgcttgcgtacggcggcaccggtcttggcgttgggcgtgttgccggcgtcgccgagggcgaacacgttgggatagcgcacgtgctgcagcgtctccttgttgacctcgacgcagccgcctggcgtcccgtcggacagaggcgtcgccttcaaccagtcaggagcgctctgcggcggtacggcatggaggaagtcgtaggagatggtctccttggtgccctccttgttgtcggagatgacgacctcgcgcttggtgccgtcgatctccaccatctccgattggaaccgaacatcgatgccgtagcgcgcaacgaccttctcgagctccttcgcccacaccggcacgccgaacatcgtcggtccagggagcacgaggatgacgtggatcttgtcgagcacgccctcgatccgccagtagtccgccgcgaggtaggcaatcttctgaggcgcgccggcacacttgatcggtcccgagggcatggtgaagaccgccgtgcccgagcgggtccgctggatgaagtcccaggtgcgtggcgcgagatcgaacgtgtagttgctcgagaccccgtcgtggcctaccgcctcggtgagtccgggcactcgatcccaattgagctgaatacccgggcacacgaccaggtagtcgtagtggacgggaatgtcgctctcggtgctcacgacctggttctccggatcgatggtgaccacccggtcacggatccacttcacgccacgcggcatgaccgaggcctcggagcgcacggtctcactcgccttggcgagccctccccccacgacggtccacagtggctggtagtagtgattctccgatggctcgatgatcgcgacgtcggtctcgcctgctcgtcggaggcgtgccgccaccgtgatgcccgcggaacctccgccgatgatgaccaccttgtggtggagccccttcgcttcggccatgtcccctcctcgacctcatgaaggttgtgctgataccgacaagggtacaccactgagggaccttagttgaatttggttcgggactttcgtcccttgttcacgtcgattcaggtctgcggtcggctcggagcctggtgacgtagcgcgacgggcagtcgtccatgacgacgatgagaccgccctcgcgcgcgatggcggcagcctcgtccgagacgatcccgagctggagccacagtgctcgagcgccgacaccgacggcggcgcgagccaccgcggggcacgcctccgggcggcggaagacgtcgacgaggtcgatcgagtgctccgcggcagcagcctcgagcgtggggtaggcgggcaggtcgtgcaccatggtttcgcgagggttcaccggcagcacctcgtagccgaggtcgaggagctccgccatgacgtggtgggaagcccgccacgggttcgaggacgctccgaccatggcgatggtgtggaccgagcggaggacgtcgatgggctgctcggcgccgatcacgatcatcagtactctcccctcacgacgttgagcaggggaagtccggccatgtagcggcggacgttgcgctcgacgagcgccgacgcgcgcgtctcgaggccggcgacgtctcctccgacgtgcggggtgagcacgacgttcggtaggtgccacagcggatggaaaggcggcagcggttcggggtcggtgacgtcgagaccggcccggagccgaccgctcgcgagctcggcgaccaacgcttctgtgtcgacgactgggcctcgggcgacgttaacgacgaccgcgccgtcggggagcctggcaaggagtgctgcgtcgatgaggtgcctggttgcatcggtgaggggaaccacgacgacgatgccggcgagcgtgggaagaatcggggcaaattcgtcgaaggcgaggacgtcagggttgaaccggggtgtacgagccactcggacgatctcgacgccgaacggcgcgaggcgagcctcgatggcgcggccaatcgcgccgtagccgatgatggcgacgcgcgcacccgcgaggcttggcatgacacgacgctcccaccgcccctcgtgttgggccagggcgaactcggacaagccacgcgtcgcggcgaggaggagcgccaccgccaactctgcagtcgcgtcatcgtgcacgccgcgggcattgcagagcgtgacgccttcgccgatctgcccgacgacacgatccacgccagctgtcaggagttggaggacttcgaggtgacgcatacgcgggagcggctcgagggcggcgccgccggcagcgtaggccggcacgaagaaggtcgtcatggccaatcgatcatcgatcgggtcccctggatcccacgtcacgatcggtgcgtctgggatgcgtgtgatcagttcggtgagggctgtcgggaccacgatctgcatgaatcggagcctaggccctcacctccacagaaggtcagctgatgggcgtggctgaacggggacgtggcaactcgccacgtcgtgctgctggggacgtcgtcggtgcgtgcagcgtgagccggctgcccactcccgcttcgcctccgcgacgacgatccgcgtgtcgcccacacctggttcggcttgaccgctccgtcgcgtcgttctcagctctcggcgcccacgcacgctgctggccttctccctccaggttgacacctgcgatcgggggaatggatgggccagcattggaaggccagcattggaaggccagcattggaagaggacgacgcccttcgccactctgggcagactcgtggtcgatcgggaacggcccttgttcgtacccacggacgacgggccgcagttcgcgaagcggtacctctgacctgggagctggcggggatggcgtgtggtggttcgctgatgctggtctgtacggctctcaggatgtgactctcaggatgtgaactgagtccgcctcgcgctggcgatcatcgcccagatgaacctctcggtccctggtcatcacgcagcagcgatgagccgcggttcgcagcgccgagccgtcgagcagcgcggcctcgggcgtcttggtgcccgaggccgtccctgcgacgcggccgctcagtcgccgagctctctcgggatcgcggtctggaagctgcggaacagctgcgtgaggtccgcgtagccgaggcccgatcccggattgaacacggcgccttgtgagccggtgtagaagtcgttcgtgttggtgaactcaccggagatcgcaagctgggcgttgccgatctggccgctgtagtaggccgagccgtcgatggtgttcgaatcgagcggcgtgaacggcgacgacgtcgaggtcgcgaagcggtagatgttcggattccagaagccgagccgtacgcccccgagggcgctctcgtagacggcgtcggtcccgttgagctgaggcgcgatgaagctcgtgccaccgaagtccaccagctttgacccgtagacgctctggaactgtgggtcgtagaccgcatagccggtctgggggtcggcgttgaacgccaggtccggcgtgacgcggccaccgctcatgcccgtctgaagcgtcggggcagggttgaacgagaactgcgtcggctcgacgaggcctggtgcgacctgctgtggatcgatcggcgtcaagaactcataggccgagtagctccctgcccccaccatctgaccctgttggtagagcggacggccgaagagggtggagtagccaccgcctgatcccaccggcaagctcgtggctgcttgggcctcgttctggaagccgagtgcgatgtacatcggccacaggtagtcccagccccaggtcatctgctgcgggatggtcaccgactcggtgccgacttgggtcccgttcgccatgatcgggtaggtctgagtacccgggagcgtcgtgccgccagcggcggtgtcgtagggggagtcggaggggttgtcgataccgaggttggtggtaccgatatcgccttgagggtcataggcgccgttgtcgccgctcgcgatgaagttcgactgtccctgcgccgccatctcgaggaaggcctggttgaacgaggccgcataccccggtgactcctgcgctgcgtccaccgcagcttggatcgcggtctcggactcaccccagctcgacgagacggagccggcgacgttctggctggccgcctcgtagaaggcgtcgacgaagccgtagtcggtgttgggcgcctggtacacgacgatcttggccatcggcgcgatcgtgcccgactgctcgacgtcgagggtggtctcgtcggagccagcgttcagcgacaccggccctgcaccgccgtcgacgttgacgagcgcaagacgattcggcaacgtcacgacgtgcgcgatgttcctccagaagtacatcggcaccgaagggttcacgctcgccaaggtcacgatgccgatggtctgcccctgaccgaggtagcccgcttgctggagcggtgtgaggttgtagtcgctcgtgaaggcctgcggcagctgatcggtgggtgctgcggtttgcgacgacccagccgtgggtgcgacctggttgatgccgggcaccgcgagcgactcgtagggcgcgtagttcgacaacccgagcacggccagaatgttcgacgccaggttcaacggcatctgcggcgcgctgcgcgtcccgtagaccgtctgggtcgtcgcgggcgcactggctgcgggcctggtggtgacggtgaagttctcgagcaagatcccaagggccttgtcgtactgtgcggccgtgccctgcgaggtgacatcgaggccatcgctcatggcctgggagctgatgccgaactcacggaggaacccacgcagcgcgaggatgtactcttcggtctggccgtactcgagcgcgaactcatggggcgtcaggtacggaccacgccaaccagcagccacccgagaggcaagctgtccctggttgcgcatcttcaggatgaacgacacccgcatcatcgtcgacccagccgtggtgcccgtcggggtggcgtgcgagagcacatcggcaccgatgccctgcgacaccggcaccagcggatcagacgccgacgcgagcgactgcgcgcctggcatcgccagtgcagcgccgacgaggccgatggatcccaaggtaccgagcatctgcagacgacgactgatacgcctcatagcccaacccccctcatacctgagcgcagcccacacccatgcaggacctgcatcagcgcgacactagcacgcgaagtatgccgcatcgttgtcgagacggtccgtctttcggttggctcgactaccgagcgtgctggtccgtcgcggcggatgcgtcgtgggttcggtcgtgacgtgctcagtgcatcaggagacgcggctcggcgtcgacaccgagtgtgaggtgccagaaggagtcctgcgatccttccgccttgagttcttctgccgcgagtgcaaggcgcttcatcggggagcgcgccgtgtgatcgtgtgggagcagggttacgaggtagccgtcgcgacggaagtgtcgagccatccgcaacgcctcggcaatctgagtcgtcgggtcgaagatgagggtgaggcggcgtcgcggcgtggcgaggtggatgccgagctcttcgagcagggagagaatgcgctcgaacccaagcgagataccgcaggccggctcgtcgactccgaagcgtgcgaggagtccgtcgtagcgcccgccgccgccgatcgacgacgaccagtgagggtgaacgatctcgaacaccgacgaggagtagtagtccagccctcgaacgatgagcgggtcgatgacgacctccgtgtcccggaccgaggtccgcacgtgcgtcgcgatcgcgtggaggctctcgagcacgcttgcatcgacatcgagggtctcgaggacatcgaggggatgctcgttctcgacgatgtcaccgagcgttgcgaggacgtggtcggcgagctcctcgccgagcccagccccgaccatctcgttacgcacagcgatcggcggctccttgtcgagcttgtcgagcgcgacgagcacactgcgccaatgatctgccggcacctcgagacgctccaggacatgctcgacggcccgtcgatcgttcacgtgcagctcgaagccctcgaggccgagctggtgcaaggccgccgtggcggcgatcagcagctcgacctcggcgagccagctcgcctcgccgaggatgtctgcgtccgcctgcacgaactggcggagtcggccgcgctgcggacgctcggcccgaaaggcggggccgatctgcatcgcaagaaagggcttgggcagcttcgactggttcacggcgtagaagcgagcgagcggcaccgtgaggtcgaatcgcaggcccgcatcgacgaggtcgtcggggctcgaggcggacccgaggtcgagacgctcgccgcgcttgagcaccttgaacatcagcttcgcattctcgcccgccccggaggcagccagtgcttcgagggtttcgacgatcggggtctcgatctcgaggaagccgtgcgaccggtacgtcgagcggatcacagacgctgcggcagagcggacctcgtgctccccggggaggatgtcgcgcattcctcgaaacggacgcacctggagcattggactcctctctgactcgggcgccgatgtgctgtcatcaggcagtgtcatcctacgcctcgatcgggcccgaaccgtggcccttgggaagggatgcgctctcaccggtgttgtccggacaaaggaggggagccatgcgcaagtccttgcacgtccgttccgtggttaccgtcggggtcttggcgagccttggtgtcgtactggccgcctgtgggtcgacgtcgtcgacgtctacctcggcgaagacgtcgtccagctctgcgaccgtcgccacgtcgtcctcgagctacggcaccatcgtgacctcgggttcgggagtcacgtactacgtgttctcggcagactcacacgatcattcggcgtgcacgggttcgtgtgccgctgcgtggcatccggtgctcgcgacgcaccccacggtcggtggctcggcccaggcatcgctcgtgagcacgttcgtgcgcccaggcggagagcatcaggtcgcctatgacggccaccctctctacaccttcgtcgacgactcgggcccccacgtcatcagcggccaaggcatcaactcgttcgggggttcctggcacgtgatcgccccgagcgggaccccgatcaccgctgcgtcgagctcgtcgagttcgtcctcgagcggctatagcagtggctactagacggcgtccgcaccacgaccacgacgcccggtggctctaggctgcgagcgcacggcaccatgagcgtgccctgtgcctgatcgacgaacgaggaggccctggtgcgcagcgcttcgccacggcacgacagtcatatgatcgccctggcgcgaggtgacgggaacgtcgacctcgtcatcaacggtgcggaggtcttcagtcctctgacgcgaacctgggtctcgacgtcgctcgcgatcgccgacggggtggtggtcggatggggcgagcggccgaccaaggagcggctggacctcgcgggcatgatcatcgtgcccggattcatcgatgcccacgtccacatcgaatcgacgaagctgtggatcgaccgcttcgtcgaagcgaccgtacctatggggacggtcgcggtcgcgagcgatccacacgagatggccaacgtaaaggggctcgagggtgtgcgtgcgatgatcgcagccgcccatgatctccccatcaccatcggagtctgtgggtcgtcgtgtgtgccagcgtcgcgattcgagagtccgggggcgacgttcgaggtggaagcgatcgccgaggtgctcgccgagaccgacgcgctcggtgtggccgaggtcatggacttcccaggcgtgatcgctggcgacgagaccttgctcgccaagatcgcgctcgctggttcgcgtcgcgtcgacggccacgctccaggactgcgcggttcggatctcgatgcgtacctcgtcgctggcgtggaatccgatcacgagatggtcagtctcgaggaggtcgacgagaagcgtcacaagggcatgtgggtcttcctccggcacggatcggcaagccacaacctcgctgcgttcgccccgtcggtgcgagcctacggaacgaccaacgttgcgctttgctccgatgaccgggagccggatctccttctcgagcgcggtcacgtgaacgacctcgtcaggatcgccctggaggcgggcatcagcctcgaagacgcactcgtgctggcgacgttgaaccctgccacctaccacggtctcacccatctcggccatctggggcccggccgtcaggccgacttcgtggtgtatcgatcgcgcgccgagctcgaggcgggacggcctcccgccatggtgttccaccgtggtcggctggtcgccgaagatgggcggctcgtcgtcgagctcccccgtcgcgaggtgcccgagaccctcctcgccaccgtgcgtcttgctcgagcgctcgtcgagggggactttacgaccccgatccccgagcgcgttcgagtgatcgtcgccaacgaccactcgctctggaccaaccagcgcgtcacgactcgtgacgagctcaccgggatcaatcggctcgcggtcgtcgagcgacaccacgcgaccgggcgcatcggccatggtctcgtcgagggtttcggcctcgagcgcggtgccatcgcgtccaccgttgcccacgacgctcacaacctgatggtggtcggtgcgctcggagccgaggccgacatggcgaccgcagccaatcgcgtcgctgcgctcggcggcgggcaggtggtcgtcgtcgatggccaggtgatcgcagaggtgcccctcccgatcgccgggctcatgagtgatgcgccgattgccgagacggcgcgcgcggtcgtcgaggcgacgcaggccgcccatgcgctcggatcgacgctggaggcgcccttcatgacgctcgcgttcttgggtctgtcggtcatccccgagctcaagctcactgaccagggactcgtcgacgtcggagcgtgggacgtcgtgagtctcgaggcctgacaagccaccgctcaccccggccggtacgctaggagcaaggccaaggaggtcacccgatgcgtgatgccgtcatcgtcgatgtggttcgaaccccagtcggtcgtcgtaatggtgcgctctcgggctggcacgcggtcgacctcgcctcgacggttctcgaagcgctcgtcgcacgaacgggcatcgacccggcgctcgtcgaggacgtcatcatgggctgcgtctcccaggtcggagagcagggcatcaacgtcgccagaaatgccgtcctcgccgcgggttttcccgagtccgtccccggcacgacggtcgatcggcagtgcggctcgtcacagcaggcggtcgcgttcgccgcacaaggcgtgctcgccggtgcctacgacgtcgtgatcgccgccggtgtcgagtcgatgtcgcgggtgccgatgggctcgaacggggtgggccctgggtcgccattcgggccccgtgtcgaggcgcgctacgcagcgcgtggaggtctcgtgcctcaggggatctcggctgaactgatcgtcgaacgctgggggttgacgcgccaggagctcgatgcgttcgcgcttcgatcccacgagcgtgcttggacggcgacgacggaagggcgtttcaagtcggagatcctgcccatcgaggggcgtcgtgccgacggtgcagccgccccgaccgtgctcgaggcagacgagggcatccggcccgacacctccctcgaggcgctcgggagtctgaagcccgcgttcgtgcccacagggacggtaacagcgggcaacgcctcgcagatctccgatggcgccgccgctgctctcatcatggacgccgaacgggcgcgtcgccttggcctcgtcccccgcgcgcgggtcgttgccttctcactggcggccgacgatccgatcatgatgctcaccgcacccattccagcgacccgtcgtgtgctcgaacgcgcccatctcagcctcgatgacatcgacctcgtcgagatcaacgaggccttcgcatcggtcgtgttggcgtggggtgctgagctgcatcccgactgggatcgcgtcaacgtcaacggtggggcgatcgcgcttggccatccgctcggggcgtctggggcacgcctgttggcgaccttggtgaacgagctcgagcgccgtggcgggcgttacggcctccagaccatgtgtgagggcggcggcatggcgaacgcgctcgtgatcgagcgcctcgggtagatgagcgccccacgcgtcctcatcgtcgacaacgtcgactcgttcgtccataatctctatcagtacgtcggcgagctcggcgcagatccagtcgtggttcgtgacctcgagattcgagatcgtgtcgatccgcgcagtttcgacgcgatcatcatctcccccgggccggggcatcccagggcgtgcgtcggaggacggtggatcctcgaggatgcagctcgcgaggtgccgacactgggtgtgtgtctcggccatcagctcatcggtctcgtcttcggtgcaaccgtgacccacgcaccacgcatcgtgcatggtgagacctccagcgttcgccacgacggtcgaggcgtctttgcggggctgccgaatcccctcgtggcaacccgctaccattcgcttgcgatcgacccgacctcggttccggacgagctcgtcgtgacgagctggagcgaggacgacgtgatcatgggggtgcggcaccgatcgttcccgatcgagggcatccagttccatcccgagtcctacgccaccgacctcggccaccagctgatcgggcgattcctgggtctcgaggtgcctgcccgcactcgctgatccttgtgcgggcgtcgttcgctcggatggccaagccggcgcgccaccggagctgctcagggtggcgaccttcgccgtggtggcacttggcacgaggaaggcgggcatgcacgtccgctgcggtggcgttgacaccgacccgggcgccgcgctcgtctggtggcgctggccgtgcgacggcacgggctcagcgccgagtcggatcagccggctgacggggttggccccccgctggcaggaccgcccgaagcggtcgtcgtccacgtgatggtcacgctggacccaaccggtgcctgggtccctgcggccggcgacgtcgactcgaccaccgcggcagccggagggttcggctgcgagagtgtgtaggtgaagccagcgttggtcaggtcttgctctgcggtggcgaccggatcgccgacgacgttcggtaccgtcgcctcgttgccctgcgacaccaccaacgcaacactcgatcccggcgccaccttcgtccccggagcggggctcgtcgagatgacgtcaccattcggcacgctcgagcttgcctggtacgtcaccgtaccaacagccaattggtcggccccgagcttgttggacgccgatgcgagcgagagaccgacgacgttcggcaccgcgatcgagctcggaccgttggagacggtgaggacgacggtcgaaccgtgcggggcggacgtcccgccagtcggcgactcggcgaccacggtgccctgcggcgcgctcgctgcctgatagttggtggagacgttgaagcccaacgcgagcagcttcgcctcggctgtcgatgcggtctcaccgacgaccttcggtaccgtcaccgccgccggtccgctcgagaccacgagatcgacggtggagcccttctgaaccttggtgccagcccgtggcgattcggcgatgacggtacccgaggaggccgaggccgcccggaacgacagtgcactttggaggccaaggttggagaggacctgcgctgcgccctgctcctgggagccgacgacgttcgggacggcgacgcgagggagcggcgctgcgacgtgatggttcgagccggcgagcttcgcgtacagaaggcctcctgcgagtgcgagcagcaccacgatgacgagtaggatccatggccagcgccgccgccgacgagctgtctcgaccggcggcgtcaccgccgggatcgatgccgtgtcctcgacacgactgagcaactgggtccgatcgccaacgccctcgaccgctccgatcgccatcgtgcgctcgccgagcgcggtctgggtggtcgtcgtgcgcaggggacggtgctcgagcacccgctgcagatcgacacgcagtgccgtcgcgtcggggtagcgctggtcgcgctgcttggcgaggcagcgcatgaccacggtctcgagttcggcactcacccgagggttcacgttccggagcggggtgggcgcctcggtgacgtgcttgtaggcgacggcgatcggtgtctcaccgaggaagggtggcgtcccggtgagcatctcgtagaggacgatcccgagggagtagatgtcgctgcgtccatcgagatcctcgccacgggcctgctccggcgagatgtaggtcgcggtcccgaggaccgagccggtctgggtcaggtcctcgtcgttggcgaccgcacgtgcgatgccgaagtcggccaccttcacgatgccgtcctcggtgatgagcacgttggagggcttgatgtcgcggtggacgaccccgtggcgatgggcgaaggcgagtgcgagcgcgacgtcggcgccgatcgaggctgcttgatcgggggggaccaccccgaccgtgcggatgagctgcgccagcgtctgaccgctcacgagctccatcgcgatgaagtaggtgccgttcgcggggccccagtcgtagaccgacacgatgttcgggtgcgacagcgccgctgccgactgcgcctcacgccggaatcgctcgacgaacgtcgggttcgtcgacagctccgcgaagagcaccttcagcgccacgaggcggtcgagcaggaggtctcgcgcttcgtagacgtcggccatgccccctcgggcgatcttcgcgatgggctggtagcgcgtcccgaagacttggagctggacctcttcggtcatgtctgcctgccttcattcatcacagaggcacgctcggagcgcgcatctcccgtcatgacgacctcttccgcttagcgtgcgccgtggcggttggtgctggcgctcgcgcgatcaccaatgtcacagctgatccaggggcgacctcggtgcccgcggccgggcgcgatgcgagcacgtcaccgctcggcacggtggtgctcgtttggtaggacaccgtcccgaggacgagttggtgggttccgaggaggttcgaggcggccgcgacggagaggccttggagggtcggtacgaccacgcgaggtggtccggaagagacgatgaggttgacgcgagatcgtatcgcaacggtggtgtcggcggtggggctggtcgcgatgacctcgccgggtggcacggtggtgctggcctcggtcgtcacggtcccgaggacgagttggtcggcaccgaggtcgttggaggctgctgcctctgacatcccacgaaggcgcgggaccgcgacgaccgcgacggccgtgaggcggcttgcgatcactccgatcgcgacgccgagcccgagcaccacgaccagcacgatcgcgagccacggccatcggcgcgaccgtcggggcggcgttgtggaggctggcgagctcagcaactgcgtccgatcgccaacgccctcgaccgctccgatcgccatcgtgcgctcgccgagcgcggtctgggtggtcgtcgtgcgcaggggacggtgctcgagcacccgctgcagatcgacacgcagtgccgtcgcgtcggggtagcgctggtcgcgctgcttggcgaggcagcgcatgaccacggtctcgagctcggcactcacccgagggttcacgttccggagcggggtcggcgcctcggtgacgtgcttgtaggcgacggcgatcggtgtctcaccgaggaagggtggcgtcccggtgagcatctcgtagaggacgatcccgagggagtagatgtcgctgcgtccatcgagatcctcgccacgggcctgctccggcgagatgtaggtcgcggtcccgaggaccgagccggtctgggtcaggtcctcgtcgttggcgaccgcgcgcgcgatgccgaagtcggccaccttcacgatgccgtcctcggtgatgagcacgttggagggcttgatgtcgcggtggacgaccccgtggcgatgggcgaaggccaatgcgagcgcgacgtcggcgccgatcgaggctgcctgctcgggagggacgaccccgaccgtgcggatgagctgcgccagcgtctggccgctcacgagctccatcgcgatgaagtaggtgccgttcgcggggccccagtcgtagaccgacacgatgttcgggtgcgacagcgccgctgccgactgcgcctcacgccggaatcgctcgacgaacgtcgggttcgtcgacagctccgcgaagagcaccttgagcgctacgaggcggtcgagcaggagatctcgcgcctcgtagacgtcggccatgccccctcgggcgatcttcgcgatgggctggtagcgcgtcccgaagacgtggagctggccgtcgcgtcgagttcggcgtcctcggtccctgcgaccgagcgagaggggggcggtcgactcgtcggtcatccctgccctcccgtgataccgagcgcagcttccagcatcgccttgacgaccgggcccgcatactgagcccccgtcgggttcgcggacagcccaggctgcttgggtacgacgacagcgacgacgacgcgcgggttctcggccggagcgaaggcaaccatccagttgtccgatgcaccaaggaccgaggagtgactcgtcaacgtggtctgggccgtaccggtcttcgcagcgatctggacacctgggatctggatgccgaccgccgtcccgtagcggacgacgtcgatcatcagctgtgtgacctgtgcggccgtggacggactggtggcgaccctccaaacgtgcgggtggtaggccgtgacgaccgcgtcttgaggattgaggacacggttgaggacgtgcggggtcatgatggcgccgtggttggcgataccggctccgaccagcgccatctgcaagagggtcgcggtgacgttgccttggccgatcgcgctgaaggcgagctgggggagattctgcttgaagaacgatgcaggtgggaaggtcgacgcagccgctccgggcaggtcgatcggaggaacctgattgaatccgaaggccgtggcctcctcgctgagcgcggtcgcgccgagcttgaggccgagctgcgcaaaggcggtgtcacacgacacagggagcgtctgggtgagcgtaccgccacaggactcgtaggcgtaattgtggagttcgtgcgtggtctcaggcaaggggatctgcgacactgcagggaagttgatcagggcgagtttcgggtcgtggtcgaagattgccgaggtcgtcaccatcttgaaggtggacccaggcggataggcgcgcgaaatcgcccgatccaggagcggatcacccggattggcgagatcggccttccaggccgcgatctcggtcgtcgtcgactgtgccgcgagcggcgcaggatcgtaggtggggttcgatgcaagggcgaggatcgcaccggttcggggatcgagcgcgatgaccgctcccttgagtgacccgagcgcctggtacgccgtgcgctggaggcgcgagttgatggtggtgacgaccgagtcggtctgctcgctcgacccgaggagctgcgagatcgagtcgggtaccaccacgtgcgggacgaggtagcggttgagctcgtactcgaggcctgacaggccgtagatgagcgagaagtagccggtgatgtcgccgtagagtgatccggccgggtaggtgcgctggtagctgttgccaccgggaagcggcacggactcggccatgacctggccatcggcggtgaggatcggccctcggttctccgagaagatgcgctgcatgcccgcggtgttaccgggcgcgtcggcgagcttggacgcctggaccacctggaggttgttgagctgcacgaagaccaaggcaaaggcgagcagcagtacgagcgtgacgatcccgatgcgcctacgcatgcagcacctccaccacgccgaacgcggcaagggatgcgtgctgctgcgcggcctcgcgtgtcaagttggcgacgagcgtccttgccgcagccagcgatccctcttggacgccgtggccgagctgcaggcggagcgctggcgtgagcgcgcgctgctggagggatgtcgtctcgacgacccgcgggtggaaccagaggatccctccgatgcgtccccgctcgatcacgacgtgacctgcgacgatggtcacgatgtaggagtggtcgttgtagagcgcgaccacacccaccaccaccgccgctaccgcgccgagtgccacaatgagggccgcgagtcggagcgccgaacgtatccaggtcggacgttcggtcatctgggagggaagaggacgggggagcttggttgcgagggatgggtccttcggtgccgacgacgatcgcctcgtccggcccgacgcagcgcgggaagcctcggacacgaccgaggtcgacgctgtgtccgcggggcgggcgtgcgagagctcggacgtcgcgccgagtgcgctcgaggctcccgccggcacaccgtcttcgtgcgcgctgacgacgatcaccgagacgttgtcggagccgccgtgctcgagcgccgcctcgaccaacgccgagacggcgtgctccgggtcatcgttactgagcaggtgcgcgatctcggtctcggtgacctcgttgacgagcccgtcggaacagagcagcagcgtgtctcccggtccgagcgtgagctcgaagtggtcgggttcgaccccttccaccacgccgagcaccttcgtgaggacgtgacgcgcctggtggtgctgagcttgctggcttgtgatcgtcccggcatcgaccagttcctggacgaacgtgtgatcgttcgtgatctgacggagttcgcccgcgcgcaacaggtacgcgcgtgagtcgccgacgttggcgagatcgcagcgcccgtcggggtcgacgatcgcgagggttgcagtggtgcccatccccgcgagctcgggttcgtcctgggagcgctcgaagatcgcgacgttggcggctcgcagcgcgtcgactgcgctcgctccagcggcgacggcgtcggcgatggcccggatcgcgatggacgaggccacctcacctccgacgtggccacccatgccgtcggcgacgacgaaggaccggccgtcggcggcgacggcgtcttggttggacgaacggacgcggccagtatggctggcggctgcccaacgcaactgcatcacccgaccacccgaaaggcgctctggccaacctggagcacgtcgcctcgcgtcacgcgcatcgagccttcgacccgctcgccgttgacgaacgtcccgttcgtggacccgagatctcggacgatgatccgccgtccctccttgaccacctcggcgtggtggcccgagacgaagcggtcgtcggcgagcgtgaggtcgcaggatgcatcacggccgatcgtcgcgggggtggcgagttccagtcgacgtccctccagcggccccgccaccgcgagcacgacgagcgccccggtcttcggaccgccgctcggggtgactcgagctgcggtctggtgggcctctgcctgggcgcccgagcccgccgaggcgaccactggccgagcattcacgctggccggggtgcgctgggctcgacgcgtctcgcgccagacggcgcgcagtgcgaacgcaaagaagatccagatcaccacgatcagggcgtacttcaggatggtcaggaggacgacgctcatggaatcagccgcgctccactcggacttcgaccgcaccgagacggaggacgtcgccggcctggagttcggtcggtcgagcgactcgctccccgttcacgaacgtcccgttggtcgagccgaggtcggtcaccgtcgcggtgccttcggcgatcgtgacctcggcgtgtcgacgagagacgcggttatcgtcgatgcggacgtcggcaccgctctggcgcccgatgatgtaggacccaggtccgagctcgacgggtgcgccgtcgggcaggatgaacctccaccggttgcggtaggtggcgtcttcgacgaaggccgtgtcgatgtagaaggtgccggccttgagctgggggtcggcgtcgatggtcagcgcgatcggccccaggagctcgaagccgttgtcgtcgaccgtctcgcgcgcgagctcagcgagttcctcctccacgcgagctcgcaacggcccgagctcttcgaggtcagagggtgcgagcgcgacgacgatgcggttgggagcgatctcagagcgaaccccgatccgcacgtcacgctcgatctcgcgcaccaagcgtcgcccgatctctgccggttcgatcccacgcggcgcgcccttcgagaaaatcgactcgaccgcgctcgcgatgcgacgctcaaactgttcgagtgccaccccacctgcactataccgagcccacccgcgtacccacttaggaatccccagggagctggcgcgcctgcacacgcgcgtgagctccctcgctaagctcttggcgctcccgggcgagtggcggaattggtagacgcgcaggattcaggttcctgtgagggcaacctcgtgggggttcaagtcccccctcgcccaccgcatcggctctctggcatgggcgtcggtcgacggattgggcatcgccgcggtcgcgcgtgtgcgaagctgaaagcaacccgaggagggcggcatcggaactgtcacgctcgcagccctggtggtggcgacgtccttcgtcggggagctgcccgacaagacgatgatcgcggcggtgatcctcggccggcgtcaccacccgacgaaggtcgtcggcgcggccgtgctcggtctcggcgcccaggccgcgatcgccgtgaccctcgcaaccgtggcccgacgcctgctcaaggcctcggtggtccatcaggtctccggtgcgatcttgctcgtggttgcggccgtgctcgtgtgggtggcgcttcgggccaaggaggacgctggcgacaccatcacgccgaaccgccccttctggcagctcgtcggcgtgttcttcctcgctgaactcggtgatgtgacccaagcaaccacggctggcttcgcgctgtcgtcgtcggagcccgtcgtggtcgccgttgcggcgacggccggcatgacgctcgcgattgcgatcggcgctaccgcgtcctcagcgctcagtcgcattcccgagcgcgcgatctgggcgagcgccgccgccatcctcatcctcttgggcgtcggcgagctcaccggcgttctcatcctctaggtgctgattcctcgggatcggcctcgagcggccaggtcctcgccaccatcgtgagcacgtcgtagcgagccacgatcgctccgtcgccatcgcgtgtcacctcggcatcccaccgaacctcgtcgtagggcatccccgcgcgaggcgtgatctccttcgcggtgagcgtcaccgagagcgcatcgcccgggcgtaccggtgtgaggaagcggaggttgtcgaccccgtagttcgccagtactgggcccggctctggatcgacgaagagtcctgcggccaagctgacgacgagatagccgtgcgcaacgatcccgccgaagagtgggttggccgcggcggcctcggggttcgtatgggcgtagaagtgatcgccgctgagggccgcgaaggcggcgatgtcgtcagccgtgacgatccgcgggcctgcgctgatcgcgtctcccagctggagcgcggaggtgggcttgcgaaacgggtgctcaccgaggtgccgcggggcgcctggaacccactgggcggcgatgcgaccaagcacgctcggtgtgccttggaccgcggtccgtgcgaggtgccgcgtgacggctcgcatccctccgagttcctcgccgccaccggctcgtcctgggccgccgtggaggagccgaggcaagggagagccgtgtccggtggacgcgggagcgctggtcgcatcgagcacgaggatgcgaccgtgccagggcgcaagctccatcacgagctcgtcgacgacgcgcgcgtccgcgctcaccaccgaggccaccaggctgcctgccccgcgcgcagccagcttcgccgcgtgctgtgggtcctgatagccgaggacggtcgcgaccggcccgaaggcctcgatgcggtggggctcgtcacgatcggcgtcgcgcgcgacgagcaacgtgggggcgacgaaggcgcctcgctccgggtccgcgccgaggacatcgtccaggtcgccgccgaccacgacgtctgctgcgcgggcgagctcgtcaatccgggcgcgcacctccgcacgctgggcgaggctcgccagcggtcccatcaccacgtcgggacgtcgcggatcgcccacggtcacggccgagagccgctcggttgcggcctcgaccaccggtcctaccaggcttgccggcacgagcgcgcgtcgaatcgcggtacagcgctgccccgccttgatggtgagttcgtccacgagctgggagacgtagagatcgaattcgttcgtgccggggaccgcgtcaggcccgaggatcgatgcgttgagcgagtcggtctcgacggtgagatgggtgccgcgggtacgaacgctcgggtgcgagcggagcagctcggccgtcgccgccgaaccggtgaaggcgatcgtgtcctgaggcccgaggtggtcgaggagatcctcggcgccgcccgccaccagttggagcgcgccgggcggcaggaggccgctgtcgatgatgagctgcacgagtcggtgggtgaccggggcggtctgcgacgctggcttgatgatggtcggcatccccgcgagcagggctggagccagcttctcgagcggcccccagacggggaagttgaaggcgttgatctgaacctcgacgcccctgcgcggcacgaagatgtgacgccccgcgaagcggccaccgcgatcgagccgttccacctcgccgtcacgcaggacgttgccctccggtagggatcgcttggcgaggcttgcgtagctgtagaggacgccgatgcccccttcgacgtcgaaccacgcgtcgcgagccgttgcgccagcgacggccgatgcgtcgtggagggtgtcgacgtgctccgagaggtacgccccgagtgcaccgagcagtgcgcccctgtcttggaatccgagggcgcggagcgccgggcccccgacatcgcgcgcgaagcgcaccatcgcctcggtcgggagtcctcgcgtcgcgaggcgagccacctcctcgccggtcgtggcgtcaaggacgggttgcccgggatccgtggagaaccaccacgagtcctcgacgaagctgccaagcgtctgcatcgatcacctccgaggccgcgcccgaccgaccggtcggtcggggtgatctgaggctatcgcagactgggccgcctcaccgcggccttgtcgtcgtggctcgacgcacgtgtcgccgccggcgatctgcgtgcagctcggtgctccgggagcctgcggtccgaggtgcgatcagccagcgtgaccgatgcacatggcgctagacccgatcatgaggcacggatcgttggcggagagggagggatttgaaccctcggacccactttcgcgggtcaactcattagcagtgagtcccattcggccgctctggcacctctccttgggctcctaaggctagcgcagcttcggccgccgattcgccccggtggcccagacggcacgggctacgggccggcgtgtgtcggcggcggtcggatcggtgatggcccatccacggagcggggtggtctcgaagaccatgcgacgcccagcgatcgtggggcgggagggagaccacacatgagttggatgagacgacatcgcgtgcgcctgggtctggcggcgcttggggcggtgctcgcaacgggtgcgggcgtggcaacggccgcggcggcctcgccgccgccgagcaacgctgtcgttccaggcaccggggtaggcgagtacgggatgacgagcgccttctacgacggtcacatcgtgcacttcacgtattcgcgtggcttctactgcgacctgcacgtgtcctcgggcgcatcgtccgggtgtgaggtcggcgcgaactacgtcgtgccgccgtcgaagtcgttcgacccgctctacatcgcggtcccgatcgggatctcggtgccggccatgtcgatggactgcccgagcggcctcgtctgcgtcgatcaccccggtaccatcgacctgagcaggctagagcctgcgctcaagccgttgtatccgaacctctcggccgcgcagctgaccgccgccctgaagaacgtcccgacgccagggcacgagcacttcatcaccaccgtgaacgaccgcaagcctgagtggtgggatgtcaaggtgatcggggtggagaagctgtcggtgtggaacgccatcaatcggcatcgctcctttgccttcctcgagaaggaggttcgcgcaggacagaccacgccgatcatccccaccaacctcttcttgtacttctcggttaactaggcgtaaccgccccggcggtgctgcgtgcaccgccagggccgaccggagctcaccacccatgcacctcacacgtcgccgcctgcaacttggcctcggatggctctggctcctcgacggctgcctctcgttgcagggatcgctgctcggaaagagtttcgtcacggcggtcctcgagccaacgctcgcacaccagcccgcgatcgtcgccgcaccgctgcgaaccgccatcgaactcgtcgcaccgcacgctgcgctcgctggcttggcaatcgcgctcgtacaactcggtctcggccttggcctcgtcgtcgctcgcgacactcggcgatggcttgcgctctcgattgggtgggccctcgtcgtctggtggatcggggagggactcggtggcctcctgaccggggccacgctgctcagtggcgctccaggggcggcactgctctacgcgctgatcgcggccgcggcctggccgcggcggggccgacaggagcacgttccgccctcgccgttcgccgtcgcggcgtggagcgtcctgtggatcgtgaacggcgtcgcgcaagtcctggccgatcgttcgagcacgaacccgatcgcctccacagcgcagatgggccaagttggcgccccatcgtggatcgcggccgtcgaccaacgactcgggacgatccacggcgatgccctcggcacgatgctgatcgtgctcgaggttgccgtcgccatctggggactcgtgcctggcggaccacgcacgctgtcggcgctcgtcggatcaggtcttgcggtcgtcgcctgggtgttcttccaggggatgggggcactcacctcgggcctggcgaccgatccgaatacgggtccgctgatgctcctcctcgctggcgccgtcgtcgcggctcgtcctgcgaccggcgctctcacggaagcgatcgggcgacgccgggagcggagggcgccggtcggcgcccacgtcctgctcggcgtgcaccgtggcgagcgttcctcgtccatccccgcccagacgaagtgaggtgtgtccagtcgggtcgtgagcgtctgcgtgctgctgtcgatggctccgggggcatcccggctgtgcaggcagtccgtggaacgacttgcgtgtggcgcactgcggctcgcgccatggcgcccctccgcctccggcgacgtcgggtggcgtggcctcgcccgcctcgctgccgtcgtcggctcaccgcgaccgcatgcggggccgttggcatcgctggcgcaaccttgtgccggcccggtccacgccacctggtgcactgccatcgtgacgatcctcgactcgggcgctcccttgcggtctcggtgcccatgggggtcgatctgggctcgtcgatgaaggctccgtcggatccttcgtcgtcccagccgaggccgcggcgcccccgcagttcgatgcgccatactcagataggagcacgatcggtgctcacgagggtccggggggccaccgtcgagcaacgactggagagcacacagctaaccgccgatcacgactctcgagctcatcggtccgccggctgggatctgtgaggcccgtgcgagccgctgccggcgtcgccgcccatggtctcgcgaagcccgtctcgagtccgcagctgtcacctcgcagcgcgagcctcagctcgtgcgcaccaggtactcgagcctgggccgtggctggtgcgtgtctcggtgtcggcgaagtgccaacattgagccttgtgttgcggagggagtgggattcgaacccacggggctcgtggcccaaagcatttcaagtgcttcgcattcgtccgctctgccatccctcctcgaggacgcgagcctagtccggcgagtgcaggctccgcgggaggctcgggtcgagcggaaccggcggtggcgatggtgccgcctcttcgcggtggcgggggcgtgcactggcgaacgagccgagcagcttcgctcgtacgccgctcgcggcgaggtcgtcgagtgcactcgccaccgctggatcggtgacgtgaccctcgagctcgatgacgaacaggtaggcgccgaggctggttcgggttgggcgcgattcgagtttggtgaggttgatgccgcgagcagcgaaggcgctgagcagcgcgagcagtgagcctggtcggtcggtgacctgaaagcacgccagagcggtgcgatccgatccggtgggttccgggagcctgcccttggcgagcagccagaaacgcgtctcgttgcgcgggtcgtcctcgatgtccgacgcgagaacgtcgaggtgccagaggtgtgcggccgtcatcgttccgatggcagccgtggttggatcgttggcgtctgcgacggtgcgagctgcctcggcggtcgaggccaccgcgacgcgggtggctcccgggagcctcgtgcgcaggaacccgcgcgactgcgagagcgcttgggggtgagagaggacgcgggtgatgcgatcgagggaggacccgacgacgccgagcagctggtgatggaccgggaggatcgcctccgccaccgcaaggaggtcgaaacgatggaccagggcgtcgagcgtcgcgagcaccgctccctcgagcgcattctcgatcggcgagaaggcgaggtcgacgtcgccgtggtcgaccgcttcgaggacgtcctcgatggtggggtaggcgaccggctcgacgcgatctccgaaggaccgccggagtgcttcctcggtgaaggtcccggtcggccccaggtagctgacgcggtgggtgggcatggccggagcctaccgagtgggggtgaggtgcctcgccctaggctcggcgtgtgtgcagcccatgagtgaggacggtctcgtccgtagcgatgccggttggttcgacactgcacgccggaggcggatcggcctgccggaggccatctacgcaccgggcaaagccgagaccgacctcgtcgccctcatcgagcagagtctcgcctccggcgagccgaccatcgtcacacgcgtcgagcgcgagctggccgagcggctcgtcgaccggttcgaccttcgcccgtatcccgcgctcgaacgtcgtgcacccatggtggcgctcgccggcaatccggtgccgtcgtcgtcgctcgaacgcgtcgggctggtcgggattcttgcggcggggacctcggatcgcccggtcgctgccgaggccgcgtgtgtcatcgagacgctcggccacaggacccgcttcgtgctcgactgcggcgtggctgcgctcgcgcgatcggtgcgcgccatggaggaggtggccgacgcggacgtcgtcgtggtcgtcgctggtttcgagggtgcgctggccagcgtggtcggcggttcgatggcccaaccgctcattgcggtgccgacctcgaccgggtacggggcagcccgtggcggtgagaccgcgttgtgggccatgctcgcgacgtgtgcccaaggggtctgcgtggtgggggtcgacaacggattcggcgccgggtgcgctgcggtgcgcatcgtcggtgcggctgggcgcaacgcatgagtcgacgtaccctcgtcgtcaatgctgcggcaggagtcgcgggcgacatgctcctcgccgcgctgctcgcgctcggagcatcgagagagcacgtggaacgagcacttcgaccggtcggtctcgacaccgccctcgagacctcgctcgtggaccgagcaggcattcgcgccacgcagctggtcgttggcgacgacatcgagcacacccccctcgacgaggctgggctgcgcgcagcctgtgaggcggccagcctcgggcctcgtggacgcgagctcctctcgcgcgcgctcgatctggtgctcctcggtgagcgcacggtccacggggggcatgggcacgctctgcacgaactggggtcgctcgataccgtcctcgacctcgtcgggacggcggccgcgttcgaggcgctcgacgtggatggggtgctcctcggccccgtcgccaccgggctcggggcggctccgatggcccatggggtctacccgatcccggcgccagcggtcgcggcgatcgccgccgcgacgggcctcgtggtcgaggtccgttccggtgcagaggccaccaccccgaccggcgctgcgctgctgggtgcgctcacgatggtgcgggtcgccgaagcgagcggggccgttgctgccgtcgcctacggcgccggtacccgcgatgacccggaccgggccaacgtgctccaagccctcctgctcgatgggagcgacgcggttgccgagcagatcggcgtcgtcgagacctggctcgacgacctgagcggtgaggacctcgggcgcatcgccgacgaggcgatcggccagggcgcgctcgatgcgtggttgcttcccggactcggcaagaagggtcgtccgggtttcgagctgcgtctcgtgtgcgcaccgtctgccctcgagagcctcgtggcctgggtgcaccgacggacccagagtccgggcgtgcgtcatcgtctccaagagcgcagcgtgctctccgcgtggttcgacgaggtcgaggtgcacggcgtgtcgtgtcgcatcaaggtgacgccggtgggggccaagtgcgaggacgacgacgcacgcgaacttgctgcggtgctcggggcatcggtggcgacggcccgtgcgttggcattggcgaggtggcgagagagcggtgtgtctcgatgaccgcgactggagggagcgacgtggcacttgacccgacgatcgcgagcttgctcgaacagctcgccgcaaccggagcgacgactccggtgtacgagctgtcgctggccgatgcgagggctggcctcgatctcgtcggcaccatcgggatcgcaaatcctcctgcggttgcccgagtcgagcagcggaccatcgacgctggcgaccacgccatcgcggcggagctggtttggggctctgaggcgccacgggctgccctgctcttcgtgcacggcggtgggttcgtcctcgggagtctgcgtggctacgggccgatggtccgccatctcgcggcctcgaccggcgcgttggtcgtgtccctcgactaccggctcgccccggagcaccgtttcccggcagcggtcgacgacacgctccatggtttgcggtggctcgcggccgagcgagatgcgctcggcgtctcggtgctcggtgtcgtgggggactcggcaggcggcaacctcgcggccgtggcgagcatcgccgcgccgtccgaggggatcgacctcgcgctcgccctcgagctctatcccgcgaccgatctcagcgaggacctcgcctcgctcgagcgcttcggcgagggttactacctcaccgccgaggaggctcggtggttcgcgtcccagtatctcggcgatgacgaacggctgctcgcagattggcgtgccaatcccatggccgccaccgacctcgacgacctgccactcacgatcgtcgcgaccgctggctacgaccccatcggtgacgcgggccgccgatgggcagctcgtctcgcagcgctcgagccgcgcggtagcgtgcccgacgacctggacgagcgtctgcgacaggcgggggtcgaggtctcgggctgggcccgcggtcgggtcatctcgctggactttcccacgctcgtccacggtttcgcatcgatagcccagctcgcaccggcggcgggggccgcgtgcgagctgagctatggcctggccgcctgggtgctcgaacgggcgtgagcggcgtcgggacgcctacccggagttcttctggacggtggcgatcgcattgatcgatcgcaggacgagggtgagatcatcggggttccgggaggaccgccacgcaccgagcgccgtcacctgcaacgggttcagctctgcgaggacgcggttgcgcacggtgagcgagtcggcgagcgtcggactccaggcgaggagtcggcgctgacccgtggcgcggagcgtctcggccacggtgcgctcgtactcctcctcgatcaccgcgaagatcgccgctgcggtcgtcggatcgtctgcgaggtcgaggtagcggcgggccaagcgcatgtcggccttggcgagcgcgatctggacgttgtcgagcatgccggcgacgaacggccacgaggcccgagcctcccggatggcgtggtcgccgtgcgcctcgcgtgctgtggcgagaccggtcccgatgccgaaccacgcgggcagcgtgtgccgtgactgggcccacgcgaagacccaggggattgcgcggatcgtggcaagtccggtatcggcctgatggcgccgggcgggtcgtgagccgatgcggagctgggtgagctccggaaagggcgtgaccgatcggaaataggcgtcgaaaccggcgctcgtggtcaaggcccgataggcgtgctcgctcgagcgtgccaccagttcggtgaccatgaccgcgcggtcggtgggtgcggtgtcgtcgtccgcgccgccgaaggctccgagcgcggtgagcaaggtcgcgctggcgcgatcggtcgtggcgtagcggtgcgagatggtctcgccctgctccgtgatgcggatggtgccgcgcagcgcagctcgcgggtgcgctcgggccacctgggcgatcggtccgccaccacgcccgacggtgccgccacggccgtggaagagttcgacggtgatggcgtggcgttctccgaggccgatgagcgcctcttgcgcccggtagagcgcgtacgcggacgccgccatgccaccgtccttggtcgagtcggagtagccgagcatgacctcttggcgcagcgcccgacgctcgaggtgggccaggtaggcggggagggtgaagagttgctccatgaccgactcgagacactcgaggtctgcgatggtctcgaagagcggggtgatgtccagatggtcggcgccgagcgcacgggcgatgacgaggaccgcaatgacgtcggcagcgtggtgggtcatcgagatcacgtaggagccgatggcggcgggcccgagctcggcctcgacggtggtcagggtgtcgaacagggcgacgaggtcggcaacgagcgtggtcctcggcgtgcgagcgtgtggcggatgatccaggcaggccagcagcatcgacaggcgatcgtccgcgtccgcctcccaatagccagccaggcgaggatcgtcgccaaagagttcgaggatcgcttggtggtggaccgtcgactcctgccggatgtcgagtgatgcgaggtgggtgccgaacgtcgcggcttgccacacgaggtcctggaggggcccctcagcaagcgcggtgtcgccgtgagcagccagcgagtcgcgtatgagtcggagcgcagtctcgaggtcggggccgaccaggggggcgatgtcgagcgcctctgggtcgttgtggagccgatggagctggttgtcgatacgcgcaagcaggtagtagatcttctgacggtagggctcgtcgacgtagtgggtgcgcacgtacggtgcgaggtggacgaagtcgtgctcgtcgttgcggatcgactccacgatcgcgtcggagacggcggcgaagtgcatggagtgcgtgagccgtcgcttgacggcgtcgagtcgcgagcggaacgcctcgaggcacgcggtcgcgttcgcgacgaaggcagccttggtgacctcggccgtgaccaacgggttcccatcgcgatcgccgccgatccacgaaccgaagcgcacggggacgccgatggcatctgcatcgaccccccgtgctgccgcgagctgtcggtacacgactgggatggcgtcgaacaggctggtggtgaggtagaagaggccggtgtgcacctcgtcggcgacctcgagtcgtcgggagcgcagctcctcggtgaaccacaacagacggaggtcggacgggtcgacggcgttcggcgcgtgcgcgatgcgctgcagggtgtgcaagatggtgcgccgcttggtctcggtcgggtgcgcggtgagcaccggagtgaggcggatccgtccgagactcctcggtgcgagcttggcgaggtccgtcacgtcgtcggcgccctcggcgacgttgaggacgttgaacacgacgttggcgaggcgcagaagctgctccgtgtcgttgcgatcgagcggctcgtgctcggggccatcaccgagcgcgaagcggagcgcggcgaccgcccgcggcgtggcgagcgcccacagcgcgtccagcgggagtgaccacaggtactcgttcgtgcgcgacagcgactgcctcctcgcgggccgtggcgaccagtgcgcccgggcggcgagtgcgccgcccgggcccgagcggaggaggtgggattcgaacccacggtgggttgccccacacgcgacttccaatcgcgccgattcggccgctctcgcacccctccgtgcccgtctcggtgcacccaaggttcgggctgctacgctagcctacggtctacatcgcgcccgggccgccggcgtgggcgcggaagccgggccccacgcggcgggtccccgtgaaccgggtcagggccgggaggcagcagccctcagcggagcgattcgggtgccgtggccagcctggcttccgcgcaacgccggcggcctcgtaggcctgtccggggctgaagctaggatgccaccgtggccgagccttaccagtcgctgtatcggcgctttcgaccgcggcgcttcggcgaggtccgaggtcaggagcgcgtcaccgagaccttgaggcgcgcggtggccgaggggcatgtctcgcacgcctacctcttctcgggcccgcggggaaccgggaagacctcgactgctcgtatcctcgcgatggcgctcaactgcgaggcgcccgtcgatggtgagccgtgtctcgcctgcgcgtcgtgcgaggccgtcgtgcgcggcagctccgcggacgtcgaggagctcgatgcagcgtcgaactccggtgtggactccattcgatggatcacccagaccgttgcggctgcgccggtcgggcggtggcgcgtctacatcgtcgacgaggtccacatgctctcgcaggcagcgtcgaacgccttgttgaagacgctcgaggaaccgccggcgcacgtcgtgttcatcctcgcgacgaccaacccggccaaggtgctcgcaaccgtgcgctcgaggacgcagcacttcgcctttcgcctgctcgacgacgcatcggtcgatgcgttggtcgccgaggtcctggaggcgctcggcgccagcttgtccgacgaggcgctggcctacgtgcgtcggcggggcggaggatctgcgcgtgacacgctctcggttcttgagcaggtcctcgcgctcggaggcgtggtgaacgacgcggccgacggcgccgtcgcgctcgcacaggcgatcgcagacggtgacctcgcgtccgcggtgcgcatcgcgagcgatgccttcgagggcggcatcgacccgacagaactcgtcgccgacaccgtgggcgatctcggtcgacggttcgtggccgaggcgctggccggtgcgcgaggggcggagctcgctcggctctcgcggccgctcgagaccctcggacgcttgggggcgggcctgcgcgatgcgttggacccacaggtggtcgtgctcgcagggctcgccgaggcgctggcgccggacgcgaggctcagcgcgctcgaggctcgcgtggccgcgctcgaggccgacctcgcaggagccggtcacatgccgagacccaagccaccgaccggcgagccactgccggcccggaccacgagccccgagcccgccgggcactcggcgtcgccaaacgttgcggagcctgagaccagccagccagagacccgggagcgagcgtcccgcgcaccagcgcgcggactccaagatgctcggcgtggtggcgacgagcatcctggtgcgtccaccgagcagcggccctcgtcgctcgatcgcgtgcgtgctgccttcgcgaggaatcagcagcgggccgatgtcgaccgtggcgagccatccgagcccgtcgcgaccaccccggcccctcatggagacgatgaccagcccgcggcggcccccgacgcgcacggctccccggtgccgagcgggctcgctgacgaagcaacgcgagccgctgggcccgcgtcgctcgaggcccgtcggcagcgactgcaggcacgctggttcgacgacgtgatggccaaggcgccccgggtcctgcgtccgctcctcgcgcacgctcgtctcgcgatccgagacgagcgcatcgtggtggcggtcgacaaccgaacggttgccgagcggctcgtcccccatctcgccgagatcgtcgcgctcgtcggcccggacgagtttgccgagccgcccgagatcgtcgtcgaccctggatcgagtcagacgtcgtcccgggcgcccgctgcgagcgtcgacgatcgcgatccaggcgacgaggacggcgtcgatctcaccgacgccccctcgtccgatgcgacccccgtgcgcgacctcagcgagtcggtgatcgaggccaacgtccgcagcatcttcgaggatgctcgacggctcccatgaactcactgcctccaacgctggacgcgctcatcgaggagctcggtcgattgcctggcatcggtccgaagtcggcgcaacgcatcgcgctggcgctcatcgtgcgcggcccggccgctgcgcaccggctcgcagacgtcctcgtcaccgcgaccgagcggctcggtcgttgtgaccgctgcggggcgctcgcagagggggcgcgctgcccgatctgcgacgatccggcccgagatccgcgcatcgtcctcgtcgtcgagggcgatcgcgacgtgtgggccttcgagcgggcgcgacgtttccgagggacctaccacgtcctcggcggcgtgatcagccccatggacggcgtcggacctgatgatctcgccatcggccggctcatcgctcgcgtcgaggccgagccgatcgaggaggtcgtggtcgcgacctcgccgaccgtggagggcgagacgacggcgacctacctcgccagagtgctggccgggcgcgtcggtgtctcgcgtcttgcgaccggcgtgcccgtcggcggcgagctggagtacgtcgacgagctgaccttggcgcgcgcgctcgagggccgacggcccttcgacgacgcggggccgcgccgctagtcagtcggttgcaggcggttcttcgacgaactcgatcaggacgccaccggtggagcggggatggacgaaggcaaccgtcgtgccgcgcgatcctcggcggggtacctcgtcgatcgggtcgaagccctgacgtcgagcctcctcgagggcgtcgcgacacgattgcactcggagggcgaggtggtggatgccgggccctcgacgggcgagaaagcgagcgaccggcgagtcctcgcgggtcggagcaaccagctgaatgaagctcggcccgaccgcgagcatgacctcctcgatgccgtcggagtcgacgtgctcgcggtgggcgagtcgtgccccgagcgcctcccaccgggcgatcgccgcgtcgaggtcgtcgaccgcgatgccgacgtggtcgatctcaggctcgtccatcgtcgcctccgcgctgttcgggtgccgtcgtttgctcggccgcaaagcgcgcgaagagtgcgatgcggtcttcgccgatcgcggtgcgtgcctcggggtcgtcgatgccgagccccggcgtgggcgagaggcagaggatcccgaccttgccttcgtgacggttctggcggaccgtgcgaaccgcttcggcgacctcctcgagcgggtacgtggccgacaggaccggttggatgcgtccacgctcgatgagtcgattggcttcccacgcctcgcgatagttcgcgaagtggctgcccttgatggtcttcagcttcatccacaggtggcggttgtcgtaggagatccaatgtccgctcgtggcagcgcacgtcacgatcgtgccgccgcgcttggcgacgtagacggacgcccccatggtcgcgcggcccgggtgctcgaagacgatgtcagggtcttcgcccacgaggtcacgtatgtcttggccgaagcgtcgccactccgtttcgtcctgcgtgtcgtcgtcgcgccagaactggtagttccgctcggaacgatcgatgacgtactcgcagcccatgcgtcggagcagcgctgccttgcgcggcgaggagaccaccccgacggggatgcctccgccgttcaggacgtactggacgccgtaggagccgatcccaccggtcgcgccccagatcagcaccacctgtccttgacgcatctgggcaccgttgggcgagacgagcatgcggtaggcggtcgagttggtgaggggattgacggccgcctcttcccagctgagatggcggggcttcggcatgagctgattggctcgcacgatggtgaactccgccaagccgccgaagttggtctcgtaaccccagatgcgctgctcgctggcgagcatcgagtcgtcgtgggcgctcgggtcttggtcgtcgaccgcgttgcagtgcacgaccacacggtcaccgatctgccagcggcgtaccgcgggtccggtgcgaacgatgacaccggcagcgtccgatccgatcacgtggtagggcaggttgtggcgctggtcgagcggccgcggtgagcgtccgagtcgggcgaggaactgaaacgtcggcaccggttcgaagagcgccgaccagatcgtgttgtagttgatcgagctcgccatcaccgcgacgagcacttcgtccggcccgagctcgggcatggggacatctccgatgtgcaaggtggtgccggggtcgcgtacggcaggatcgaggtgggcaacacgctcgatgtcggactgctggacgtagcaggcccggtagtggtccgggaccggtgtcgccgccaactcggcgggatccgcgccagcgagcacagcctcggtgaggaacgacggcatgctctgacgttagccgctggcgacctcggcgtgtgggcagcccatctcgacgctgcgacgccggtgttctagactcgcgaggtcacaaccgtgtgctcgtgctggcgccaccaggtcaggcactcggaaggttggaggaggtcgtatgtcgaggtcggtcattgtctcgtacgctcgcacaccgatcggcaagctccagggtgcgttggcgtcgctgtcggcgatggagctcggtggtcgcgccatcgcgggcgcgctcgagcgagcgggagtcgccccggactcggtggactatgtcttcatgggccacgtgctccaggcgggccaaggccagatcaccgcgcgtcaggcggcggtggccgccaacattcccatgaccgttcccgccaccacggtgaacaaggtctgcttgtcgggcttgaacgcagtgttcctcgccgatctcctcctcgcccaaggacgcaccagtgtcgtggtggcgggcggcatggagtccatgtcgcgggcgccctacgtgctccccggcgcgcgaggcgggctgcgcatgggcgacgcggccctcatcgactcgatgctctacgacgggctcttctgtgcgttcgatcgcatggcgatgggtgcctcgaccgaacactactgccgggtggatcatccggtgtctcgcgatcgccaggatgcctttgcggcacgttcgcacgaactcgctgctcgagcggcgaaggagggccgtctcgccgacgagatcgtgccggtcacggttgcggggcgccgaggcgaggtgcacgtggtcgaggacgacgagggcatccgtcccgagaccacggtcgagacgttggcccgtctgcgtccggcctttgccgaggacggcaccatcaccgctggtaatgcgtcgcagatctccgacggcgctgccgcgctcgtcgtcatgcgggccgaggaggcagagcgacggggcctgacccctctcggagagatcctcggttatgggcaggttgccggtcctgacgcgtcgttgctgcaccaaccctcgaacgccatccgtgctgccgcgagcgacgccggcctcgacccggcctcactggacctcgtcgagatcaacgaggcgttcgccgcggtcgcgctcgcgtccatggacgatctcggtatcgatcccgcgcgtgtcaacgtcaatgggggcgcgatcgcgctcggccaccccatcggggcctctggtgcgcggatcctcggctcgctcctgctcgagctccgtcgtcgtggtggcggtgtcggcgcggccgccctgtgcggcggaggaggccagggggatgcgatgatcgtgcgcgtgccccgcaccgagtcctgactcaagccgccagaggggcggtcgatgacctcctcgggaggtcccgcatgcgtatcttcgtcgagggggcaacggcccacgacaactcctacggcatcgtgaacctgcgccttgccgaggcgctgcgcgctcgtggtcatgcggtgtacgtgcgcccgtgggaccaatcgttgcggggagctggcacgagcgcacgtgagctcgacatcgagcccttcgatctcggcgtcggccacgccgacgtctgggtgcgacaggtgtggccgccgtcgttcgagcgtcccgacgccgagcgcgccttcgtcatccaacccttcgagcttggcgcggtgccggcgaggtgggtcgtcgaggcaggtcagctcgatggcatcctcgtcccctcactctttgccaagcaaacctggctccaaggcggggcggatcatcgccacctctgggtcgttccgaacggcgtcgtcgtacctgccctcgtcgagtcctcagaaccgaacggtgatcgcctgacggtgggctacgtgggcggcgccatctggcgcaagggtatcgacatcctcatcgctggtctcgacctcctcgatgacgccacgctgcaacggatcgagctcatcgtcaaggtcgcaggtcatgacacctactacgccggccagtcgttgctcgagcgcgagctgctcgcccatcctcgtgtcgccgctcggacggagatcattcgcgcgagcctgtcgcaggcgcggctcgatgccctctaccaacgcttcgacgtgctcgcggctccctaccgtgccgaggggttcgcgctgccgatcctcgaggcgatggctcacggggtcgtcccgatcgtgccggacgccgggcctgcgccagagttcgtcgaccggagctgtggcgtgttgctcgcgagtcgccccctcatggtcggtggccctgccgatgagttcctcggtccggcgctcggaccacggtgggccatcgaggtggacccctgtgacgtcggctccgctgtggccgcgctgctggaggaccccggcgcccgggctgggcgtgcgcgagctgggcaggagcgagcccgggcctggagctgggatcgcgccgcaagcatcctcgaagacgtcgtgagggcgctggacgccgacgaggcacccaccgatgcgtcgtctcgactcctcctccgtgcgacacggggtggtccgcaggcgatcggtgcgctcgtcgagctgggtgacctccacggcgcccgcgagctcgctgcggtgaccccaggcgccgaggcggtgcgagcgagactggaggggctcgcggccactcgcccggacgtgtggtggggtgcgcgccatcgcgcgccgatccccgctcgggccgaagcacggtcgtcgtggcacgccggcgaaggcgacctcgccatcgtgacgcgtgtcgcgcgctacctcgctccactgcttgcgatcggaggcggtcgcgtcctcgacgtcgggagcggccatggcgcgatgctcggtcagctccggtcgctcggggttcgtgcacttgggatcgaactcgatccagcgagagtggagcacctgcgtgcgagtgggttcgacgtcctcgagggcgatgcgctcgaggtgctcggcaccttggagacggggagcttcggcggagccttcgtgggccacctcgtcgagcacttcgcgccccaggaggtcgtcacgttgctcgccgagctcgctcgtgtcgttcgcacgggtggcgtcgtggtgatccagaccccggatccgcaggcagagggagtcatgcagcagacgttctggctggatccgacgcacgtgcgcccgtatccggcgatgacgatcgccgcgatggcggccgaggccggttttgccactgttggggcactcgagcgatcgctcgcaccgctcgtcaccgacacgctcgtcgtgctgcgtcgtcgtgccgatgcgcccgtcatcgcgcctcggagggtggcagcggtggcgccggcggtggtcgtggtggccgaccctcacagtggattccggcgagccagcgacgcgctcctcggcgagctcaatgcgatgggcgtgggcgtgcgggcagagcccctcgtggggccgcggtcggaccgcgtgttcatgcacgatctcccgattggttcgttggccagcggcctcgtgggtacggcgctcgttgcgcgtaccgcgtgggaggcgaggggcctgccacgagagctgcgccgtacgctcgcgcgctatcgccgcatcctcacctactcacactggagccgcgacgtgttcgtcgaggccgggctcgcgcccgaccaggtcggcgtctgggcgccgaaggtggccctggacctcgatccagcgtcagtgcgagccctgcgaggttcgagggagccctcggggcgcgtcctggcggtcgccgagtggggcgctcgcaagaacatcgaggccctggtgcgcgggttcgtcagggctcgtggtcgtgtcggccagggttcgctcgtcgtgaagctacgacggatcgaggccgagagcgcggcgcgctggctcgagcggatcgtgagcgaggagcggggtgaattggcggcgatctcgctcgtcaccgacgacctggcgcctgcggcgctgcgccagctctatctcgatgccgacctctactgcatgccgacgcgtggcgaaggcttcggcctccccttcctcgaggcgatgagctacgggtgcgccgtcatcgcgccggccgacggcggtcaccgtgacgtggtcgatgcgtcgcaatggctcgttcccggtcgctacgagcctgcgcacgtcgatcccgcgtctggctacgccgatagcggggtcttccgaggagccgagtggttcgagatcgatcccgacgccttcgtcgaggttctcgccgaggcgctcagcgacccggacgcggtgcgctcgcgcgccttggctgcgctcgggctcgccgaggctgccgctcaggcctcgatcgacgagcacgagctgaacgtcgtgcgcgcgctctgggaggacgcggtcagctacgtggatgttcgatgatcgtgacgtgctcgatgaccgggacgcgctgtggccgaccctcgggagtgccgagcgcgtcgaggcgtgcgagcgtctgcgaaccgtcggtcatctgaccgaagaggctgtaggcgggcggcagtgcgacacccgagggtccggagacgatgaagaactgcgagccattcgtgttcggaccggcgttcgccatggcgagcgagccgatctggtaggcgcccgctggcgggagctcgtcgcggaagcggtaaccaggcccacccgcgccggacccggtgggatcgccaccttggacgacgaagccggggatgatgcggtggaacccgatcccgtcgaagtagtggtagcgggcgaggaagacgaagctgttgaccgtcgtcggcgcgcggtcggcgaagagctcgaagcggagctcgccttcgctcgtcaccatgagcgcctcgtaggatgcaccgtcggcgaggcagaagctcggcggcgcatcgaaccgctgtgtcttcgggctcgagccgtcgggctcgggacaagggtacgaacggtcacgacgtccgaacgccacgggggctcctttcttcgtgctcaccgcacgacgtgcggcacgtgccacacgctcgggtggactacgagctcgcgatgtgccagtggatcgacacgatccggtaggtgtgcttcggggggatgccgttgttctgggccgagccggcgtcgttgatggtggtgatgacgttgaggccgctcgtcacctggccgaagaccgagtagtcaggggggagctgctcgcctgcgggacccgacacgatgaagaactgcgagccgttcgtccctggcgccccggagttcgccatggcgagcgtgccgaagcggtacgagccggcaggagggttcttgtcggcgtaggcgaagcccggtgatccggtgtcggtgttcgtcgggctgccaccttggatgacgaagcccggaatcactcggaagaaggtcgtcccgtcgtagaagtgatacaggctgaggacgtagaaggcgttggcgctcttggggcccaggttcggctcgagtcggaaggtgaacgtgccggcggtcgtgtcgacggtggcggtgtaggtatcccctgcgacgaggcactccttggggtaggcgccaaagtgcgttcgcttgggtgcggacccgttcgggttgggacagccgttggcgaggaggcccttggcgggctttgcggtcgggcgcgtgagctcgtagatcagcgcgaggagggcgacgaggatgacgaggacgatgactcctcgtcggatgaggcgggtgcgacgctgacgggctgcgcgctcggcgcgcagtcgctcttggttggcccgaatacgggctcgcttggcgcttggcacctcggcaaggctagtcgccaaggcctcgggactggcgcgaccacaacgcgccgcgcgtgctcccgcctcgaggcgggaggtaagcggcgctctcatgctggtcggcgctgttactcgacgtagtggcactacctcgaacagcccctccttgcaggtatgacgctgacgagcgttggtgacgtgggcgagtacgtcggtcggagctaccggctctccccgagcccgcaccaggcagccagaatgaccacctgggcacatactcgccgtgccattcacaacctcgccatcgagcatcggcaactggcgtggtcaagagcgagggcgcaggtgacgtaccgcgaacaatgtcacgagctggctgaactgcgctcgtgcgtcgagtgggtggccgagccaccggcacaccttctccaacaagcacttcgtgacgtggatcgggcacaccagaactggtggcaaggacgcgcccgtaagccagccttcgagaggcgcggccaactccgcttccggccctcggcctccgatctccagatccgccacctcaaccgaaaatggtccgaagtgcgcctccccaagctggggtgggtccggttccgacgctcgcgctcactcgatggtgagcttgcctcggccacgttccgctgctcggtggcgtgtggcaggtgaacttcaccgtcctcgccacgacccaccgcgcgcccgtgaacgacggacccacggtgggcgtggacttcggtattgcctgcgccgcctacgtcgctggcgagtctgccccgaggatcatgcccccgacgctcaccccaggcgaagagcgtcggctccgtggcctggaacggcgtaaggctcgccagctcacctacgcgaagcgtcacaacggaggccggtactcgaaccgactccgtcggacgatccgtgagatcgcacgtctccgggctcgccaagcccggagacgccaggacttcacccacaagctcacgagcgacttggccaagaaccacagcctcgtcgccatcgaggacttgcgggtgacccacatgacgagctcggccaagggcacggtcgaggctcccggcaccagagtccgtcagaaagccggactcaaccggtccatcttggacatagctcctggcgagcggcgtcggcaactggactacaagtgcccgaagtacggctccctgctcgtggcggtgccaccggcaggcacgagccagacctgtcctgcatgcggggtccgagacccagcgagcaggccagggtgcgggagatcgttcgcatgcgtgcagtgtggtcataccgcacatgcggacgcggtggccgcacggaacatccttgatcgggccatcgccctcgttggtggtggtattgccgtggggcgcacggtggacagcgcgggcagggcttctggcccgagtcgccgccgcacggcggcaggcgtttccgcgaaggttcctcctgcggtaggagccacaggtgcgtgaacagcgcacccgaagcccccgccttcaggcggaggtggagtcacgagccgctagccttgggtgcccgtggccctgctcgtccagaagtttggcggaacctccgttggcgatgtcgatcgcatacgcggggtcgcagaccatgtcgcgcggacggtacaccgagggaacaaggtcgtcgtggtcgtctcggcgatgggcaagacgaccgacgacctcattcggctcgcgcacgaggcgacggacggccctgcgcccgcgcgcgagatggacatgctcctgaccgccggtgagcggatctccgcggccctcgtcgccatggccctgagcgacctcggcgtggaggccgagtcgttcaccggctcccaagccggcatcatcactgacaccgaccacacgcgcgcgaagatcctcgagatccgcccccatcgtctcctcgaggccatcgagtcccacatcgtgccggtcgtcgcgggattccagggcgtctcgacggagcgcgacgtcacgaccttgggcaggggtggttcggacacgaccgcggtggcgctcgcggctcggctcgacgccgacgtctgcgagatctacaccgacgtctcgggcgtgttcaccgccgatccgcgggtggttccgcgcgcgcgcaagattccccggatctcgttcgaggagatgctcgagctcgcggcctcgggagggcgggtcctggcgttgcgctcggtggaggccgcgcggaacttccgggtcccgctccacgttcggtcgagcttcacgtgggagccggggacgtgggttgtggaggaggagccatcgatggaacaggccgtggtgtccgccatcgcgcacgacgcgagcgaggtcaaggtgaccgtggtcggtgtcccggatcaccccggggttgccgcccgtctgttccgccacgttgcggagcaaggcgtcaacgtcgacatgatcgtccagaacgtctcgctccaggggcacaccgatatctcgttcaccgccccgaaggccgatcgcgctcgcgcactcgaggcgacccgtgctgctgccgcagaggtgggcgccgtcgacgtcatcctcgatgaagggatcgggcgcgtctcgctggtcggagccggcatgaagacacaccctggggtgacggcccgcatgttcgagaccctcgccgagaaggggatcaacatcgagatgatctcgacgtcggccatcaggatctcctgcgtggtgcgggccgaggtactcgaggacgcggtccaggcgttgcacgaggccttcgaactcgatcgtgaggtgcaccaatgaacgggctcgccctcggggtggtcggcgcgacgggccaggtcgggtcggtgatgcgtcggatcgtgctcgagcgcggtctgccgattgcgtccgtgcggttcttcgcctcgtctcggtcggcagggacgcagctcgacttcgatggcacctcggtcgaggtcgaggacgttgcgacggcggacccgagcggcctggacgtggcgttgttctcgatcggggcttccgcggccgagcgctacgcgccgcgcttcgctgcgagcgggtgcgtggtcgtcgacaactcctcggcatttcgtatggacccagcggtaccgctcgtggtggccgaggtgaatcccgaggcgatcgaggcgatgccgaagcggatcgtggcgaacccgaactgcacgacgatggtcgcggtcggggcgctcgcggcgatccgtcgcgtcgcgggccttcggcgcgtcatcgcgtccacctaccaggcggcttcgggtgccgggcgcacgggggtggccgaactcgccgcacagctgtcgcgccccggcctcgaggcgctcaccttcgacgggaaggccgtcgacttcgggacgccagcggtcttccccgcacccctcggggccaacgtcgtacccctcgcggggtcgttggtgggcgacgacacgaccgaggagcgcaagttcgtcaacgagagccgcaagatcctcggcatggaggacctgcgcgtgggcgcgacctgcgtgcgcgtgccggtctttaccgggcacgcagtgagcgtggtcgccgagtgcgagcggcccgtcgaccttgccgcggtgcgtgctgccctcgaggcggctccagggctccagctcgcggacctcccgacgccgctcgacgcggcaggtcgcgacgaggtgctcgtgggtcgggtgcgcgccagcgacgtcgtcgacaacggcgtcgcgttcttcgtcgcgggagacaacctgcgcaagggtgccgcgctgaacgcggtccagctcgctgagctcgtcatcgagcgcggcctggtcggctgagcaatcctcgcgagcgctcagagaagctactcaagttcgagatcctcgtcgtcgatgccttgaatgcgcatcacggaaccaccgtggagcgtctatggacagcgggcattcaaggaggatccatgtccctctcggtcaacacgaacctctcggcgattcaggcctacaacaacctgaatgcgacgtcgaaccagatgcagaccacgatcaatcagctgtcgtcaggtctgcagatccagacggctgcggacaacgctgcgggctacgtgatctcgcaggggctgcagacccaagcgaacggcctcggtgtcgcgatcaacaatggccaggacgccatcagcgtgctgcagatcgcctctggtgcgatgaaccagcagatctcgatcctgcagaccatgaaccagctggccacgcaggctgcgaacggcggcgcgaacaactccaactcgctgagcgcggatcagcaggagttcgcggcactccagagccagctcgaccagattgcgaactccacgagcttcggtggcacgaacctcctgaacgggagctactcgaacgaggtgttccagatcggggcctacgcgagctcggtcgaccaggtctcggtcaccatcgcgaccttgaacaccacctcgctcgggatcgcgtcctcgacggtgtcgatcggcacggtgtcggcggcgatcagcgccatggctgcggtgcagtcggccatcctcgcggtggcgagtgccgaggcggtggtcggtgctgcgcagaaccaggtccaagcgatcatcgcgaacgacacggtcgctcagcagaacgtgcagtcggcgaactccacgctggtcgacaccaacatggcgcaagcgatgaccgcgttctcgtcgcagcaggtcctcatgcaggccggcgtcgcgatgctgtcgcaggcacaggcgctgccgcagctcatcctcaagctcctcccgtagcacatccgatcatccccggtcgttcgtcacgggcccaggccgtcggggcctgggcccgtgatcgtgcgatcaggactccgaaggaggccccatgtcgtcgatcctgccaacctcatcgacgagctcgacgtcgtcgacgtcgagtggctccaacgtctcgacctactccgacccgggcggtcccccgatcacgttctccagcctgttctccggtatcaacacccaggcgatcatccaggcgctcatggccgcctacgagcaaccccaggtcgatctcgccaagcagatccagtcgctccagacgaacctgtcggactaccagaccatcgtctcggacctcagttcgctccagacccaagcgaacgctctgctccagccgtcacagctctcctcgatgagcgcgagtacctccgacgctgccgtggccacagcaaccgcaggtcaaggcgccatcccgtcgtccttgacgttcaacgttaaccaactcgcccaggccaacatcctcgcctccagcggcaccgtgtcgtcgctgtcgtctcaggtcgcctccgggaacttcctcctctcctcgagcgcagcgggcgccggcgtcacctcgcttgctggctcctcgctccaggtcgggacgcactccttctccgtgacgagcgcgctctcgggcgccaccgcgacggggacgtcccctcttgcctcgtcgatcaccatcggctcgtccaacgacaccatcgccgctaccgtcaacggcaccgccgagacgttcaccatcgcctcggggacctacacgccagctcagctcgccgccgcgatctcgcaggcgagttcggtctcgggaacccccttgctgcaggcgcaggtgaacgcccagggccagctcgaactcggcacgacgctgctcggttcgagtgcatcgctccagatcaccggtggtaccgcactgtcgacgttgggactcgcggcccaagcgagtgcgtccgtcgggaccgcggggtcggtcacactcgatggcaccgtcaccgccgtgaacaacgtccaagcgggtcagacggtcagccttgccgacggcaccggggggtcgatcacgatcggtatcggatcgttcggcctcagccagggcagcttcaccgctaccgaggtggcggccggcaacgggtcgctctcgcaggtggtgagcaacatcaatgccgctggcgccggtgtgacggcatcagcggtccaagtctcgagtggtacctacgtgctccagctggtctcgaaccaaacgggcaccgcatcggccatcaccgtcgaacaggcgcccttccagagtgccctcggtagcttcacgaccattgcagcggcacagaatgcccaggtccagatcggtggccagagtggttacctggtgagttctcagacgaaccaggtccagggcgtgttgcccggagtcacgctcaacttggtgtcggcgcagcctcccggctcggcgccggtcaccgtgagcgtcacccccgacggcaagacgctcgcctcgtccatccagtcgctcgtcaacgccgcaaaccaggtgctcagcgacatcaacacgtacgcgggctacaacgagcagaccaacaccggcggaccgctgatgggcgactcgacgctgaacgggatcacgagccaggtgctcggtgtcatcgctcagaccctcggcgaggggggcatcaccgccgcccaagccggcatcacgctgaacaagaacggtaccatcagcttcgacgcgcaaaccttcgcccagctctacgaccagaacccgaccgccgtcacgtcactattcgcccagtcgggcaccttcaacccatcgagttcgacctacgcaggcgacgtcagtctggtctacgcgggtgatggcacgcaagcgggctcctaccaggtcgtggtgagccagtcggccacccaggcgacggacagcgggtccgtgctcgcgagcggaacgatcaccaacgccgagacgctcaccgtcgcccagggttcgcagtcggtgcagtacgcagcgagcgcgggcgagtcgctcagcgccatcgcccagggcctcaatgccgcgttcgcccaggcaggcatggggatgcaggcctccgtggtgagctcgtcgtcgggttcgcagatcgtgctcaccgcgagtgcgtacgggacccagggcgacttcacggtgacgacgacggcgacgggatctgggcagaccgggctcgcaacgagcgcgaacacgccggagtcgttcaccggcttgaacgtcgccgggacgatcaatggtgtggcggcgaccgggaacggtcaggtcctcgccgcgccgacgacggaccccacgctcgccggcttgtcgctgcaggtgagtgcgagcgggatcacgagtgcgacgaccattggctcgttcgtgtattcgccagggatctcgggccagctcgccctcatcgccaacggcgccacagcacccgtgaccgggagcctcgaggcgcgcatgagcggtatccagcaacagatctcgatgctgcagcaacagtacaacggctatacgccgatgatccagaacgagcagaagatgctcgagcaggagtactccgcgatggagtcacagctcggctcgctccagagcgtgggctcggagctcgccgggcagattgcacagctgccgtagcgcccgccggacgggtgctgtcgacgacgaccaaggagggagaccgggtgccttcactggctcaacgcgcctacgtcgagaacgcggtggaaaccgcgacgccggcccagcgcctgctcatcctgttggaccgcctggaagcgaatctggtggccctcggtgacgcctttcgggtgcgtgacctcgaggcgatccacgtcaacgccaaggctgcccaggcagcgttggcgttgttgcgaggggcgcttcgcgaggacgtgtgggagcacgccgcgacgatcgcgaccttgtacacgtgggcgctggagcgactcgtccgagccaatgtggacaaagatccggctccctacgaggaggcccgctcggtgctcgagccgctcatcgcggcgtggcgacacgctgcgatggaggtctcgcatgagtgagcgcgatccgtgggaggagtacctggacgcgtacgcggagcacctcgcgcgcgtctcggcgagcctcgaggcgggccgggtgctcgagacgccgttcgatcgtgcgcgtccttccagcgcgatgccggcgcgtcacgctgagcgagcacgcgccctcgtggaggcgaccgaacagctcgcggcccgcctcgagcatcgtcgcgacgtggtcgggaccgtacttcggtactcgagagtccgcgaccccgagcgggtggtgctcctcgacgtgatcttgtgaggatgccatcgcttcggtttgcgtgactcggccgatctcggggacctgctcagacgctccacggggctgcttcctcgcgtgagctgacgcgagaactcacgggaagggactcgacggtgatcacggtgacgggacccaccaagcgcttcggagaggtgaccgcggtcgacggattgtcgttcgaggtgccgcccgggcgcgtgaccggattcctcggcccgaacggcgcgggcaagtcgaccacgatgcacatgatcatgggcctcgaaaggcccagtgcggggtccgctctcatcaagggcgtcccctacgccgagcttgccgcgccactgcggcaggtcggtgcgttgctcgaggcgaggtcgttccatccggggcgcagcgccagagcgcatcttgggtggctcgcggcctccaatggcttgcccgcccacggggtcaacgaggtgctcgagatcaccggactcaccgacgtcgcttcccgacgggccggcaccttctcgctcggcatgggcagcgtctcggcgtcgcggctgcgctcctcggtgatcccgaagtgctcatcctcgacgagcccgtgaacggactcgatcccgaggggattgtgtggatccggaccttactgcggggacttgctgctgaaggtcgaacggtgttcgtctcgagtcacctcatgtccgagatggctcagacggccgaccatgtcatcgtcatcggccgtggcaagctccttgccgacaccgcgatggcagcgttcatcgcatcgagttcgtccgcgagaacgctcgtacgcacaccgagcccagatgcgctcgcgtcgaccctgcgcgagcgcggcggggtcgtggtcgtcggcgacgacgggagtctcaccgtccggcctcgtggcagccgagatcggcgagatcgccttcgagcacgggatctgtctccatgaactgtcgccccagagtgcctcgctggaggaggcgttcttcgctcttacgggcgaggacacgagctttcgcggccagccggccacggttcacgaaggagcctcacgatgacgacgacggtcgaccgtagtccgagcacgctcggcccgacgttcgggcgctgctcgccgccgagtggatcaagatcaagagcgtgcgctcgacggtgctcacgctggtgttcatggtggtgctcggggtcgggatctcggcgctcggcgcgctcgccgtgcacgcagccgtgtcgcaccaccgcatcggccccggcttcgatccggtcgcgcgctcgctcggcgggatgctcatcgcgcagatcgccatcggtgtcctcggcgtcttggtcttcagcgctgaggtcgcgagcgggacgatcagccagacgttcgccgcggtccccaagcgctggcacgtgctgctggccaaggtactcgtctacttcgtgatcgcgctcgttgcctccgaagtagtgtccgtggcgagcttcctcgtgggccaggccgtcatgcacggagtcgtcccgacgaccagcctcacgaacgcgacggcgatgcgggccgtcctgggcaccgggcttctcgtcgcgatcgtgggtgtccttgcgctcgccatcggtgtcatgatccgtcgtactgctggggcgatcaccaccttcgtgggcgagtacctggtgctgcccttgctcgtgaccgcgctcccgtcgccgtactccaccgacatcgaaaagttcctgccgttccaagcagcccaggtcatgatgtcctcgcagctcgtcgcgaacagcttgtccgcgtgggtcggcctcgccgtcgtggcgggctacgccgtgatcgccgtcgtcgtcgcagggtcgctcctctcgtcgcgcgacgcctagacgcccggccatcgcgccccgcgcgaggcctgcagcttgccgcccgtgccgccttccatggaggggacacgggcggtcgtgcgtcgcgggtgcggctcaagaacacgtaagtactgatttaaccaaatcacgaaaagctcgatgattcggtttagggaaaccgtcacccgtaccgctaccgtggtgcccatcgcgttggggatgtgaggaacacgccgctcattcgagcatgaccgcgtcgaccaccagagggtgcgaggccgcggaaaacagcggggcgttggtcgacggccgctccgagccatgacgagcgagcgcacgagaggcgtaccgacacgagagaggaaagaggatggctggcaatcgctacgaggctggcgtcaaggagtaccgtaagacgtactgggcgccggactacgtgcccttggactccgacctgctcgcggtgttcaagatcgtaccgcagcctggtgtcgaccgggaggaggcagctgcggcggtcgccgccgagtcatccaccggtacctggaccacggtctggaccgacctgctcacggacctcgattactacaagggccgcgcctaccggatcgaggacgtgcccggggacgacacggcgttctacgcgttcgtcgcctacccgatcgacctcttcgaagagggctcggtcgtcaacgtcttcacatcgctggtcgggaacgtgttcggcttcaaggcggtgcgatcgctgcgcctcgaggacgtgcgcttccccttggccttcgtcaacacctgcaacgggccaccccacgggatccaggtcgagcgcgacaagatgaacaagtacggccggccgctgctcggctgcaccatcaagccgaagctcggcctgtcggccaagaactacgggcgtgccgtctacgaagtgctgcgcggtggtctcgactttaccaaggacgacgagaacgtcaactcccagccgttcatgcgctggcgcgaccggttcctcttcgtcgccgaggccatccatcaggccgaggcggagacgggcgagcgcaagggccactacctgaacgtcacggcaccctcgccagaggagatgtacgaacgcgcagagttcgccaaggaactcggcatgcccatcatcatgcacgacttcttgacgggtggtttcacggccaacacggggctcgcgcgctggtgccggcgcaacggcatgctgctccacatccaccgggccatgcatgccgtgatcgaccgcaatccgtaccacggcatccacttccgtgtgctggccaaggccttgcgtctctcgggcggtgaccacctgcacaccggaacggtggtcggcaagctcgagggcgaccgagcggcgacgcagggatgggtggacctcctccgcgagtcctacatccccgaggaccgtagccgcggcatcttcttcgatcaggactggggctcgatgccgggcgtcttcgccgtcgcctcgggcggtatccacgtgtggcacatgccgtcgttgctcaccatcttcggcgatgacgcggtcttccagttcggtggcggcaccctgggtcacccatgggggaacgcacccggcgcgaccgcgaaccgggtcgcactcgaggcgtgcgtccaggcgcgcaacgagggccgtgacgtcgaacgggaggggaaggacattctccagaacgcggccaagcacagtccggagctccgtgtggcgatggagacctggaaagagatcaagttcgagttcgacacggtggacaagctcgacagcgtgcatcgctgagcgagcgtggttcgacgaggtggcgcagcgtgcgccacctggacctaaggagcacacatggctgacgttcaggagtatcgcacgtcacggcgctacgagctgttctcgtacctgccccagatgaccccggagcagattcgcaagcaggtgctgtacctgatctcgaagggctggaacccgagcgtggagcacgtcgagccccatcgctcgatggagcgcttctggtacatgtggaagctgccgatgttcggcgagcagtcggcggaggtggtgctcgccgagctcgaggagtgccgccgtgcctaccccgatcacctcgtgcggctcgtgggctacgacaactacacccagagccagggcatcgcgttcgtggtgtaccgaggccaggggtcctgagcggctggcgctcctcgacgccgggaccagcgcgacctcgcggttcgcgcgaggtcgcgcggtggggccgtgaggctgaggcatgcgaagcaaggagatggcgacggtgcgcgcgagcgacgcgagcgagtcgccaagtaggtcgaggtcgtggtggtgacgaagggagggccccgagtgagcgagtcgtccacagccggcggggcggtgcgttctggccgcgcgttggcgcagcagcgtcggcgtgagcaagcgcttcgtcgcgcgaacgcacgaacgtcgccgaggcacgacgcagacgatcgttcgcttcgggtcgcaccgatggcgactgacccggtcgaggcgcggccgacgaccaccgagggtggctcgtgcgggtgcgaccacctcgagccgcccgtctccgcggtcgcgacgtcaagtgaactctcggtctcggtgcgcgggtatgtctcggtggatgatgcgctgcgtggcctgcgcggccgtgaggccgccaaggtgcgtcgccagctcctgtgcgtgcaggggcgaggcgatctggcggcgtgccgtccgacgggccggatgcgccgtcgcgacacggtggcgcccaaggtggaagagggcacgacccttgccggcaccagggtgaccggtacgcaggtcgagctcacggcgaccatgacgggtgcggatgcgggcagctgccgggtgatcagcggcacacagtacgtgggcatcgagcagttcgaggagcgctgcgacgaggtcccggaggcgcccccggccaaggtcagcgtcggacgcacggcggcagggcgccgcgtgagcggcacctccctcgcgccgagccccagcgtgacgggctccgaggcaggtgcgtgccggcgtgtcaccggcgtggactacctggaggcgaacgcggtcgaggaggcgtgtggcgtcgtccccgagccggcgccagccaaggtgacggtgggcgagacggtccagggccagcgtgtcacgggcgtcgtggtcgatcgtccagctgcggtcaccggtgacgacgtcggccggcgccagcgcgtgacgggcagccagtaccagcaccctgagtggattcgaggcgagtcccgcaatggttcgtcggtgccgcacaaggtgagcgtcatgagcacggtgcggggtcggccggtcaccggaaccatcgtgacgcccgatcccaccatcaccggggccgatcgcggggcgtgcgtcgaggtgacggggacggagtacgaggacagcttggccaagtaccaggcgtgcaatcggcaaccggcacctggtccgcacaaggtgagtgtgatgcggacctggcgcggggaagtcgtgaccggaaccagcgtcgagcacgacccgcgggtcaccggtgacgaggccgggcagtgcgaggacgtgaccggcacgccctacgtgggaccaggccagtacgaggccgtctgcgcgaccgatccggttcgccagggcgctcctggtggatcgtcgatcgcgatctcgggaacgcgtgtcagtgggagcgatcgtgtgacgggggacgagcgtggccgttccgtcaccgtgagcgggactccgtaccagcgtgggccctctggcgatgccgagcgcggcgtgagcgcgtggggggcgacgttcagcatcaccacgccagcacgtgctgcgcgtgaacgggcgcgggcgcgcgtcaccggcaccggctaccagcgcggtacggctcggatcacggggccactcgacctcgccctcggtcttgtctcgggtacgccagagtttcgctatcacgccggctcggacgccgaacagcaggtgcccgctcgcgaggcggccgtcacgggagaggggcgcgaggagggctttgccatcaccggcgatgcctgggatcgttcggccaccatcaccgggacagaaggggcctccgcatggcgcaatccgacgttgcggggaacccctcgtcggcgcgagcaggtggccagaagcgccgaccagcgggcagcggcagctcgcgagctccccgccagcgcccgcatcaccggcagcaccggtggcgtgagcgaggggccggtcgtgacgttctcgggcgggtcgcgcggatgatcttcctccagatgaagcggacggtcccatgaacacgcgcaatcgccgggggcgctacggcgggccgactccgtcgcatggcccctacgggctgggtacggcgcaaggacgtctgtcgggccaggacgcgcatcgcgaccacggcgaagcggccggggtcagccgtcgctcgaggaacgcgcatccactcaccgatcacgccgccaacgagcgacttgctcgattcgaacgcctcgtgcgagggcggttcgacgcggtggtaccgacactgaaggcgatcggaacgcttgctccgaccgacgacctcgccgaacgtgctgcgtcgatggctcgggccgagctcggtgtggcgttgccggcagagctgttcgagtctgcctggatcacgggtctcgacatgcgccgcctgtacgcggtcacgatggcagagaccatccatgcggtcgcggccgagacgcatgcgttcgccggcaccgagtcggacaccatgaccggtttcctgctcgagtgcggcttccacgccgtcgacatctcgccctgctccgatgggcggctgaagggtgtcattcgctcgatcctgcgcctgccggacgacgccgtgcgcagtcgcaaggcctacgcgggcgccatgttcgacgtcgaagcgaacgttcgccggtggatcgagacggagctgctgcgctttcgcgaggggagtcccgtgccgccgtcggccgggacgcggtatctgaagatcgcggtctatcactggagcaggtcggatcccgattacgaggggtgcgcggcgcacggctccgaccagcgggccgccgccgcggcagcactgtcgcgcctccgcgagcttcgcgaagccgtcgagaacagcttcttctgcggcgcctccatcgatctgttgttgatcggcgtcgacacggacaccgatgccatccgcgttcacgtccccgatgcgctcggcgacatggacctcgatcgctacgtggacaacctcgatctctatcgccagaccatcgacgatgacgtgacgacggcgcgcatgcgcgtgcatcgcgccatcgaagctgcgagcgccgatcaccctggcgggccgccgcacgagggcatgcgacggctcattgcgacgctgctcatcaacaacctgtcgcagatcgactacgtccgatcgacctggggcgagcgctacccggacgtcggccacgccgaggccttcatcagcgtcggtgacggcttcgaggagttccaggttcgcaacctcgcctacttcgtcttcctccagacggtcgaggaggcggcgaccgacctcgacgtgggcatcgggctgttccagcgtcggcccgagcgccgtgggttgccgatcccgatcgcgatccactttcgctacgaccgtcgggtcccgggcagtcgggagcgagccatcgagcggtgcgtgcgcgtgcgctcggcgatccgagcgcgctatcgagatctgtgcgcggccgggctgctcgcgtgcgacatgagcatccaggagcgaaccttctcgagcccgatcgaggtgatcgaagcgccgagtgacggtccggcgaacgaggatccgctgcgcctcgagcagcgtacggggcgagaggggggcaggcgatgaaggtctaccaagtcgagaagacgctcgtgtccaccaatcgcatccccggtctcaagaatctcccgctgctcgtggtgcgcgagcgcaacggctcccagagcgtggcggtcgacgcggtcggctgcgtccctggcgactgggtcatctgcgtcagcggatcgggcagtcgggcggcgacgggagacaaggactatccgaccgacctcaccatcgtcggcatcatcgactactgggacgaggacggctagcgacgagctgccggtgcgatgcgtcggcagcaatggggcttcctgggcgtgcgagcgcacgaccagggcgcaagggcaggggccacaggcgtatgggcaaggggcccgagcaaggaggaacgatggcaacaggggtgagcggcatcgcgctcggcatgatcgagactcgcggtctcgtgccggcgatcgaggcagcggacgcgatgacgaaggcggcggaggtgcgcctcgtcggtcgtcagttcgtcggtggcggctacgtcacggtgttggttcggggtgagaccggcgcggtgaacgcagccgtgcgtgcgggtgcggacgcgtgcgagcgggtcggcgacggcctcgtggcggcacacatcatcgctcgggtgcactccgaggtggagaagatccttcctgacggcgaggacatggccgccggggcgtagggaagaggcgagaagggagcgttgacgatggcaacaggggtgagcggcatcgcgctcggcatgatcgagactcgcggtctcgtgccggcgatcgaggcagcggacgcgatgacgaaggcggcggaggtgcgcctcgtcggtcgtcagttcgtcggtggcggctacgtcacggtgttggttcggggtgagaccggcgcggtgaacgcagccgtgcgtgcgggtgcggacgcgtgcgagcgggtcggcgacggcctcgtggcggcacacatcatcgctcgggtgcactccgaggtggagaagatccttcctgacggcgaggacatgggcgctggggcgtagggaagaggcgagaagggagcgttgacgatggcaacaggggtgagcggcatcgcgctcggcatgatcgagactcgcggtctcgtgccggcgatcgaggcagcggacgcgatgacgaaggcggcggaggtgcgcctcgtcggtcgtcagttcgtcggtggcggctacgtcacggtgttggttcggggtgagaccggcgcggtgaacgcagccgtgcgtgcgggtgcggacgcgtgcgagcgggtcggcgacggcctcgtggcggcacacatcatcgctcgggtgcactccgaggtggagaagatccttcctgacggcgaggacatgggcgctggcagcgtggcggcgcgctaggcggtcgaggtgacccaggaccacaggctggccggctttgtcgtgcgcgcgttgcgtgcagagatcatcgcggtcgagcactacctcgcacaggcgagcctggtggaactgtggggctaccccgcgttggccgatcgcttctcgaacgatgcgcgtgacgaactcgatcaccagcaccggattctccggcacgcggtgtcggtgggcatcgcgccacgcgccatcgacctgccgccactacggtttggacggagcgtggaggagctcgtaatgatggaccgggcattcgagctcgacgtcgttcgactctacggcgaggcggtcgactactgcgggcggatgggcccggcctcgagtctcgagctcttcgccgggctctacggggaggaggtcgagcacctggcgtcgatcgacgccctgatcgttgagatccgatccgagaggagggggcgggatcgtggctgaggccgccgcgccacgatcctggcgcttcgtgttcgacgactacgcaaccctgcggcgcttcctcgatgagctcgcgtcgatcttcgaggagcatgggtactaccccaaccagagcttccatcgcgccgacgtcaccatcaccatcgatcccgcgagtgccaacggcaacgaccagggcgttcgggcggtcgaagccgctctcgatgcgttcgtggcccgtggggtggggcaggcagatgaccagcggtcctgacgcgagtgattcgagcctcgtggtcgcggtggtgaacgccaagggcggatcgggcaagacgacgctcgcgctgcacgtgggcgtcggtcttgcgaggcgcggccccacgctcctcgtcgatgcggatccgcagcggtcgctgaccttctggacggcgatggcacctcctcgagctgcgttgccaccggtagcggaggcctcgcgggacgtggtgaccgtgctgcgcgctgcgcgggcggactaccgctacgtcgtggtcgactgtccaccgacgccgatccgaggcaccgtgcgtgccatcgtcgaggtcgccgatcgtgtggtggtcccgatcctcgcatctccggtcgatctgtggacgagtgcggagacgttctggtcgttgcgcaggctcgcgactggggaccgtgcgcgtcggttcgtcggtgtgctcaatcaggtcgagccgcggagcgcgctgtcggcgtccgttcggcgcgcggcgctcgcactcgatgtgccgctcaccgccgtcgcgctgggccggcgtgtcgtctaccgacaggcggcggccgaggggcggagcgtgtacgcgatgggcaagcgagcgatggcagcgatcgaggagatcgaggccctcatccaggaggtggtgtgatggcagaggacttgagtgatcgcttggtgcgggaggtgagccaggtccgtgcgatccgagccaagcagacaagcgcgtcgaagggggcaagcgtcgccggctcagaaccgacggcgcgagccaccgaacctgccaagccccgacccagacggcgtgcctcctcgactgtcgagcgcgaggtcacgcctccggccgacggcgaggccgtcgaacaaccggtggcgcgccctcggacgagacgtcctccacttgccgtgtggcctgactgatgcggatcgcggggcggtgctcgtgacggtcgggccgacactgtctcaccgaggagcaccgtttcaccgagcaataccgtctcgccgaggaaaggagtgagtcgtggtcgcaccccaagttgcgccctacgtcatcgacacggagccctactaccgaccggtcgcgaacgagatcgcgctcttcgaagccgcgtactcggtgcggatgcccgtcatgttgaagggcccgaccgggtcgggcaagacgcgcttcgtcgagtacatggcctggcgccttggcaagccgctcatcaccgtcgcgtgcaacgaggacatgacggcctcggacctcgtcggacgcttcttgctcgacgccggtggcacccggtggcaggacggaccgctcacgatcgcggcccgctacggggcgctgtgctacctcgacgagatcgtcgaggcgcgccaggacacgaccgtggtcatccacccgctcaccgacgctcgccgagtcctgccgctcgacaagaagggcgagctggtccaggctcaccctgacttccaggtggtgatctcctacaaccctggctaccagagtgtcatgaaggacctgaagcagtcgacgaagcagcggttcggcgccttggacttcacctatccacccgcggccatcgagacggagatcgtcgcccacgagagcggggtcggccacgacgatgcgagtcgcctcgtctccatcgccgagcgcgcgcgcaacctcaagggacacgggctcgacgagggcatctcgacccgcatgctgatctacgcggccagtctgatcgcccagggcgtcgatcgcatcgccgcatgcgagatggcgctcgtgtcgccgatcaccgacgaccccgacatgcgtgacgcgctcgaggcggcggtcacgacctacttctaggagggccctcccgtggccatcgagctcgagcgctaccaggggctcctcgactctctcggctcgcaagccgaggaggtgctgcgtgctgcctgggacgaagcgacgcgctccttcagcccacgcggcctcgaggaggtctacctccgctcggccgcgagcctcgcggcgctcgggcgtgggagcgacctcgtggtctcgttcctgcagcatgcccccgcgctggcgcgtgagctcggcgaggacgccgtgcgggatctggtcgcggcctcggtggcgttcttctcgaagaccagcgccagcgtgatcgcggagctgatcgcgacgagccctcgggcggccgagcgcctcggggacctggaactgttccgctcgtacctcgggctcatcgaccagctcctcgggctggccccccgtggcgttcgcggcctcctcgaccacctcgacgtcctgcttgcgcagctgaccctgagcgggttgacgcgctgggccctctggggtgcccaagtccacaaggtcgacttcgaggcccagcagcgctacttcgcactcgagagccccgatgcgctcgccatgctccagcagcagcgtcggggactgctgttcgtcgacgtccagcgtcgcttgcaggcctacctgcgcgccctgtggggccgcgacttcttccttcgacccgagtcggccgatccgcagacggccgcggtggtacgaccgttcatcgatggattcgtcgtccacctccccgacgcctacgacgacacggacggggtcggtgggccgatcagcgcgctcgagcagtaccgtgccgcggcggcgcacgccgctgcgcaccaggtggcgaccacacacgccgtggctcgagccgagcgatcgcgtctcgaggaactcgtcgtcgggatcctcgaggatgcacgcgtcgagcgcgcagcgatcgcggccttcccagggctcgccgcgctctgggcgcgcttccacgtcgtcgatctcgccgccgacgacccctcctcgctcgtcgcgcggctcgttcgctctctcctcgtcggctgcgataccgaggctcatccgtgggtccgtgaggcgtgcgagcacgctcgggtgctcgacgagttgggcggtgccgaggcagcggcagctctcccggagcttgctcgaaccctcatcgacgccgcacgccgcttcggtgtcgagctcgaccaggtcgactcgcgagccgtcctgccgagctaccgcgacgacaatcgctacgtcttcgagcgcgacgaagccattcgcgcccaggccgccaacctcgatctcgcgccctcgcaggtgcgcaagtacgtgagcgtgatggagatgatcaacgaggtggacgtgccgagcgccggcgacgacgccgaggagatctgggtgctcgcgaccgagttcttccgtgacggcgaggccgagagcgtcaacgcccaagagggtcgggagccgccgcccgtcgaggtgcactatcccgagtgggactaccaggtccaactggagcgaccgagctggacgaccgtgctcgagcgacgaggacccttgggcagcctggaggaggccgaggcgatcctcgccaagcatcgccccttgctcgggcggatgcggcgcatcatggaggcgctcgcccccgagggtgtccagcgcctgcgcaagcaggaagagggcgaggaactcgacatcaacgcggcggtcgatttcgcagtcgacctgcgacgggccgaggagcccgacctcagggtgatggtgaggacacggcgcatcgtccgtgaccttgccttcttgctgctcatcgacacgtccgagtcgacgaacgatcaggtgctcggcgcggacgtgacggtgatcgagctcgctcgagaggcgaccttgttgctcgcagaatcgatcaatcgggtcggggatccgttcgcggtccacgggttcgactccaacggtcgccatgccgtcgagtacgttcgctacaaggacttcgatgagcgcttcggcgacgaggcgcgcgctcgtgtggccggcatgaccggccaactgtcgacgaggatgggcgcggcgattcggcatgcgggtgcccatctcgcacgccagccccagcgtcggcgactgctgctcgtgctcaccgacggcgagcccgccgacaacgacgtgcgcgatccgcagtacctgcgtgcggatgcacgccgagccgtcgaggagctggctcgcgctggtatctcgacgttctgcctgagcctcgatcctcgcgcggaccagtacgtcgcgcgcatcttcggcccgaccggcttcatcgtgctcgacaacgtggcgcgactcccggaacgtctgccgctgctgtacgcggccctcacgcgctcgtgagcaacacgtaagtctttacttgacgaacatcgctttcaaatgagctttcgcatagcggaagtgtatttccggtctagtagattctcttttcatgaggagcacgccgaccgagcgccttcacggtgatggtcggctgcaggcttctgctcggcaccgggtcggtgcggcgagcggtggtgaggtgcgccccgcggtcgcgttcttacggtgtccgtggccgtggcggcccctcgcggggctcgaggggagaagggatcaagcatggggaacctggtgagttcgtggttgctcgcggtcgcggtggtcgcctacctggtggtgggtctcggtctcctggtcgcgcggggcgcggccggacgcagtgcgcgacggtggacgacggtggcgtcgtgggtcgggctcgtcgccacgctcggcgcctcgacggcgttcgtcgtcggccacgaacgatcgaccacgctggtcgcggtgccgttgcccgcacacctcgggcacgtcgccgtcgattcgctcgtgaacgccctcaccatgatcgtcgtcaccttggtggcgttcgtgggcaccgtggtcgtacgctactcgacgtcctatctccgtgacgaccccgctgagctgcggttctatcgctggttgaacgtgacgctcggcttgttcctgtggctgatcgtcaccaacgacgtgtggacgttctggctgctgttcgtcggtgcgagtctgtcgctccacgagctgctcgtgctctatcgcgatcgaccgctggccgtcacggcggcgcgcaagaacttcgcgctcgccagactcgcggacgtgagtctggcggttgcgctggtgctcgtcgtggaggcgacggggcgctcgagcttcgccggcatcgcggcgtggttccacggggcgcaccccccgatcggcgtcgatctcgaggtcgccgccgggctgatcgctctgaccgcggtcgtcaagagcggtgtcttcccgttccacgggtggctgatccaggtcatggaggcgccgacccaggtctcggcgctcctgcacgcggggctcatctacacgggtgccttcctcctcctgcgcatgagctggctggtcgcgtcggtgccgtgggtgtgggtggtgctcagcctcgccgtgatcggggtgttcgtgtcgtcgctgatgatgctcaccgagacgaacatcaaggaggcgctcgcgtactcgacctccgcccaacttgcgttcatgatgatggagtgtgggctcgggctctacagcgtcgcggtgctccacatcgtcgcacactcggtctacaaggcgcatgcattcctctcgtcgggaagcgtggtggatggccatcggggcgcgatcctcaccaaggtcccggcgcgtcgaacgttcgggcaggtcgagggcgcgctcgctatctccgcgctcgtcaccgtggggatcgccgagctcctccgggtcgacgtggtgcacgagcccacgttggccgccatcggcttcgtggtcgcggtcgccatgacgcagctgctgctgcagggggtcggggggtcagaccgtcagggacgtcgcttgctcgtgcgcgcgagcggcttcagtgtgctcgtgggtgctgcctacttcggtctgcacgacgtcatggtgcgcctgctcggctccacggtgccgtccgagagcggccaggcggaccacatcccggggtgggtgctcgtcgtggtcgtggcggcgttcgtcgccttgctccacatcggccagttcctcggtccactcagccggacccgcttcggccagtggctctacgtggcgctgtggaacggtctgtgggtggatgccgccatgcgtcgcctcgcgtggttcgaccacctgcgcctcggtcatcgtccgctgcacgcccctaccgagcctgagcctgttgcggcgacgggcgatgagcccgtgcccggatcggcggcctcggtgctggaggccgcgcgcgtggcgtgcgaccggatcgcgccggtgtggccgctccggcacttcgtcgccgtgaacccctacttcggcatgcgcgacctgtcgttctgggaggccgaccgctacctccagaccatcgcaggttctcgcctggtcatgccgctcgcctactaccgagagcagctgcaacaaggacgcatcggtccacgcgatatccgtgacgcagcgcgtcgccttgggcgcgagggggcggtcgagggcctgctcgctcgcctggaggaggctcgtagtgagccgctgctccctcggctcccgctcttcagcgatcacctcgggcgccttcgcggtcgggacatcaccacggccatcgtcgagcggctcagccatttcctggcggcctacttcgacgaggggcaagccacctggcaccttccgtggcaggggaactcgttgtggcaggcgtggcggtcatcggtccaggtcgacgcgacgccgcgcatcctcggactcccgtggcccaagtcggcgctcgcggccctgcccgagacgcccgaggacgccatcgccgctgcgctgggcgtgctcggcgttgctcacgaagcgatcgaggactacttggtcgctgcgttgttctccatcggcgggtgggcgtcgtgggcacggtaccgacggtggcaggcggagctcgtcggctcgaccgacgaaaccctgttcgaactgctggcgatccacgtctcggccgaggcgatcctcgcccagggacttgatgatcctcgggtgctcgcctcgtggcgcgacgccgtcgtggcagcccatcggtcctgggtcgcctcgcggcacgatccgctcgacgacgccgcgatcatccacaccgcgttcgagctgcactatcggcgccggctcgcgcggacgctggctgccggtgctcgcgccggggaggcgcccaccggggagcgtcctcgcgcccagctcgccttctgcatcgacgtgcgctcggagggcatccgtcgcgccgtcgaggcccgcgtcgctggcgcccagacgctcggcttcgccggcttcttcggcgttcagatggagtacgtccccttcggtaccgagcacgcacgcgcacacctgccggtcatctttgcgccgccctatcggatccgcgaggacctcgtcgatgcctccgacgacgaccgtgcgcgtgcggcggagcgacgtcgccttcggctcggcgccggcgcggtctggaagaccttcaagtcctcggcggcctccaccttcaccttcgtcgagtcgaccgggttggtctatatcccgaagctcttcggcgacgccatgggctggtcccgcacggtcgcgcaccccgacgcccgaggtctcgctggcgacctgcgcgcccggctgcgcccgaggctgacgccgatcggtcatcccgggggcaacgacgggatccccgaggatcgtctcgccgagatcggtcgcttcatcctcacctcgatgggcctcaccggcgggttcgcgccgctcgtggtcctggtggggcatgggagcgagaccgtcaacaacccgcaaggatccgggctcgactgcggtgcctgcggggggcagacgggcgaggtgagcgcgaaggtggcggcggcgttgctcaacgatccgcgaacccgagcaggcctcgaacgcgtggggatctcggtgccgagcgacacggtgttcgtcgcggcgctccactccacgttgacggagcaggtgaggctcttcgacgtcgacgcgctcgatcccgcccatcgcacgctcgcccgcgacctcgagaccgatctcgccagcgcgacccggctcgccgcgacgtggcatgcgacctccctcggtgtgaccgccgaccaggatctggcgcacgacctggcgcgtcgtggccgcgactgggcggaggttcggccggagtggggcctcgtcgccaacgccgccttcatcgcggctccacgcgcaaggaccgcccacgtctcgctcgagggccgcgcgttcctccacgactacgactggcgccacgacacggactttgcgaccctcacgctcatcatgaccgctccgatggtggtcgcgaactggatcaacctgcagtactacgcctcgatggtcgacaaccggcgcttcgggagcggaacgaaggtcctccacaacgtcgtcggtggttcgatcggagtcctcgagggcaacaacggcgatctgcgggtcggcctcgcgctgcagtcattgcacgacgggacacgctggctccacgagcccgtgcgcctcaccgtggtggtggaggcgcctcggggcgcgatcgaccaggtcgtccgggaacaccagctcgttgccgacctcgtcgagcacggctggctggtcgtgacccaactcgaacccgacggcactctctacgaacgcgagggcgatggccgttggcgcgcggtcatcgacgacgattcgttggcagcgaccagcgttcgctgacggcacggcgagcgcgagcggcctcgctcggcggccacctggaccgttcgcggtgtcggtggctgctcgtggtccgtggcctcgctcggcgatccgtgctcaaggtcgtcggcgttcgctccgagatcagtggcagccgcaggatgcgagctaccgctgatccaaggagggcgtgacccgcacggggaggactccgcgtgagcacgaccgtcgaggcgttgagctttgcgctcgacgcgctccagatccagagcgacgccatcgccaacaacgtggccaacgtcgacacgcctggctacatccagtcgaacgtgtcgttccagtcgtcgctcgccgctgcgctcgccaacggtggcacggccaccaccagcgtgaccccatcgtcgaaccccgtgggactcaacggcaacaacgtctcgctcggccaggagctgacccaggcgaccaccaacgccatggactaccaggcagtctcgaacgagctgacgacgtacttccaaatcttgtcgggttcgatgggaggccagttctaagtgtcgctgtttccagccatcgacgtcgctgccaccggcgtgacgaccgagcaaacctggctcgacaccatcgcgtccaacgtggcgaacgtcaacgaccagtcggccacgaaccaaccgatctatcaggagcaagaggtgctcgtgcagcccgtggagacgtcgccggtgacgggcgtcgcggacacgaccacgacgcccgtcggttcgggcgtccaggtcgacgccatcgtcaccccgttgcccaacggggtgctctcctacgatccgacctcgacgctcgcgaacgcgcagggctacgtgaagacgcccgggatctcgctcgcccagcagctcgggaacctcgtcaacgctcaaacctcctaccaggccaacgtcgcggtgatcaaccaggccaagacggcctacgaggcgatcctcgggatccaggcatgatccccccgatcgcacccctgtcgtcagcgctgtcggcggcggcgccgggtgctgcgggagcgtccacgcagggcgcgagcggctttgcccaggtgctcggatcggtcatcgaccagatccaatccacccaagcgacggccaacacccaagcgcaaggcgtcgccagcggccaagcgtcgatctcgaacgcgatggtcgcctccaccgagtcgctgttgaccaccgaacttgcggtccaggtgcgtaacggcgtcgtcggcgccatcgaccaggtcatgtcgacgcagttctaggaggcgtactcgtggcatcccaggacctcctcgccaaggcgcgcgactcgctccggcgcttcgcgagcggcttcaccaccggccagaaggccgtggtcatggtcggcatcgcactggtcgtcgcgatcgcggttgcgctggcatcgctcacgtcgagcccgagctacggcgtgttgttctcgggcctgtcggcccaagatgccggctcgatcaccgcgaagctccagtcggcgggggttccctacgagctcacgaacggcggtacgacggtgctcgttccccagaacctcgtcgaccaggagcgggtctcgctggccgaggccgggcttccgtcccagaccgcggggctgacgtcgctgaacggcctgtccatcacgagctcgcagatcacccagcaggccgattaccaggcggcactgcagtcgcagctcgctcagaccatcgaggcgatcaacggcgtgcagtcggcacaggtgaacctcgccctgccgccgacggacgccttcgcgatcggtcagtcgtctcagccgagtgcctccgtgatcgtgacgctggacgcgggcgtgtcgctcacgtcccagcaggtcgaagcgatcgtccacctggtggcgagcgccattccggggatgaacgccaacgacgtgacggtggccgaccagaacggtgacgtgttggcagcgccgggtctcggcgtcaacgcccagggcgccggtcagtcggcgcagggcttcgactctcagctcgaggcgtcgatccagtcgatgctcgacacgatcgtcggccccggcaacgcgaacgtccgcgtcgcggccacgctgtcgacgaaccaggtcacgacgaagacccagtcgatccagacgcagaagggcaagcccctcaccacgccgacccagacccagacccagacccagaccttcaccgggaacggcaccgtgccgggcggcacgctcggcaccactgggatcgcgaccaccggcaaccaggtgtcgacctacaagcagacctcctccacgacgcagtacgcgatcggtcaggtcacccagacggtccagcaggcaccgggcgcgatccaacgactcagcgtggcggtggcggtcaactcgcacgtcaagggtctctcgttggcgaagctgcgccaggtcgtcgcggccgcagccgggatcgtaccggcacgtggcgacacgctctcggtcgtcgcggtgccgttccccgcgctggcgacgacgccgtcgggtgcggggtcgtcgctcttcgggtcgatcctcggcatcgcgaaggtggtcctgctcgtgctgggagcgctcggtgcgatcttgctcatgtcccgtgcagcggcgcggaccgaggtcgagccgttgttcccggctgagctcgagcctgctctcgcgggaacgggtggccagctcgccggacccaccgaggaactgcccgcggtcgccttgccccagagccagccggtcgtcggcgaggacgtgctcgactacatcgatcgccagcccgaggacgtcgcgaagctcttgcgggtgtggatgacggcgcggggtcgcaaatgagcacgaaggtcgccgacctcaccggcacccagaaggcggccgcagtgttggtgcagctcgggacgactctcgctgcgcgcgtgcttcgtcagatgagcgagtcggaggcggtcgccctcacgctcgagatcgccaagctgccgagcctcgacaaggagaccatcaccgaggtgatggccgagttcgtcgactcggtcatcgcactcaagaccgtcggtcaaggtggcgtcgacacggccaaggagatcctcgcggcccgcctcggcgatcgtgaggctgaagagatcctcgcccagttcaccggtcagagcgtgtcgaacccgctggccttcctcgaccacgtcgagccgttccagctggtcagcttcctctcgagcgagcacccccagtcggtggcgatcatcctcgccaacgtccctccagacctcgctgcccaggtgctggctgcgatgcccgaggagccgcgcgcggaggtcacccgccgtatcgccctcctgtcgcgtgtcgacccggtcgtcgtcgagcaggcggcctccgtgctccagcgcaagctagccggcctgacgaagcaggggccggtcgccctgcgcagtgggctcgccacggtggtcgagatcttgaacaacgtcgaccagagcacggagcgacgcatcctgtcggacctcgactcgctcgaccccgaactcgccgatcgcatccgtgagcagatgttcgtgttcgaggacatcatggtgctcgacgaccggaccctccaacgcatcttgcgtcaggtgtcgccgaaggacctcgccgtggcgctcaagggcgtctcgcccgagttggtgaaccgcatcatggcgaacatctccgagcgcgccgcggaggatctcgccgaggagatcgagctgctcggccccgtgcgcctctcgacggtcgaggctgcccaggcacagatcttgcgtgccgtccgcgagctcgaggcggcgggcgagatcacgattgcccggtccgacgaggagctcgtccagtgagcgccgcacggatcctgcggggcacgctcgacggcgtcgggacggtggcgctcccaccggtggagcatcttcgtgccggtgacgccgagcacatcgcccttgcgcacgccatcgaggaggccgagcgccgaggcgaggagcgcggtcgtgccgccggtgaggcggccgcacgtcagctcctcgaggccgagcgggcggcgctggcctcgacgcgcgaggcccttgcctccgtcctccggcggctcgagcgcatcggtcgcgagtcgctcgaggccgacgtcgtcgaggtcgtcaccctcgcgctcgagctcgctcgcgaggtgctcgcggccgaggtggtgcctccccgggagcggatcgaggcgtgggtggggcgagtgctcgccgagcgtgacgtcgaggagctcaccgtccgcctggcaccgcccgcgagcgaggacctcgccgacaccctcgtcgagttggccgagcgcgaaggcgcgaggctccgggtcgagcgcgatgtgtcgctcgagccctacgacgtcgtcgtggagctgggcgcgggcgtcctcgacctcacggtcaagggagcgttcgagcgtgtcctccaggagttgcgggagctcggacagtgatccctgcccgtgtgcgcgaccaggtcctgcgtgccgctgcgccggttcgccagggccgcgtctcgcggatcgtcgggatccacctcgaggtcgagggcgtggaggcaggcatcggcgaagcggtgcgcatcgagctcggaggcggccagagcctggtcgccgaggtggtgggcttcgagggcgagcgactcgtctgcatgccgctgcgcgaggtccgaggggtgcgctacggcgatcgcgcggtggccttgcgccgcgcgacccagatcccggtgggtcgagcgctgctcggccgcgtgatcgacgccgatggggtgccgatcgatggccagggcccggtcgaacccgacgatgtggtgggcctcgagctggcggcaccgatgcccatggagcggacgctcatcgacgagcagctcggtctcggtgtgcgcgtgctcgacaccatggtcccctgtggtgtgggccagcgtctcggggtgttcgcgggagcgggtgtcggcaagagctcgttgctctcgatggtggtgcgcggtgcggacgtcgacgtgcgggtcgtcgcgctggtcggggagcgcgggcgcgaggtgcgagaattcctcgagcacgacctcggaccggaggggatggcacgctcggtcgtggtcgtcgcgacctccgacgagccgccactcgtgcgtgtgcgagcagccatcgcggcgactcggatcgcggagtggttccgcgccagcggggcgcgcgtcttgttggtgatggattcgctcactcgcttggcgctcgcacaacgcgagctcggactgtcggcgggggaaccgccgagcgtgcgtggctatccgccgagtgtgttccgcctgatggcccagctcctcgagcgtgcaggcaccgatcacgtcggctcgatcacggggatctactccgtgctcgtcgaaggtgacgacctcgacgatccgatcgccgacgcggctcgctcggtgttggacggtcacatcgtgttgtcgcgccagctcgccaatcgcggccgatatccggcggtcgacgtcttggcgtcgctgtcgcggttggagtcgtccatcctccccgacgatcgacgaaggctcatgcaggcggctcgccgacatctcgccgtcctcgacgaggtgcgcgatctggtggatctcggtgcctaccaagcgggaacgagcatggaggtcgacgaagcgctcgaggtggtgccgcggatcgagaccgtcttcggccaggacatctcggagcgctccgatccgaacgacgcctggtcgcgcctggccggtgcactgggggtgaacgcatgagcgaggagcgtcggatcagagcactcggtctcttgcgtaggatcgagcgactggagcgctggaaggccgtcggggcggtcgccgcagcacagcgcgcgtggggatcggcaagggccgaccgcatcgcccatgtcgccgccatcgatcaggacctgcccctcacgctccatgcctggcatctccaggccgccgtctgggcgggcgagcaggccgtagacgccgctgcccgacgtgcgacgtcggagcgttggctgcgcgccagtgagcttcgagagcggagtctcgctcgactcgaggccgaggcgcttcggcggcgccggagccacctcgaacgtgcgcgcctcgccgatctgctcgatcgtgtggtgtcgacgccgaggggagacggaccatgaccatggcgatccagagtgcggctccgcccgccgtggccgccatcgagcagctcgccagcaccctgtcagcggccgcgagcgcgcagggcgtcgcctcgttcgagtcgacgctcgccgcagcgctccaagccgagggccaggtgatctcggggaccgggaagagccagagcccaggatcggtgacgggggtggcccagcagccgagcgcgagcgtcgtgccgacgtcgaacgcaccggtcgacccgttcgctggtctcaccccggtgcccccgacgccaacggcccagaccctcgtctcgacggggggctcggcctccgagcgtgcgacggcgctcgcggccgcgaccggtgagatcggcgtaccgtacgtgtggggcggatcgtcgccggcgacggggttcgactgctcgggcctcgtccagtgggcgtacgctcaggcaggagtcgagctccctcgtacggctgccgagcagcagaccgtggggacgctcgttccctcgctcgccgcggcccagcctggagacttggtcttctatgggaacccggcctatcacgtcgcgatctatgccgggaacggcatggtggtgcaggcaccgatgaccggtgagaacgtcgagctcgccccggtcggtacgccgacggagattcgtgacccgacggccgtcgcaccgcagccgacggtgagtagtgccgtcgcgacgccgagcgacctcacggcgacgttccaggctgcgagtgcggcctatggcctgcccacagggatgctcgaggcggttgccgagaccgagtccaacttcaacccgaacgccgtgtcgtctgcaggcgcggaggggatcatgcagctcatgccccagacggcggcctcgctcggggtcaaccccttcgaccccacccaggccatctggggcgctgccaagctgctcgcgggcaagctcgcccacttcggttccgtgccgctcgcgctggctgcctacaacgcgggagacggcgcggtggaggcctacggcggtattccgccctacgcacagacgcagaactacgtccgcacggtgctctcgctgatgggaggtgaggccgatggctccggtcagagcactgccagcgcgtgagccgtcgacgggatcggcggtcgcgtcgtcgagtgcgagtccgtccgagtccgtcgcgggtgggttcgcggcgctcctcgcggccgcatcggaggtgggcatgccccaggcgaccgagaccccgacacgtgggggttcctcgggtcactcgtccgatgtcgagcacgggggggtaggaccggaggcgcgaggacgcgggcacgctgcggtgagggccgaaatcggtgcccctggcgaggcgagcaatgccagcacacgacacacgacccatcccgagggatcggaggcgaccgtgtcggcggctcgagcagccgtcgagggcgccatcctcgccgaaccggctggtgcggtgcggacgcacgcagcgtcgaacccgaagccagagcccgcgagcgcttctgcgtcactcgcgctcgttgctcaagctggcgtcgtcggggccacaggcgtcggcgccgaagccatccgggccgaagccatccgggccgaagccgtccgggtggcagcctctcccgcgcgtgcgccctcgctcgaggtcgctccggccgccgatgctcgtcgtggcgagcctgccggggcgccagcgagcgccaacacgaacgctcgacccgatggggcacctccgcacgacgctgggtcgctggtgtcgcaggacgtggtgtggccaagcgctgggccgcttgcggcggcggtcgctggtgccgagggatcgggcagcgcgcccatggccgtgtcggcgccgacgacggacgcccccgcagcgctgtccagcgccgtggccgctgccccccgagcgcacggcacgcgcgagcccgcgatcgccctcggcaccgccgacggcagagccggatcgagcatcgcctccgacttgcaagcggtcgggcgggcgccgaccgccgaagctgccggccagacgacggtcgcttcgaccggagcgagcggtgcggtctgggcggcgacgagcgtcgagctcggctccttcgtggtcgatggcgatgtgatcggaccgcccgtcgagccctcggcggtgccggcgatggtggacgggctggcacgcgctggcggtgcccaccgcgtcgtggtggtcttgtcgccgcccgagctcggtcgtctgcgcatcgtcgtgagcgaggcaccgggcgggaccgcggtgcaactgcaggtcgagaggccggccactcaggcgctcatcgagcacgcgctgggcggatatgccgatacgagtggctcggggtcccgggggggccagccgcacgcagaggacgcggcgccgccgtctcgggtcgcggtgtcggtgacgacgaaggcgacctcggttcgcgctcgtcgaggcgttcgagtcgatacgtggatctagcaggtcgacgagagaaggagtccagatgacaatggcagtgggtggtatcggagcaagcgccgccggcgctacgacgagcgcgtcgggtggactcgccagcctgaccgcgaacgagtttctcaacctcttggtcacggagctgcagaaccagaatccgctctctccgatggacccgtcgcagatggtctcacagacctcgtcgctgtcggaggtggagctcctctcgaccatccagagtgcgctcacccagatggcctcgagccaggggatcctcagcgcgagcagtctgatcggccagagcgtcacctatcaggacggctccggcgaggttgccggccaggtctccggcgtcgggcagagcgccaacggcgtcgtcctcgatgtcggtggccagagcgtgccgatcgcgaacgtcatcgccgtcggcatggtgccctcgggcgcctcggcgacgggatcgacgcagaccgggtcgacgacgtcgacgaccgggtcggtcggctgagccgccggacagcgtcgctcagtgggcgccacgaccaccatcgacacggaacacgatcaggacaccacacgatcaggacaccacacgatcaggacaccacacgatcaggacacaaggaggatcatcccatgaccaagtcgctctcgtctgcgatctccgggatcgaggcgaaccaggaatggctcgacaacatcgcgaataacatcgccaacgccaatacgaccggctatcagtcgacccagacggagttcgcagacctgctctatcagcagcagtcggcagccggcggaccggtgccgggccagaccggagggacgaatccactggtggtcggctccggtgtccgggtgtcggcgacgccaaccgacttctctcagggcacgatcgtgcaaaccggtacctccaccgacgtcgccatccagggccaaggcttcctcgtcgtcaaccagggtggccagaactactacacccgtgacggggcgctccagctcgacggcgctggtcagctcgtcacggcctcgggtgcgctcgtgatgggatgggtccccaacgcggccggtcaggtgaaccagaacgctccgctcgccgcgctcacgattccgcagggccaagttgcccagccggtcgccacgagcaccatcacgctcggtgggaacctcccggcaggttcgtccaacccggtcgtcgtgacgacgaccggctacgacgacctcggtaacccggtgccgattcagctcacctttacgccgtcgacgaccgccaaccagtggacactcacggccgagacgacgccgccgggcgcgacctcgcccgtggcgctgactgtcggcggcgcctcctcgcagacggtgaccttcgaccccgcgaccggacagatcagcgccatctccgggacctcgaccgcgaaccctgatcaactggcgctcggtgggttccccacgtcgtacgatctgccggctggctacgccatgaacctcgacttcccgacccctggcacggcacaagccgtgacccagttcgccgccagctctccaacggcccaggtgacgaaccagaacgggtacccatcgggagccctcgcaggcttcaccatcggctccgatggcgtgatcgagggcacctatgccaacggtcgcacccaggtgctcggccagatcgcactggcgcagttcgcgaacgcgcaggggctctccaagcagggcaacctcctgtacgcagcgacgaccaactccggtgcgccccagctcggatccccgggtgccgcgggtctgggccagctcgtcggaggtgcgctcgagtcgtcgaacgtctccatcggctccgaactgaccaacttggtcgtcgcacagaccgattaccaggccaatacgaaggtcgtccagacgacggccacggtgctccagagcttggtgcagatggcctagcggcgtcgggtcgcgcctgctgggtgcggcccggtcgccaaaggttcaggccggcaccaacggtgccgataccaacggtgcgcaaggaggtgctccgtgatcgaggtcacgcggtggtcaggatcgaccttggtactcaacgccgatgcgatcgagcgggtggaggcgacgccggacaccgtgatcacgctgttcggtggctcgacgtacgtcgtccgcgagacggtcgacgaggtcgtcgcggccgtggtggcctacaagtccgccgtgttcgcacccatcgcacccaccggcctcgtcgtgctcgacggcggggaggggtaggccatggacgtcgccacgccggtcgggatcgtcgtagccctcgtcgcgatcctcgtgtccatgatcatggatggaggcaatccggccgccctcatcgccccgtcggcgatgatcctcgtgctcgtgggcactgtcggcgtgtccctcgcgggccgtcgtctcaaggagatcggccagatcgtgggagcgctgcgctcggccatcctcgccaaggcgccgagcgcggaggagagcgttgggcaactcgtgcacttcgctgagatggcgcgccgagagggcgtgctcgctctcgaggccgccgcgaaggacctcacggaccccttcatgcgctcgggtatgcagctgatcatcgacggtgtcgagggcgacaagattcgagagatcctcgaggcagatctcgagggtatggggacgaggcatcgcgccggtgcgaagttcttcaaggacatggcgggattcgctccgaccctggggattctcgggacggtcatggggctcatccacgtgctcgccaacctctcgtcaccgcagacgctcggtccggcgatctcgggcgcgttcaccgcaaccctatggggcgtcatgacggcgaacgtgttctggctgccgatctcgaacaagcttgcgcatctgtcggagcaggagaacgcgctgcgtctgttggtcatcgacgggatccttgccatccaggctggtgcgtcaccgcgcctgctcgagcagcagctcctcagcttcctcgccccgacggcacgtgaggcgcaccgtacggccaaggagcgagccaagccgcagaagaaggcggcctagcgtggccagacgacatcacggcgagggcgaggccgagaactccgagcgatggctgctcacctactccgacatgatcacgctgctgctggcgctcttcgtggtgctgttcgccatgagctcgatctcggtgcgcaagttcgacgagttcaagaccgggttgttgcagaccttctcgcagatgcagctgcagagcttggagcacgggggacgcgggctgctccagcactcgtcactggtgacgcacccaggtctcacgccgggtcctccgcagatcaccatcccgcaaccaggcgcgggaactccgagcgagtcgcagatcgcccaagaggtgaaccaggcactcgcggcccaaggcctctcgcaagatgcccaggtcgtcgtggagcaacggggggtggtggtgcggatcttgtcggacaaggtgttcttcgcgacggactcagccgcactcggccccgtgggagacgccgtggtcgacgccatcgctggcgtcctgcgcacgctgccgaacgacgtgtccatcgagggctacaccgactccgagccgatcgtcggcggcccctacagttccaacttcgaactctcggcggtccgggcggtgacggtcctcgagcgactgtggaaggtcgacggcatcaaccccgaccgtctcagcgccacgggtttcggcgacacccatccgctggtgccgaacacgaccccccagaacatggccatgaaccgtcgcgtggacatcgtgatcttgagttcgaccacccaagccggcaaccgcatctagcgcgacccgacgagaaccaccggggtcacgaggaccccacgagacccaccaaggagggatatggcgacgacgaaggccaaggctgcccaggcagccgaggaggcgcaagcgcccaagaagggcaagaagcgcctcgtgctcatcgtgctcctcgtgctcatcgtgctggggggtggaggcggtgcctacgagttcctcctcgcgccccatcctgccaccaagcggcaccacggaccaccgctgccggggccgacctacacgttcccccagctcacgaccaacctcgacgacggccacatcgtgcagctccagatggtcctccagctcgcgagcggtgacacaaccgcggaggtcgcccacgacctcgacgagctcaacaatgcggccatcttgacgttcggccagatgagctacgggcaactgctgccgacggcgggccgggtggcggcggcgagcgccctcgaaggcgcgttcaaccacgtcctcgcgagtggcgcaccgccacacgacgaggtcgtcgggatcgagttcacctccttcatcgtgcagtaggcgccgcggcgccctggcaccaccgagcgcgaccgttggtcgacgctcaagttcgcgcgcctccgtccgatgccactgtcatgagtggggagaacgaggcgcgtgagcgccaggtgcgtactgtcgactttcgcctcccccacagcttcgaccgtgccgagcaacgaggactcgagctcctcgtcgagaacgcgctccgaccggctgcaaccttgatgggtgcgagcctgcgccgcggcgtgcggctcgagctcggtcggatggaccaacttccctgggagcaggtcgtcgcccaacaggacggcccagccctggtcatctcgttcgcgctggttccattgggatcgcgtggcgttctgcgcttcggagccgatgcggcccttcgcctgctcgatctgcggctcggcggtgacgggtcgccgatcgagccccgtgcgctcaccgaactcgagcagggactgctcgtccaggtcttctccgatctgctcgtccaactcgcctcgagtctgcagacgctgctcgacgtccgcttggatcgggtgggggcagagacgtccctcgagttcgtccaagtcatcagcccgggcgagatgtgcctggtcgtgccgatcgcgctgggcatcggtgacgaactcgagagcgagctcacgctctatctgccctattccatgctgcggcccgtcgtggagctcatcgcccagcgcgccatcgtggccgtcgatcgtggcggcgatacgttccgggatctgctcgccgctcgtctgcacgacgtccgcctcgaggtcagcgtccggttcgagccgacgtcgatcagttcgcgcacgctgctcgagcttgctcccggtgacgtcgtccccctcggccatcgccaaggacaaccggcctgggtcatcgtcgatcgcacgcggcttcatcgggccgtcatgggtcagtcgggctcgcgcgtcgccgccgtcatcatcgaggaggaggaagaggctcatgcctgaggtgcccgagacggccgcgaacctcgcggtccttcgcaacgtcgaactggagctcagcgtcgaactcggcagggcgcggatgcccgtgcgcgcgctgctcgcactcacgagtggcgacgtcatcgaactcgaccgtcacgccaacgccccggtcgacgtcctggtcaacggcaccctggtggccaagggcgaggtcgtggtggtcgacgacgagttcggggttcgcatcctcgaaatcatctcctccgacgaggtggaccagctgacccggggagcgtagcgaagatgggatcgatcgtcgaggccatcggcgcgctcgcgttggtggtcggcttgatcgtcgcatctggtcgcctcgcccagcgcggtcgtccggcgcgttcggtcggcatggctcgcctcgccgtcgtggctcgggcttcacttggatcgaagacctcgatcgtcatcgtcgaggccgacggacggcgattcctgctcggggtcgggccgcagggggcgagccgactggcgagcctcggtgcggcaccgccggccgatgcccccgagatcgagctcctcgacctgcgagatgtcgacgtggccttcccccctccaggttgacacctgctataggaggaagggatgagccagacaccgaacccaccaccgggcgacggccccgctggacgacgacgcggccgctacccgagccagttccgcaaggacgcggcagcgttggttctcgaccagcgccgcaccatcgctgacgtcgcccgtgagcttggcatcaacgagcagacccttggtaactgggtccgtcaggaacgcatcgaccgaggtgagcgagagggcctgacgagcgccgagcgcgaggagctgacacggctgcgccgccaggtcaagcagctcaccgtggaacgcgagctgctcaagcgagcgatggccttctgggtgaaggaggggggacagtgagccgctaccactggatctcccgccaggaggccaagggcttctctgtagcggcagcagcacgagtcatcggggtctctcgccaggcctactacgcctggcgacaccgtcgggaccgaggcgaggatcccgagcacctggtgctcgcgagcgagcttcgcgccatctggcacgagagcgacggcacctacggcagcccccgcatcacccacgagctgcgacggcgcgggttctgcgtgaaccacaagcgggtggaacgcctgatgcgcgagctcgagatggcagcgggcccacgccggcgcttcgtagtcacgacgaggcggggagaggacgcagcgctcccggacctcgtccgtcaggacttcgctcctggtgagccgaagcgcaggtatgtgagcgacatcacctacgtccgcaccgatgaggggttctgctatctcgccacggtggcagatcttggctcgaggcgcatcgtgggctggtcacttgggcgtcacatgcccgatgacctggtggtcgaggcgatccgcgaagcactcgggactcggggcagcctggctggggcgatctttcacagcgatcgcggcagccagtacctctcccggaaggtacggagcctgctcgcgacccttggcattcgccagtcggtggggagggtcgcgacctgctacgacaacgccgtggccgagtccttcttcgggagcttgaagcgcgagctggtggctcgctaccgcttcgcgaacctctcaggggctcgctctgccatcgctagctggattcaccgttacaacacggtccgcctgcactcaagcctcgggtacctaccgcccgtcgagtacgagctctcctgggcctgccgggaggtggccgtggcctaaattcagactgtcaagcaaatggggggaagcccaacgatccagaggccgccgtggtcgctgccttcgacgagccgccggtgcacgccggcggtgcgctcacggccctgctcgcggcgcttcgcacccgaggggttcgcccgtgagcggtctgctcctcgcggcgacgagcctgccgtcggccacgttgacggtgcatgcgggttcgacgccgaccgcgagcgtggtgatcatcctcgccctcaccgtgctctcgctcgccccgacactcctcgtgctcttcactggcttcgtggagatcgtcgtcgtgctctcgatcactcgtaatgccctcggtctctcgacgacgccgcccaatcaggtcctcgccggtctcgcgctcttcctctcgctcttcgtgatggcccccaccctcgggatcgtggagcaccaagccgtcctaccgtatctgcacggtcacatctctgccgttgtggcgttggatcgcgcggaagggccgatcaagctctggatgctgcgtcacacgcgaacgcaagaactcgcactgttcgatgtagtcacccaccacgccggggtcgcacctgccgcagcgccactcgatgccgtcgtgccggcgttcatcctgtccgagctccacagcgccttcgtgatgggcttcatcatctacgtgccgttcctcgtgatcgacctcgtggtctcgagcgtgctcatgagcctcggcatgatgatgctgccgccgacgctggtgtccttgcccttcaagctgctgctcttcgtgctcgtggacggttggacgctcgtcgcgcacgccctgctcgtctcgctccactgacaagggggttcaccagatgaacgatgctgctgtgctccagatcgcgcggacggccctcgaggtcgccacgctcgttgccggaccggtgctcgccgttgcgctccttgtcgggctcgtcgtcgcgctggcacagaccctgacccagatccaggaggcgaccctcagcttcgtgcccaagctcgctgccatcgccttggtcctgctcttcacggggcactggatgctccaggaactcacgacgatgacgacccagctctacagccagatcccccatctcgtgcagacgctctaaggacgagccgtgcagatcagcctccagctgggctccgtactcgcgttcttgatcgcgaccgcgcacgcgctcggcttcgtcgtcatcgccgcgccgttcgcgctcgcgacggtgccgcgcacggctcaactcgcgctcgcggtggggatgggcatggctggcgcagcgatccacaccgccttgccggcgacgacgccagcgctcatcggccagctcgcctgggcagcagcgaccggtgcattgatcggattcgtggcgctcgctgcgatcagcatcggatcgcaggcggggagcttcatcggcttgctgggtggcttcgtcacgcctccctcgctcacgccgctcgcgttcggcgaggtcccggtcaccggcgacctctacggcatgatctgggcggtgctgttcttcgtctccggcgccgacgtcgtcgtgctccgcgggttctatctcgcgagcgacgcgagcgtccatctggccaacacggccaccgtcatcgtgcagtcggtgacgctcacctttgcggccggcctggaggtggccgcaccggtcatcgcggtcatgttcttcgcccagatcgtggcggcggtcctcacgaaggtcgcgccgcagctccagccgctcggcttcttgttcccgctcgagattctgttgtcgctcatcatgatggtcgtctcgctgcccgtcatcccgcacctcttcgacgctggggtgcgtctcctgctcgctgccgagcgtgatctcggggcctgaagatggcgcgccaggagggcaccgaagagccaaccccgcgaaagctcgagcgggcgcgcaaggaggggatggtcgcgcgctcggtcgacctcgtctcgttcgtcgtgctcctcatcgcgtcgttcgccctcccgctcgccgtgcgcgatgcgagcgtgcgcatcggcgacgtcgcggccgcagcgtggtcgggcgcgatccccgccacgagcgccggggcgttgcgctttctcggcaccggtctcgatctcgtggtccaactggtcgggccggtcgccgtcgttgcggtggtcatcgtcgcggtcgggaaccttgcccaggtcgggctgcgcttcgtcccgaagcgactccgaccacgcgccgagaccttctcgcccgcggccaacctgcgtcggatcttctcggcccaacccgggatcgaggtcgccaaggcgatcgtcaagctcgtcgcgacggcggccgtcgcggctgccatcgtctccagcagcatcgacgccatggctcagggtgcatcctcaccgcttgcggcggcggatgccgccgctggtgcctctctcgagctggtccgtgtcgtcgcggtcctcggggtcgtcctcggcatcgtcgacctcgtgcgccagcgtcggtcgctgcggcgcaggctgcggatgacccgccacgaggtacgtgacgagttgcgcgagcacgaaggagatctcgccgtcaaggcacgccgccggcgcttggcgcgtgagttcgttcgacgggccatgctcgccgacgtcgcccaagccgacgtggttgtggtcaatccgacgcacgtggccgtcgcgctgcgttacgaccctcgccgtgatcgtgctccgaccgtcgtcgctaagggcctcgatcacttggcgatgaccatacgcgagcgtgcgcgtgccgctcgggtgccgatcgtcgaggaccccccgctcgcgcgcgtcgtctacgtcgcctctcgtgtcggagagccgatccctgcatcgctgttcctcgtcgtcgcgaggctcctcgcgttcgtctatcgactgccgtcgctggcgcgctcgttcgactcacgccacgtgacccgttccgacgacattccggtcgatctcgccgctcgggcctggagtctgctcgccgacgagatcgatactcaaggcgacgtgcacgcgggccgagaacgctagcgaggcgcacggaggcgccgtggaagccacggtgggcagcgacgaaggggaggcccgtggactcgacgaggctccggcgcatggcgctcgccgtgccggtcggcatcgcggtcatcgtgatcatgctggtcgtgccgatgccgtcgcagctcctcgacgtcttgatcacggccaacttgaccttcgcgttgatcgtgctgggactgacgctgcgcgtgcgagatcccctcgacttttcggcgttcccctcggtcctgctggtggccaccatgttccggctcgcgctgaacgtgtccgcgacccgtctggtcctgctgcacgcctatgcgggcagcgtgatcgaggccttcggccacttcgtcgtcggcgggtcggtcgtcgtcggactcgtggtcttcgccatcttgttcatcatccagttcgtggtcatcacgaacggtgccggtcgcgtcgcggaggtgggggcgcgcttcacgttggacgctatgccgggcaagcagatggcgatcgacgcggatctgaacgccggtcacatctcggaagccgaggcacgtgcacgtcgggcgcgcatcgctcgcgaggcggacttctacggggcgatggacggcgcctcgaagttcgtcaagggtgatgccgtcgcggccgccgtcatcaccttgatcaacctcattggcggcttcatcgtgggcatcgtggagcaccatctctcggtctcgcagtcgatcgacacgtactcgctcctgtcggtcggtgacggcctggtcagccagatcccggcactcttgctctcgatctcgacgggcctcatggtgactcggagcgcgaacgacgcggacttcggcctcgacctcctgcgccagatcgcccacgagcccgtggccatccaactcgctgggggggtgatcggcgcgctcggtctcttgccggggctccccatggtgccgttcgtcctggtcggtggctcggtcttcgcggtcgggtggcggcttcggtcgaggagcgcgtcgcacgtggggagcggcgacgagcccgtcgtcaccgagtcagaagccgtgccggacgcgctcgcggccgacgtcgtcggcgtcgagctcctcgagctccagctcggcttcgagctcctcgacgtcctcgatccggctcgaggcggggacctgctgacgcgggtgaagggcctgcggcgcaagctcgccggggagttgggcttcctcctgccaccggtgcgtacccacgactccttggacgtcggtccggacgagtatcggatcctcatccaagatcaggtcgtcggtacgggtcggattcccagagggcgtgtcctcgccatgggccagggcctcgagtccttaccgggggaggccgccgtcgatccggtgttcggtcttgcagcgtgctggatccccccggaggccaagacgcaagcccaggtgctcggcgcgacggtcgtcgaccgatcgtcggtgatcgtgacgcacctcgccgaggtggtccggcgccacgctgacgagcttctcacgcgccagcaggtcaaagagatgctcgatgcgctccgccaggcagcgccggtggtggtcgacgagctggtgtcgtcgcagctcccactcggtgagctccagcgagtccttcgcgacctgctcgccgagcgggtgccggtgcgcaacctcgccgccatcgtggaggcggtcgtcgatcgcgcgcgtcagacacacgagcccgacgcgctgctcgaggctgcacgcgaggcgctcggcggtgccatcgggacgcgctttgcgaccggcggcaagctgccggtcgcctacctcgtgcccgagctcgagcttcgcctcgtggaatcgctcgtgagcgtcgacggacgccggagtctcggcatcgcccacgaggagctccgagcactgcgtgccgaggtcgccgaggccaagcagcgcgccgaggcacaggggctcgacctcgtgctcgtcacgatgggagcgatccgtcggccgctgtgggcggtccttgcccgtacgccggcggagctccccgtgctcgcgctcggtgagatcggttcgtcggttgatgtcgttcagatgggggtgatcggtggtgtccagcaaccagcggcgctttagtggtcagacagcggcagaagcggtcgcggctgcgcgcgcggccctcggcccagacgcgaggatcgtggcggccgagcgggtttccaagcccggcctactcgggcgcaagcgccacgtggtcgtcacggccgaaccgatgccggtgacgagcgcccgggactttgccaaggagctgtcacgtcagctcgcggctcgggaagcggaggcgcccgccgaggacctcgagatcctggcgacggcgtacgagcaggccaagagcgagccgcctcaggtcgtggtcgcgcccatcgggcgacgcgaggcggtggtggtcggttcgggcggtgagacgcgtccgctcggctcggtcgagcgcccgcagtggtcgcagctcggtgacgtagcgagcgcagccgtgcgtgccgtcatcgacgaacgcacgactcacctgaccgtcgacctgagcgctgacggtggcgacgtggtggtcgacgtgagcgcaccggtggccgagcgcaccatcgcccccgagggctcgcgggtgatcgcggtgtgcgccccgagcgtgccgtatccgttggcggcgttcgatgcggtcgccgatcgcgtcggggtcggcgacgccgatcggttcgtgctcgctcagcgtcggcgcgagatcccactcggactgcgcagtccagctgatcgggtggcgcgagcggtcgcgagtggacagcgacgcgtcgcggtgctcgtggatccaggtcagctcgcgctcttgcgtagctcgtttctcgccccgctcacgtgggtggtcgtcgcggtgtcgggagacgagcctgcctgcgacctcgaggtggaactcgcggcttgtgggccgatcgacgcgctccactgcgtgcgctcggagcgtgccgccgtcgagctgggccttgcggtggtggcgtagccatgcgtcttccgtggcgggtctggctctcggtcatctcggctgcgctcgttgcgacacccagcgtcatccaagccgaccacggctacacgagctgggccaacgtcctcgagcacttcctggtcgccttggtcgtgctctggatcgcctactccgtgctggcaacggtgatcgcatggtacgaactcgaggggatggtgcgacgtcggcaggcgcgccaggccgcgatggagcaggcgcagcaggcggcaccacggactcctcagtcctgatcgacgaggaggatccgaacgacgtacgacccgtgctcgtggcacgggtcgtacgtcgtttcggcgatggcgtcgagcgcgattcaggcgacgttctcccggctgccgttcagcgttggcttgcccgcgcggatccaggcgttggtgccaccgcggacactgacggcgcgcagaccgctgccggcgaggagttgggcggcggcgtagctgcgcgatccgctcgcgcagatcacgtggacgtccttgtcgcggggcagttcatggatgcggcggggcaggtggctgagcgggatgttcttcgcccccgggacgtgacccgactcatattcccaaggatcgcgcacgtcgacgacgaaggcaccatcctggtgggccgcggcgaagtgatggatgtcgatctcgcggatcatcggtcctcccgtagtatcacgacaattatgtgatgcttcaggttgtcaaccctgatgatgacagtatataccccatggggtactgaggcgaccagtccggcccacgtcatgtgtgcgatcgatcgacgcccacgacgcaaccagccgggaccacggtcccggctggttggaggtacgcgttgtggggtgaggtctggtgctacggcagctgcgcgagggcgcgctcctccttgaagaggaagtagcgctcgaggaaccgcttcgtgatgtcgtagaaggggttcgggagcatgaactcgacctgccgcggcttgaagaacttgttggcgtacatgatcacttctttgtgccccgcgtccagtacgcacacgcccgggatgtcgcggaagggtcgctgctcgaggtccgtccgtccggtcgccaagcggccgacgttcttgccgacgagcttgccctcgatgtcggccgggaagcccgtcttcgggatgccgagcggcacctgactggtgaagggcttctccacgtcgatcgccacgcccgcagaaaagatgttcgggtagtcggggtgctggaatgcgccgttgaccgggatgaaacccgctgcgttcccgatgcccgcacccgagttcaagatcacgtcctgtccgctgaaggccggcatgatcatggtgaacttcgaggggagctgggtcccgtcggcgagggtgacgccctcgtcgctcacggatgcgatcgccgtgttctcgtagagccggatgccctggcgatggagcaggcccttcaggagccgctcgccgcctcggatgccatccatgccgaaatgacccgcgtagggttcaggtgtgacccaggtcacgtcgacgcggtcgcgaacgccgtggacgcgcaggtagtagtccaagttgaagaggaactcgtaggcggctccgatgcagctggcaccaggagcggcaccgacgacgaccgggcccggatcggcgacgagccgatcgaagtcttcacgcgtctgcatgatgagctcggggtcgtggacggcgtggttgaagccgagcttcgggtcggacccttcgagcttcgagtagtcgaacttcgggcccgtcgcgatcacgaggtagtcgtagggctcctcgccacgagtggtgctcaccacctggcgctcggggtcgatgtgggtcgcctcggcctggctgaaggcgacgtcgcgcttggcgaggatcttgggaaccggccgggtgatctgcgacacctcacgctcacggaagggaacccagatcatcgaggggacgtacaagaagtagtcggtcttcgagaccaccttgacctcgacgtcgcggccgcgggtatgtcgcttggcctcgagggccgacgtcagaccggcgaagttgccaccgagaacgagtactcgctccactgcgaacctcctttgcgcactgagtcagtatgggcgcgctggagcgcccccgaccagggaagaggtgcccgtccttgagggaccttcgtcccgaacggacgtcgaggtgccggtaggatgggggtgtggcgagcgtctatgagctggatcgtgcggcggtgcgtgcgctcgttccctggccggactggcgtatcgagcagctgtttcacgggctctaccacgaggggcagcgactcgaggcgatctcgacgctgccggctcggatgcgagccgagctcgcgagccacctcgatccgggcctcactgagcgtcggcgtgagcacgccgacgacggtgagacggtcaagttcgcgctggaggctgccgacggggcgctcgtcgagacggtcgtcatgcagtcggcgcgtcgcatcagcgtgtgcgtctcgagtcaggccggttgcgcgatgggctgtcgtttctgcgccacagggcaggccgggttcgtgcggcacctcggggtcggggagatcgtcgagcagctcgcgatcgcgcagcgttcggtacgcccgcgacgtctcacgcacgtggtcttcatggggatgggcgagccgctcgcgaacgcctcggtggcgatcgaggccattcgacgcatccgcgctgacttcggcatcagccctcggcgcgtcacggtgtccacggtcgggatcgtgccggggatccgacgccttgcgcacgcagatctcggcgtcacgctcgccgtgtcgctgcatgcggccaacgacgccgcacgaagcgacctcgtgcccatgaaccggcgctacggcatcgacgccgtgctcgatgccgcgcaggagttctccgagctcaccgggcggcgcgtcacgctcgagtgggcgctcatcgccggcgtgaacgatcgcgaccgtgacgccactgagctcgccgggcacgcacgtcggctcgccgctcacgtcaacctcatcccgctgaaccccacaccgggctacccgatggtgggcaccgatcccgacggcgtcgcgcgctttgcgcgccggcttcgctcgctcggtgtcaacgtgacggttcgcgacacgcgggggcgatccatcgatgcagcctgcggacagctcgccgccgacgtcgctcgcggcggcccggccggcgccagcgcggtgcgcttcgcacggcgcatggtctcggcctgagatcccccgaccgatcacccctggcgggggaggctccaagcgtcggagaggctaggttcctaggtgcctcgataggcctcgcttcgaaggagcgcgcatgacgaagcttgagatcgcgccctccatcctccctgctgacttcggccagctcggcccgacgctccaggacctccaggctgctggcgtcgaccgtgtgcactgggatgtgatggacggcgtcttcgtgcccaatctcaccgttggcgccccggtgatcgagagttgccgccgctggagcgacctcccgttcgaggcgcacctgatgatcgtcgaccccgaccgccacgtcgagtcgttcgtgcgggccgggtgcgagctcgtcatcattcacgccgaggcgacggcccacttgcatcggagccttgggctgatccgcagccttggtgctcgcgctggcgtggccctgaacccgtcgaccccgccgtcggcgatcgagtacgtcatggatctgctcgatgtcatcctcgtcatgacggtcaatcccggtttcgggggccagcgctacctggcgagcgtcgagccgaagatcgcatcgctcgccgcactgcgtgacctcacgaacccgaccaccaggatcgaggtggacggcggcgttgcccctgacacgctggcgggggtcgtcgagaacgggggcgagatcgtcgtgtcgggctctgcgctcttcgcacatccaggcgggctccgagctggcgtcgaggcgtttcatgcgatcgcagaggaggcaaggaagtgaccacgactgtcgagcagcgagccatcaccacggtccggatgctctcgatcgaccaggtcgaggcggcgaactcgggccatcctggccttcccctcggactctcgccggtcgccgtcacgatctttgcgcgcttgatgcggttcgatccgacagatccggcctggcccaaccgcgaccggttcgtcctgtccgctggtcacggctcggcgatgctgtactcactgctccacctgttcggtttcgacctaccgatggatgagctgcgccgtttccggcagctcaactcgcgcacgcccggacaccccgagtacggccacaccgcaggggtcgaggtcacgaccgggccgctcgggcagggcttcgcgaccgcggtcgggctcgcgctcgcagaacagctgcagcgtcacgagacggagcagcgcttcggtgaggcgctcatcgaccatcacaccttcgtgctcgcgtccgacggcgacctcatggaggggatcagccacgaggcggcgtcactcgcgggccatctcgggctgggtcggctcatcgtggggtacgactcgaacgacatcaccatcgacgggcccgcgcacatctcgtgcactgacgatgtgcgcgagcgcttccgtggctacgggtggcaggtcctctcggtcgaggacaccgaagacccggacgccatcgaggcggtctatcgggtcgcgatggccgacgagtcccgcccgagcctcatcatccttcccacgctgatcgggcgcggggccccaaccaagcagggaacgtcgaaggtgcacggtgccgccctcggacccgacgagtatcgggcgaccaaggagttctatggctggcccgtcgacgaggcgttcgtcgtccccgatgacgtgcgcgcatgggccgacgaggtggtcgccgccaagcgtgaggtggctaccaagtggcgcgaacgggctcgtgaggtgggctacgaggcgccctccatccacctcgacccgcaggtcctcgaggcgctcgagttcccggaggtcgatcctgcgaaggccgtcgcgtcccgcgtggcgagccagcacgtgctcgagcgggccatggtggcgatcccgacgctggtcggaggatcggcggatctcgccgagtccaccgggaccaagcttgcgttgcccgtcatcgatcgcgagcatccgctcggacgcatcgtccacttcggcatccgtgagcacgccatggccgcatgtgccaacggccttgcgctctcgggcttgcgcccatgggtcgcgacgttcctcgtgttctccgactatctgcggccaagttttcgtctgtcggcgatcatgggtctcccggtcatctatctgttcacgcacgactccatcggcgtgggcgaggatggaccgacgcaccagccgatcgagcaggtcgaggcgctgaggatcatcccgaacagcgcggtggtacgaccagccgacgccttcgaaaccaacgaggcgtgggcagcggcgctcgcccacacgagcggtcccattgcgttgatcttgactcgccagggtcttgcgcccatgccgaccgcggacgagcctgggtggctcgagcgccgtggtgctcggatcgtgtacggcgccgacgtcgaccgacctgatgtggttctcgtcgcctcggggtcggaggtcaacctgtgcgtcgaggccgcgcacgcgctcctcgaggaggaggggatcgtggcgcgggtcgtctccgtgccgtggcgcgagcgcttcctcgccatcgacgagcaggagcgagaggagctcgcgccgtcggggattccacgcctgatcgtcgaggcgagcgtcgcgaccggatgggaggccttcctccagccgggggaccgcctctacaacatcactcgcttcgggctgtcggctccgatcaaggacgtgcagcgagcgctcggctttaccgcctccgacgtcgccgacgccgccgcagagctcgtcgtggacggttcgttcttgcgtcgtccggtccacctcgtctccgagctcctcgctgcgacggaggccgctgcggttgcgacccaggacctcgtcggcgatggcgatcgctcggcagcagaccaagccgcggtctcggccatgcgtcgagcgctcggtgcgctccctgcgcgggccaccgtgatcgtgggtgagggggagaaggaccgagcccccatgctctacgtgggcgagcgacttggctctggttcggtcgcggtcgatctcgcggtcgacccgttggaggggacgacgtacgcggcgaccggccgggagggtgccgtctcggtgctcgctgcggcgcccaatcgcggcctgcaccccttgccaggctggtacatggagaagctcgtggtaccggccgaggccgcgggagtcgtcgacatcgaggcaccgctcgtcgagaacgttcgacgcgtggcgcaccgtctcggacttgccatctcggagaccccggtggtcgtcctcgccaagccacgccacgaggcggccatccgagagctgcgggccgcgcgggttccggtcgtcgagatcccagacggggatgtgatggcgagcctgcgcgtgctcaccggcgatccccgtatgcgcatgctgtggggtatcggtggcacgccagagggcgtcatcaccgccgcagccgccttggcgctggccggccagatgcaggcccgcctccgcccgcagagcgacgaggagcgatcgatcctcgacgcatggaagcccgattgggaggagcttcgcttcgaggcgagcgacctcgctcatcctgaatcggtcgtcgtcgcctcgtccgtaaccggggcgaccccgcttgtgccaccgatgccgcatgcggatggtttcgtgatcgaaagcctctggatcgagccgggacagttcggcacggtccggcgggtcgtgagcctccggggggaggaggacgcatgatcgatgttgtgcgaaaggaaccgtcaatgtcccatcgagtggccgccatccagaaggcgacggcgcgaggagcgcatccgacgcgcgtgacgatgctcgcgatcgccggagactccgcttctggcaagacgaccctgacgaagggcatcacccaggcgctcggcgccgagcgtatcgcgtcgttctgcaccgatgattatcaccgctacgaccgggaggagcggcgtggactcccgttcacgccgctgcatcccgagtgcaactacctcgacattctcgagcagcatctccagctcttgaccctcggacaatcggtgttgaagccggtgtaccaccattcgacgggcacgctgggtcggccggtgctcttcgagcccaaggagatcgtcatcgtcgagggtctgttcccactgtggtcgaagctgtcgcgggccacgttcgacgtcaccgtcttcttggacccaccagaggaggtccggcgtcgctggaagatccagcgcgacacgggcaagcgtggctacagcgaggaccaagtgctcgccgagctcgagcgtcgcgagcccgagtcggacgcttatatccgtccgcagcgtcgcaacgcagacatcgtgatttcgttcgctccggttgcgggccggaccggcggagacgagacgatgagcgcgaccatcttgctgcgtccgacgatcccgcaccccgacctgtcgtcggtgctcacgggcgacacgcgtgagtcggtccacctgaagctgattcgtgaccaagacggcaagccggtggatgccctccacgtccacggccatgctccgaccgaggtgacccaggtcgtcgaggaggtgctctgggaccacatcgggctcccagggccgatccccgaaccgctcggggtcatcggaccgggcaagcgctcggcgtcactggcgatcgcgcagctgctcctcatctaccacctgatccacgcatagccgggtcgggcgtgtcctactccgaggcgtcgcgcgcctcggagtcggcagaccgccagctcaccgagctcacggcgggttcgaggctgaggcgagagatggcttgttccacggcgaggtcgtcctggccttcggcgacgaggtctgcctcgacgagcacgaggccgggctcatgacgcagctcctggctgcgcacgccgcggagccgaaacgcgccggctgaggctgcttgggtgatgagcgcccggatgtgggcttcggctggctcttgacagacgaccgagagcgtccactcgaagcgcacctcttcggcctcgcgctgcggacgtcggtcgagggtgcgggcgagcggccgtagcccgacgtgggctgcgaggaccgtgagcgcagccagcagcgccaacatgaggtagccagtgcccgtgagggcgccgatggcggccgcgcaccagatcgtggctgcggtgttgatgccgcgcacgttcacgccatcgcggatgatgacgccggcaccgaggaacccgatgcccgagacgatgtaggcggtgaccctcgtgaagtccaccgattcgtgtgccgtcgcggcgatggggctggtggcaaggagcagcgagagctgttcgaagagggcggcgccgagcgccacgagggcgttcgtgcgtagccctgccatgcgcgagcgccactggcgttcggcaccgacgatcgcaccgaacagcgcagcgaggacggagcgcacgaggaaggtccaggtcacccctgggacgaggggagcggcgaggtggcgcatgagggcctcccgaggttgcggtcgggggtagtccaccggtcgagagtgaccacgagctgaacgaaaccttgcgaggcgttgacaatgcgactgcccgtgcggaacaggtcgctgtgttgtctcgtcgatcaccgacacggcagtggtgcaccgtggtccgtgctcctgcggggcggtgctcgtgaacggttcctgcgagcgatgctgaaagcgtttgcatgtcgttcacgtaagcgctatcatctggcctacgttcgctggtatgcgaaccggggaacttggtgggggtcgtcggtcgtgcggtgtgatcagggcgctgggatcgcgcgatgagcgctgctcgcgcgacgatcttcgatgtcgcagccgaagccggcgtgtcggtcgcgagcgtctcccgggcgctgcgcgacattcctggcgtacgtccggagctacgagcgcacattcgtcagatcgccgagcgactcgggtacgtgccgagtgccccggccgcgtcgctggcgtcgcggcgcctcggtgcgatcggcttggtcttcccggacctcgatgatccgtcggtcgacccagggctcgacgaggatcaagagggtcggctctatgccgacgaggtgattcgcggagccgagcgcgctgcacgttcccacggggtcgcgctcctcgtcgccgctacccatcagcgcgaggccgccgagctcgtgcgtttcgtctctgctcgtgtcgacggcatggtgatgctctcacgggtgctcgccgacgtcgaggtccgggccttggcggagcgggttccgctcgtgcagctcgccgggcggagtcggttgcggggggcggacgtggtccgagtcgacaacgagcggggcatcgaggagatcacgcggcatctgctcgtcgatcacggctacgccgacgtccggttcgtcggaggtccggttcgctcgccggatgctcgcagtcgtcttgaggccttccagcgcacggtacggatgctcgggcgcgacgatctggccgagccgatcgcgcgcggagactttcgcgagtcaagcggctggtccatcgcgtccacgctgctcgaacgcggccccgtgccacgtgcgctggtggtggggaacgaccagatggctgtcgcgatcgtgctcgccctccggaacgcgggcctgcgcgtccccgacgacgttgcggtgaccggcttcgacgatacgcagctcgcgcgcctgacctatcccggcctgacgaccgtgcgccagccgatgcgtgacctgggaaggctcagtgtcgagctcctcatcgatcggatcgaaggtcgagccgcgccaggccgcatgatcacgctcccgaccgaggtcgtgcgacggcgtagctgtgggtgcacgtcggcgtcgtggcccggagaactcgtcgcacccagcggtgcagcggagccggtgacgagcacggtcgggacggcgatgagaggagcccagtgaaagcccacggagagcagcaggacgcgacccgggcggtactcgagcgctgggaggagggaactcgtgagcgacgtgtcgacgagcacgttggtcaccttcctcccccgacgggcgtcgaggcctggcgtggctcgggctgcgtcaccatcacatggcagcgtgtcgagggtgcggtgtgctatctcgtcgagcgggcgccgagtccggacggtccgtggacggtgcttcggcgcgccgagcacgacctcgtcgaagtcgctgggcctccaacgctggacacgagccgggaggcgggcggttggtaccgggtggcggcactcgaagatgtgggtcgtcgtccgacgtcgttctccgatccggtcgaggcgcgcgatggcgaccgcagcgcagcggtgacggtacgggtcgaggcgtcgtccccggtcggctcactcgcgcccgtgtggtggatggtgggctccgagcggccagggcagctgctccttcgcgacgacggcttcggtcatgacgttcgggccgaggtgctcgaggcctatcgccgggccgcggcgatcggcgtgacgcacgttcgggcgcactgctggctcgatgacgcctttgggatggtggacgcgtctggtcgcctgaccgagacgagcgcgctcgacgaggtgctcgatctcgtgctcgccagtggtcttcgcccgatcgtggagctgtcctttacgccatcatccctggccacggatccagcggcaaccgtgttcacctatcgggccaacgtgtcgcctcccgctgacctcgttcgctacggcgaactcgtggcgcaggtggtgcgccacatgatcgagcgctacggcgccgacgaagtccgcgagtgggcgttcgaggtgtggaacgagcccaacttggccgtcttctggaccggcgacatggctgcctacttcgcactgtacgaccgggtcgcgagggcggtgaaggaggtggatccggcgctacgtgtgggaggccccgcaaccgcgggaagcgggtggatcgcgccgttcctcgacttcgtccacgagaccgatgcgccgttggacttcctgtcgacgcacacctatggcggtatgcctctcgacctgcgtgcccagcttgcgcgcgtcggtcggggggacgtccccgtgtggtggaccgagtggggcgtgtcgccgacgcaccacgcgcgggtcaacgacggggcctttggtgcgcccttcgtggtgcgcggcatgaaggcagcacagcagatcgcagctgccctctcgtattgggtggtgagcgaccacttcgaggagctcggcaggccggaacgcctcgccgcgggaggtttcgggctgttgacggtcggcaaccttccgaagtcgcgctggcacgcgctcagtctcgtcgctgagctgccttctcgaatcgtggcgaccgaggtggagggcgacggtgctggagcactcgtggacgggtgggcgggtgccgatgcggagcgggtcgacgttctcgtgtggaacggctcgcacgatgcggccgacgccgagggtcgcggtgacctcgatcggacggtgactgtgacgctcgaagggctcgaggacggcgagtggctgctcgagctcacgcgcgtcgatcgggatcacgcttcgttcctcgaggcgatcgcgggtgaggacccatggcctgggcccgaggccacggcggccctccgggagcgcgcggcgctgcgggtcgagccggctggccgaacctccgtcgtcgacggggggcgcatcgagatgaccgtgcgcgtgccgatgcccgggttggtgcggctcagggcacgccgcgcgaggagttgggaggcctgagggtcgaccaacgcgagggccagggcccgcggcgaacggcgtaagagtttcgaccgcgggacctggcgtgggatagacaaagggggatcatagtgagtggacaggtagctcgctggaggactggtcggcgatcgcggccgatccagggattgatggtggggctcgcgggcgccgcggtgctcgcggcgtgtgggtcggcatcgacgtcgtcggcgtcctcgacgacgaaggtgtcgccgacgctcaccatcggggtcgacaacggctcgccgaccctgcaggacgatttcaatccgttctcgggcaaccagcgcatcggcacgacctacatgtacgagccgctggcctgggtcaacccgctgcaagggacgacggtcccgctgctggcggcgtccgagcacttcaccaacccgaccacactcgtcgtcacgctgcgcagtggaatgaagtggtcgaacggagcgccgatcacgccagcggacgtggtgttcacgttcgacatgctcaagcagtacccggccctcgacggtgcggggatctgggatcacgtgtcgtccgtgacctcgagcggctcgacgatcaccttcacgttcaccgcaccggatgtgccgttcgcccagtcgatcctcgagacgccgatcgtgccgaagtcggtgtggtcgtcggtgtcgaatccggtgacgttcaccaacacgaacccggtggtctcggggcccttcgtgctgaagtcgttcaatccgaacgagtacgtgctcgcgaagaatcccgacttctgggacgcatcgtccgtcgaggtcaagaccatcaacttcccagcgttgacgggcaaccagacctcccagctgacgctcgcacaggggggctacgattgggcgacgctcttcatcccggatgtccagaaggtgtgggtcgccaaggatccggcaaccaacaagtactggttcccgagcggcggtgagatcaccctcttcttgaacctcgcgaaggcgcctttctcctccgtcgcgttccgccagggcatctcggcggctctcgatcgttccacgatcgcgacgaaggcagaggacggctacgtgccggttgcaagccagacgggactcttgctgcccaacctgaagcagtggctcgatcccgcgatccccaacagcggctacgtgagctacgacccaacggcggcgctcgccgacttcgcgaaggctggctaccacctcagcggcggcaagctgaccggtccgagtggtgccgtctccatgtcgatcatcgtcccgaacggcttctctgactggatcgaggcagcccaggtgatcagccaagagctggcgaaggtgggcatctccgtgacgctccagacgccggagtacgccgcctacgcgagcgacctgtccacggggtcgtttaccggagccatcggtgccttcggcggtacgggcaacccgtacaacgacctccacggcctgctcgcggcgtcgctcgccgcaccgctcggacagacggcggcctcgaactacgagcggtgggtcaatccgacgacggagacctatctgcacgcgctggctgccgcggtcacgacgagcgcgcagcgcaacgccgtctacgggctcgagcaacagatggtgaacgatgtcccggtcgtggtgctctaccaaggggcgatctggagcgagttctcgacgaagaacttcgtcggctggccgtcggcccaggacccgtacgcgccaccgcagccctacggtcaagcgccgctggtcatcatgacgcacctcaggcttcgttagtcgtgttcccctggggccgccaccgacctcggtggcggccccctcccgaggaggtagctcgtgcgctacgtcgtgcgcaggctcgtcatcttcgtactgacgctctgggtcgccctcacgctgaactttctcatccctcgcctcatgccgggcaacccagctcaggcagcgctcgccaagttggcggctcgcggaccggtgagccctaccgagctccacgccatcgagctcaccctcgggttgccccatggctcgttgctctcgcagtacggtgggtacctcgttgccctcgcgcatggacaccttggcgtctcttacacgttcttcccggagtccgttcgctccctgatcgctcaagctctgccctggacccttggcctcgtcggtacgaccactgtgttggcgttcgtcgtcggcaccttgctcggtgtgcttgcggcctggcgccgaggcggcatcatcgacaccgtcgccaccgtcggctcgacgttcaccgcggccttcccgtacttctggaccgcgctcctcgcgctctacgtgctcggtttcgtgctgggctggttcccgatccgaggtggctacgcctccacgctcagcccgacctggagcctcggtttcatcgtcgacgcggcctaccatgcgatcctgccggccgcgacgatcctcgtctcgagtcttggcggctggttgctcggcatgcgcaacaccatgatcccgaccctcggtgaggactacgtcacgttcgccgaggccaacgggattccctcgcggacggtggcactgcgctacgccgcgcgcaacgcgatcttgccgaacgtgaccggcttcggcctcgcgctcgggttcgtcgtgtcggggtcgttgctgaccgaggtggtgttcggctatccgggcgtgggatcgttgctctacaacgccgtcgtgaacgaggattacccgctgatgcagggcctgttcctcgtcatcacggtgagcgtgttggtcgccaacctgatcgtggacctgctctacggcgtgctcgatccgcgggtgcgccgatgagcacgcccgtgacgagcgcgccggcaccggctggggcagaggctgcggctccggtgcagtcggggtcgagggcgcgagcttctctcgcgcggatcgtcggggcgctctggtcgaacgtgcgagctcggatcggcatcgtcatcctcctcgccttcgtgctcatggcgctcgccgcaccgctgatcgcgccctactccccgacggcgacgtcgtttgccgactccctgcccccgagcgctgcgcatctgctcggcaccacctcgagcggccaggacgccctctcgcagctgctctacggagcgcgtacctcggtgctcgtggccttcgccgccggcggcatctccaccgtcgtcgccatcgtggtcggactgatcgctgggttctcgcgcgggatcgtggacgagaccctgagcttcgtgatgaacgtgatgctcgtcatccccgggcttccgctcatgatcgtcatcaccgcctacctgccgggtcgaggtcccggtgtgatcatcgcggtcatcgccctcaccgggtgggcgtggggagcgcgcgtgctccgaagtcaggcgaagtcggtgagcgcccgtgacttcgtgctcgctgcacgcctggccggagattcgtcctggcgcatcgtgttccgcgagatcctccccaacatgacgtcgctcatcgcggcgagcttcttcggcgcggcgaccgccgcggtgctcgccgaggccggactcgagttcctcgggctcggcaatccgaacgccgtgagttgggggacgatgctctactgggcggagaactccaatgcgttgctgacgggccagtggggcgtcatcgtcggtccgggtctgtgcatcgcactcctggcctcctcgctgtcgctcatcaacttcggtgtcgatgcgctctcgaatccccggctgagggagcgcgcatgagcttgctcgaggttcgcgatctcgtcgtcgattaccgcatgggcacgaccgtcgtgcacgcgctccgaggcgtctcgctcgaggtcgacgagggccagttcatcggcgtcgtcggtgagtcgggctgtggcaagagcacgctcggcaccgcggtcgtcggtgtgctcggtccccctggcttcatcgtcggtgggtcgatccgcttccgcggtgtcgaactcgtgggtctcgacgccgcccagcggcgggccctgcgccatcgagggctcgcgctcgtcccacaggccggcatgaacgccctcaatccggtccgctcgattgaggggcactttcgagacgtgctcgccggtaccggtgttcgtcaccgagcagaggtccgagctcgcgccgtctccctgctcgaacaagttgcgctcgcgccgtcggtcttgcgcagctatccccacgagctgtcagggggcatgcgccaacgggttgcgctcgccctggcgctcgctctggaaccccagctcgtggtcttcgacgagccgacgacggcgctcgacgtcctcgtgcagcgctcggtggtcgataccatccgatcgctgcagcaagcgaggggcttcgccgccatcttcatcagtcacgacatcggtctcgtcgcgagccttgcttcgcgagtggacgtgatgtacgcaggtgaggtggtggaggcgggaccaaccgagcgtgtcgtggcacgaccgctgcaccgctacaccgaggcgctgctgggctgctacgccgaccctcgggcggaggaggtcacggtgcgtggcattccggggagcccgccgaacctcgttgcgcagatcgaagggtgcgcgttcgcgccccgctgtggcgtcgcgagcgacgagtgtcgttgccccctgccgacggtgacgctcgacgaccagtgggcacgctgcgtgcatccagccgtggcggtcgagggacggtcccgatgaccgaacggctcgtggtcgacggggtctcgaagtcctatcgaggggagcggcgtcacgagacgatcgaggcgctccgagacgtctcgctcgaggtcgccccgggtgggtcgctggggatcgtcggccagtcgggaagcggcaagagcacgctcgcgcgcctcatcctcggcgcggagcgcccggactcgggcagtatccgactggggaacgtgcgcgtcgaccagctcgaccggcgggggctacgagcgcactggcggcgcgtgcagctcgtgttccaagatccctacgcggccttgaatcccttgacgagcgtgcgcaccgcgctcgaacgtcccctcaccaaccaccgtcacctccgaggcgccgagcgtgagcgcgcgctcgccgagctcctcacgaccgtcgggctggtgccagtggagcagttcgccccgaagctcccacaccagctctcgggcggtcagcgtcagcgcgtcgtgatcgcgcgtgcgctcgcagcctcacccgaggtcctcgtcgcggacgagccggtgtcgatgctcgacgtctcgctccgtgccggcattctcgagctgctcgcgtcgttgcgtcgcgagcgcgggatctcgctgatctacatcacgcacgatctcttgtcggcacgggtcgtcaccgacgagctcgtcgtcctccgcgagggagcgatcgtcgaacgcggccccaccgtgtcggtgctgcgccagccgacgtcggcctatacgaaggcactgctcgatgcggtgccggtgctgccgaggagtacgcaagcgtcgacgtgagctcggccatcgtcgcgtacagtgacggaggatgactcgaacccagctccggagcctggtcgccgtcttcgaggcgggctcggtcgcgggtgcggcgcatcgactggtcgtcagcgccgctgcagtctcggcggcggtggcctcgctcgagcgggaggtcggtgtcaagctcctcgagcgggtgggtcgcggtgtgcgcctcacacctgcaggcgaggtgctcgtcgactatgcacggcgcatcgaggggctcgaagaagaggcgctggtccgcgtgcatgagctcgccgacgccgcaggcggggtcctacggatcggggcggtcgcaacggtcggggaagagctgttgccgcggtggctctcggtgttccgatcggcgcggccgaaggcgagcgtccacctcgaagtcgccaacaaggcgcgactgctcgagcggctccgtacgcatcggctcgatctcgtgatcgcgggtcgacccggacacgaggccggtctgcgcatcgtcgcgacccgtccgcacgagctgctcttgtgtgccgccgcaggctgggcgcgcgagtggttcggcccctcgctcgaggtgactccagagacggcaagcgcagtgacctggctcgtgcgcgaagagggatcgggcacacgtgcctcggcagaggaggtcctgagcgcgctcgacatccatccgccatcgctcaccatcggctccaacctcgcgatcaagcggggggtggagctcggtctcggcgtcgccgtcctgtcgagcgatctcgttgcacgagaacgtgagcagggcgagatcctctcgctcgcgctggggccgctgccgtcggtccggcgttggtgcctggtggtgggccccgaggggcccccagagccggtccgcgccttcgtcgcccagctccaggcgatgggggagctcgaaatcccccctgcgctcacctgaggggcgggtgggcgagcctccctgcccgcgtagcgtgctggcagcgcgtcgtccagtgggtcgacgatgaccagggcgcgccacgattcagtctcgagccgaggaggcgttgtggacgacattcgcacgatcgctgcggccatggtggcacgaccgaagggcattctcgctgccgacgagagcagtccgaccctgaccaagcgcttcgacgcgctctcgatcccatcgacgccggagagtcgcctcgcctggcgggagatgctcttctccacgcccgagctctccacgtggatctcgggggtcatcctctacgacgagacgttcaaccagcgaacctccgatggttcgacgatccccgagttcctcgccgcccgtggcatgatcccagggatcaaggttgataccggtgccaagccgctcgctggctcgaggggagagctcgtgacggaggggctcgatgggcttggttcgcggcttgcgacctaccacgccaagggggcgcgctttgccaagtggcgcgcggtgatctccatcggggacggtcggccgagttcgatgtgcgtcgccgccaacgctcacgcgctcgctcgctacgcgaagctgtgccaggagaacggcatcgtccccatcgtcgagccggaggtcctgatggaaggcgatcactccatcgaggtcaatgcggccgtgacccgacgcgtgctctccgaggtgttcgccgaacttcgacgcttcgacgtcgacttcgagggcatggtgctgaagccgtcgatggtcacgcctggggtgcttggcgaacccgtgagcgtcgacacggtcgcacaggcgtcggtggcggtctatcgcgacagcgtgccggcctccgtcgccgggatcgccctcctgtcgggtgggcaggcagacgacgtcgcgaccgcgcacctgcgcgcgatgaacgccggagcgacgttgccctggccgatcacgttctcctacggacgagcgctgcaggacctgcccatgcgcatctggcgtggtgatgcggccaacgcggcggcggcgcagcagtcgctcgcgacgctcgcggcggcgaacgctgccgcggccgaaggccgctaggtctgcgacgctgtcgctgtaggctccagagccgtggagcgtgaggcatcgtgtgaccccgtcgtgctcgcatcgttgctcgcgcaggtcgacacgctcgaagcggaggtcgaggccttcctcgaggtcctgcacgccgagatcgagccgacgcgtacgctgcccgatccgcggcagcgtgtgtccgagggggcgagcgagacgaggcctgagcgtgcgggtctcgcttgaactcctcggtccggtccgcgaggcgatcgggtccagcgtcatcgaggtcgcgctcgagcccgacgccacggtcgcagacgtggttgaggagctggtcgagcgtgctggcgagccactgcgtggcctgctcgaacggtgtcgctttgcgatcggcgatcgcgtggtggacctcgacgagcctctcgccgatggtgcgaccgtcgtcgtgatcccacccgtcagcggagggtcgtgatggccgtgaccatcgtgctcgtcgatgaccaccaggtgatcatcgacggggtgcgtgccatgcttgcgccctacgccgaccgggtcacgatggtcgggtcggcgaagacgcgggccgagctgttcgaggtgctcgagagcgtgcaccctgatctcatcgtgaccgatgcgaggctcaccaacgactcgggcttcgagatcctcgaggacctccagcgacgtggcgtggcggtgcccgtcgtgttctacagtgcctatgacgacgaggcctacctctttcgtgcgttgcgcgccggtgcgcgaggctacctcctcaagcaggcctcaggcgaagagctcgtagggatgctcgagcgggccgcaggtggcgagacgatgatcgatgctgcgctcgccggcagagtagccctgctcgcagcccgcttgcagttcggtgagttctggccgggagcacacctcggactcacgcagcgcgagagcgagatcctcgatctggtggtcaaggggctctcgaatcgagacatcgcgcagcgactgttcctgggagaagagaccgtcaagacgcatctgtcctcgatctatcgcaagctcaaggtcaagggacgcgccgaggcgatcgcggttgccctgcgcgaagtgcggttccgatgagtgcgcgtgagctgaccctctaccgacgtcttgccgagctcttggttgcgccactcgaggtcggcgaggtggcgagccgcaccgctgcgctcgtcgtcgaggcggtcgatgcgagcgtgtgcttcgtgcacgccgtcgatcacgagcgcgggcgcctcaccctgatcggggccaccccgcccttcgatcgagtcgtgggtcgcatccagctcggcctcggtgacgggatcgcaggatgggtcgctcaaaccggtcgtgccgccgtggtgcccgacaagtgggcggaccaccggtatcgctatatacccgagctcggtggggagcacttcacctcgctggtgtcggtgccactcgctcgcgacggaaggccgaccgtcggggtgctgaacgtgcactggcgcgaggcgatcgctgacctggagcacgaggcttccgtgatcgaggcggcgggtcgattcctcgtcggggcgctcgagcacgcgctgctcgcagaccagctcgtcaccggtgaggccgcgctcgagcgtttcgcgacggaactcatccgtgcccaggaggccgagcgccgtcgcgtccagctcgacctccacgacggcgtcgcccagtcgctgcacgccgcggcgtaccgtctcgaggggcttcgagccagcgcaccgccggcgctcgcgtcggagctcacggtggtgagggacctggttcgcgcggcgaacgccgaggtgtcacggctcgtgcgcgacccgggacgtcaggtgctcgaggacttcgggctcgccgaggcgctccagtccgtcgcacacggctatcccgacctcgaggtccaagtcgacgtcgagctcgacgatctgacgctgctgctcgagcccgagcgggggctcgccgtcatgcgcatctgccaggaggcactcaacaacgtcgcgagtcacgccgcgaccgacgctgccgaactgcgcgctcgacgcgtcggcgacgacttggtcgtgaccgtacgcgatcgtggcgtgggtttcgagcccgaggcaaccgtgcccggtcgtctcgggctcgtcgggatgcgcgagcgcgcgcgcctgctgggcggaaccatcgagatcttctctcgcctgggtgaaggaacgctggtccgtctgcgtgtgccgatcgtgccgtcggtcgcgtcgtcctaggctgagtgcgctcaaggcgccatgctggggcagagtgacaggggcagctcgtgagccgtggaggggacagttcggcgctaccgcctgagctgtggcaacgtgcgagccgttacacctggatcgccacggcactgctcctgccgaccatggtgcccgccttcgtcatcggtgggtgggcgctgcgggtgtcggacgcctcgttcgcgctggccgcgctggtgggatggctcgcgcgtcgccgactcggtctcggggcaaacctccttgtcacgaccgtcgcgagtgcaggcgccctgctccagctctcggtgccggtcgatgccgtgacgaccttgatcgcagcgagcgtcatccgctccaccttgctcctctttgccggggtgggcgtgtacgcgatgagcttcatcggcgggcgggtggggctcgcgttcgccggcgtgctcctggtcgccacggccctcgtgcacccggtgggtttgctcggcgcggtgctcgccctggcgctcgccgccctgctcggctacatgatccacgggctcgtggagcatcttgcccatcgcgagcgtgagctgagtgctgctgcgctcgtcgatccgctcaccggtctcggcaatcgacgggccctcgagcgtgcgttcgacgtcgccgtggccgaagccgcacgacaggacaccacgctcttcgtgtcgctgtgggacctcgatgcgctcaagcgcaccaacgatgaacgtggtcacgaggccggcgatgccctcctgcgggacttcgctgcggcgctcacgcggacgctccacgatcaagaccaggcctttcgtatcgggggcgacgagttctgctgcttgcatctcggcttgaaggacggcgcatcgatcctcgcgcgcatggcactcgcgtttccgagcgtctcgggcggctttgccgaggttggcaacgactcgctggggacggcgcttgctcaggccgatcgcgccatgtacgccgcgaagcgccgtcgtcggcgccacgacggctccgacggctgagcgcgtgctaaactcgacacgtccatacggatggacgtcaccgcggtcgtggaaggcgtggcgccttctccccgttcccggcgtgttcgcgctggtggtgatgccgtatggcgccacgtatgacagaagctcatggatgggcgcagtggcgacgagctgctgcgacgctggcgctcctcgtgagcggtggctttgtcgcgcgttggggctcgacggccccgtcgtcgtccgtgcagtcgctgcaggctcaggcacaggttatcgaggcacagcttgccaacctgggggcctcggtgcatgccatcacggtgcagatccaagagactcaggccgcgatcgcggccaacgaggcctctgaggccatcctcgaggggcagctacgagccgagcacgctgcgatcgcgcggtcgcgtcgagtcctggtgacggccgctgatcagcagttcgtgacggcaggccaatactcgagcgtgttggcgtcgctgcggtcgaactacagctcggtcgggctgacgcagggctacgagcaggtcgcttcctcgtcgatcacccaggcgctctcggcctacgagcaggccggtctcgagatcgaggtgacgcaggcagcgctcgcggcgcgcgttcgggcaaccgaggccgagctggtgcaggatcaggcgcaacgcgctcagctcagccaacgggttgcggccaccgaggccgaactggcccaggtgcactcgcagctggcctcggccatcgcggctgaggcggcagctcccttgccggctcccggcggagcggcccaagccgtccaggtcttgctggctccgccgccgccctcgccgacgtcgctgtcggggcccgcgaccgccgcgcagctcctcgcgttgcgcgactgcgagtccgggggcaactaccaggccgacaccggcaacggctactacggtgcctaccagttcgcggccagcacctgggctgcgctgggttacggtggcctgcccaaccaggctccgccagcggtgcaagaccaagccgccgagcaactgctggctcgagctggctggggtcagtggccggtgtgctccgtcctgatcggcatgtaacgccgatcgttgcgccacgagccgaggcggccccgggatcgctcccgtggcgccgatcggagcgcgcgccactacgtcatggcgtgcgccccgaggaggctctggcgtgcggtcgcgtcatgctcgctgggttcacgcacccgtggtggccgactcggcgagaagctctggaggcgtcgaatcgagcagcgacaagatggcggtggcgagggcgcgggcgcttgcgacatcgagctcgagcgcactgaggcgcctgaggccggtggcctcgcgagcgaagacgtcgatgttgagcgaatgggtcgctgggaacgccacggggtggtcgaagtagacggtcgcctggtcgacggcctcccagccctccggggtacgtgcgcgccccgtgagaggggcgtgttcggtcgcgtaggtgcacatggctaggcgagatgctcgccgaggaagcggaagatccgctgccaaccgtcgttcgctgcttcgggtcggtacgagggtgcagcggtgttgaagaaggcgtgcccggcaccgtcgtaggagtggaactcgtgcgccttgccgagtcgggtgagctcttcgtcgagtcgacgtacctcgtcaggggctgggaacgagtcgtcgttgccgaagaggccgaggagcggggcgtggagctcgggagctcggtcgatgaccggacgcaccctgaccggggctccctcggggggctcgttcaccacgaaggcgccgtagcagtcgatcgctgcgtcgaaggggatcgcgcatgccgcgaggaagctctgtcgaccgccagaacagtagccgatcacaccgaccttgccgttggcgctgagggcggcacggaggtagtcccgtgccccggcgacgtcgccgatgagacgctcgtctggcaccccaccctgggcgcgggcgatggccgcggcctcgtccggagccgcgttcggagcctcgcgccagtagaggttgggcatcagcgtggcatacccgtggcgagcgaagcggtaggcaatctccttcgtcgcttggtcatagccaggcatgtgatggatcacgaccatcgagccgtggaccgtcgcgtccagcggtcgcgcgagaaacccctggacgaggtcgccgtccgcgccgcgaaacaagatctcctcggtgaggacacggtgctccatgcagactccctgtgtgcatctgggtggtcgaggccaccggtcgagttggagtagttgtaccttaccagcgactgggttcggcgtcgccacaggtggcaggccggggtgcgatgaccgacggcgaggcctcgcgggcggagtggtggtccctagtgctcgaccgagggcgaggcgacgagctcgaaggcgtcgaacccgacggtcggggccgctgggcgttgcacgaagccggcggcgaggagggctcgagccgagggggtgttgtgtcgtgcgacacgcgcgacgatcacctcgacaccaggctccgcgctcagcgtcgccgtgaggctgaggatcgccgccgtcgcgatgcctcgcccccgttcggatttgatgacgtcgtagccgatctcgacctcaccgttgatcgggttgccgtgcgcgccgatggagccgacgacgacgcccttggcgaggtcgacgatcacgaacgggccgaacgggaactcaggcccgacgcccgcctcgtggagctcgaggaagcgctgcgcgacgcctcggtcgatgtcgtcggggaagtccggggcccagtcgggagcgcgttccgccgtcgcgatcgctcggaggaggtcgacgctacaccagcggagctcgacggcggcacgatccatgcgttcggatcagtggaacgtcaagacggtgatggtgccgagcaggaacagcacgccgctgacaccgtagagcagcgacttggtgatgaccttggtcacggggcggtgcacgtagtcgttcacgatggtccgaaggccgttaccgccgtggagcagaccaagggcgaggaggagccagtcgaacaggcgccagagcggattcgaccagcggtgggcgacgaacgccacggtggtctgggtcacgtcgttctcgatgtgcatgatgtacatgtggatgagggccaggaagaacaggacgatcccggacacccgcatgaagagccatgcccaggtctcgaagttctggcgaggtcgtcgtgcgctccgaggagtggcgaagacggccatgtcagtgcacccccacgaagaacggcttgacgatgtagtagccaccgacgatcgtcagcagcacgctgagtccgagcatggcctggaagagcgctcgttcgttgcggacggcgcccgggaagaagtcgatcatgatcactcgcagaccgttcagcgcgtggtagaggagggcgaagagcaggccgacctcgaacaggcgcaggaagatgttgccgtagagctggtggatctgttcgtagacgtgcgggtcgttcagcgtggcgacgtcgacgatgtggagcaggatgaacatgaagacgaggaagccggtgacccgatggaggatgaacgcccactggccggtcttgcctcgatacatcgaggcgcgcgctcgtactgcgcgccctccagccggagccggcgtcgctggcgacgtcatgactgcctcctgaaccaccgggtgctgcgggtggtcgtcgcgacgacgtaggcagcgaaggcaacgatccccaacgcgatcagaccgagggcgatggagaacaggatctgggccagactgacccccgaagagctcacactcatggcgcttacgctagcgcccgctcggtgttggtcgaaatcacggcgatgcgtccttgtcgtgggtcaacccagctcgccaccggccggggctgtcgtgagcgtccttggcgatgcagtcgggctccgtcgtgagtggtgcgacacgacctgcgatcggtggggcgctggctcaagcggtcttgggtgcctcgagcctcgaggtgccgaggtagggggccagcgcatcgggcaggcgtatcgacccatcgggttcgcgaccttgctcgaggagggcagcgatgacgcgtggccacgcgagcgccgagccgttgagggtgtgcacgtactctggccgcgccgccggctcccggcggaaccgcacattggcccggcgcgcttgatagtcgctgaaccatgacaccgaggagacttcgagccacgcgtccacaccgggcgcgtagacctcgaggtcgaaggtgcgggcggacgactgtccgaggtccccagtgcacaggtcgacgacacgatagatcaggccaaggcgctggagcagcgcctctgcccgaccgagcagctcgaggtgcatgctcgtggcatcctcgggtgcgacgagtgccaggatctcgaccttgtcgaactcgtggagacgcagcaggcctctggtgtcgcgccctgcggaccctgcctcgcgccgatagcacggggtcgcggcggtgaggcgcatggggagcatcgcaaggtcgaggatctcatcgcggtagagcgacgtgagcggcacctcggccgtcgggatcgcgtagagatcatcgcgctccatcacgtaggcgtcgtcggcgaacttggggaggtggcccgttgccaccatcgtctcgcgacggaccagcgtcggaggatggatctcttcgaaggcctctgcgtgggcatcgagcgcgaagttcgtcagagcgcggacgaggcgtgccccgaggttgcgatagagcgcgaacatcgatcccgagagcttcgctgcgcgctcgagatcgagaatgccgagctcgcgaccgatctcgaagtgcggtacgcgacgatggctgggtgtggtggacgtgagatcgacgtcgggctcgaccgtgccggtctccggcgaccattggcgtaccacacggttgtcgtgttcgtcctcgccgatgggtgcgttcgggctcgggatgttgggcaaggtcagccagatcgcgtcgcgatcgccggtcaaggtgtcgacgcgctgctcgagttcgtcgagccgattaccgagcgctcgggcgccctcttgcagctcggtcgcgtctcgaccgctgcggcgagcctcggcgatgtcgcgagagcgggcacgcagctcggctcgaagctggtcacgctcggtgatcaccgctcggagttgctgatcgatcgtggcgaggtgggcgaccacctcggggtcgatcccgcgggacgcgaggcgccgtgcgacgtcgtcggggtgggcgcgcagctccgtgaggtcgatcatgcagccttagactagcgatgcgatggaggatgctctcgaggtccacgacctcgtcgtgcgctacggctcgttcgaggccgtccgcggcgtgtcgctgcacgtcgctttcggggaggtcgtgggcgtcctcggtccgaacggcgcgggcaagacctcgaccgtcgagacgttggagggctaccgacgggcggctcgtggcgaggtgcgcgtgctcgacgtcaccgatccgtggcggcaccagcgcaccctcgcgcgtaaggtcggcgtgatgctccaagagggaggcgtcccgccgcggatgcgggccctggaagccctcgagatctacgcacagttctacgacgatccctggcccgtcgctgagctcgtcgatcgtctggcgctggcgcccgttgcgacgacgccctttcgtcgactctcgggcggcgagaagcagcggttgctccttgccctcgcgatcgtcggccgtccacgggtcgtcttcctcgacgagccgacggcaggcgtcgatccggtcggcaagcgcgccatccgggacttggtcgccgagctcgccggatcgggcgtcgcggtgctgctcaccggccatgagctcgaggagatcgatcgcatggtggatcgggtgctgatcatcgaccacggcatgcccgtcgccgccgggagtcccgcagagcttcgggagcgcttcggagaggccggggtcgagttcaccgtgcgaggcaggctggacccaagcgtgctggcggcacgactcggggtcgaggttcggctcgttgccgaggatcgggtgcacgtcggggcttcgccgacccctcagttggtcgcgtcgctcgcggcggtgctcgacgagctcggcgccgaggtcggtccactcgagacggtggagtcgtccctcgagtcgatctatctgcgcctgctggaccgcggggagacgacatgagtgcccatccagtacgcgcccaggcggtgtccgagctcaagctcgtcctccgccaaggcgaagccgccctccttacgatcgtgatcccgatcctcggtctcgtgttgttttccaaggtcaaggtattgccggtgcctggcggcatctcgcgcgtcaacttcattctcaacggcgccatcacgttcggcatcatggcttctggcatggtctcgcagtcgatcaccgtcgccttcgatcgttcctacggcgtgttgaagcgtctcgggatgacgcccctcggacgcagtggggtgatcgccgcgaagctcgtggcggtcgcaggactcgagatcgtcgagttggtactcctgctcgtcgtgggggctgtgctcgggtggcacccagctggcaatcccatcgagttcgtcgtcggttgggtgctcgcgaccgctgcgttcgctggtgtcggtctcgtgctcggaggaacgttgcgggcagagctcgtgctcggattgtcgaccctgctctggctggtgctcctcggtctcggcgcgatggtggtgccgctcgggagtctgccgggcccagtcgccgatatcgccaaggtgctcccagcagctccggcggccaccgtgctgctccatggcatcgctgtcggcgggagcgcgccactgtgggcgtgggtgagtctcgtcgcctgggcagtcgtcgcaccggtcgcggcgtctcggctgttccggtggagcgcctgagtatccgccaagagcgggccgtcgaagcgtcggtaggatagagccatgcatcccgtcgtcgagcgagttcggtcggccgtaccggtctcgccgcaagtcttccgacgtgtggcgctcgccacgctcggcgtgtcgacgttcatcatcttcaccggcggcgtggttcgtctgacgcagtcagggctcggctgcccgacctggcccgactgcacgaccggccacttcgtggcgggcttcgagatccaccccatgatcgagttcacgaatcgggtcgtcacgttcttcgctggcctgctcatgtccttgacctgggtggtggccctgttgcgacgtccattccggcgggacctcgtgtggtggtcgctcggtctcgtcgtcgaggtcgtcgccgagagcgtgctcggcggtatcaccgtgctggagaagctcgcaccccccttcgtcatggcgcacttcttgctcgcgctcgtcgtgctatggaatgccgtcgtgatctaccacaaggccggccagcccgagggacgcccaaccttggcggtctcgtccgaggtgctgtggctgtcgcgggtgatgttcctcgtcctcggtgcgctcgtcttcgtcggtacggcggtcgcgggtaccggaccctactccggatccccggggagcaagaggctgcacatcctcaccatgctgcaggtgacctacctgcacgccgacatcgccctcgtcttcattgcgctcacgctcgcggacctgttcctgctccaccaggggcgctaccccgcacagatccagcgtgcggctcggagcatcctctggctgggcgctctccaaggcatcatcggctacacgcagtacttcacgggcttgccgcagtggctgatcgcgctccacatccttggtgcagcggtcatctggctcgcgatgaaccgctactacctcttgctgttccgcgtgccctcgacgcgcagggcggaccacgcggtcgcgccgcagcaggcgccttccgtcgcggctgccgactagcgatcgcgacggacgctagccttggtggtgttcgtctcgggaggtgcgtggtcgatgtcaccgtcaccagcccttgcgccggtcgagtccgaagaggtagccgagactcgcaccgaagagagctgggcgaccattctgtgggatgacccagtgaatctcatctcttatgtgatctatgtgctgcaggccaccttcgccttctccaaggtcaaggcgaccgagctgaccatgcaggttcacaacgagggcaaggccatcgtggcgaccgggtcgcgcgaggacatggaagatgcagcgtcaaagttgcatgcctatggcttgtgggccacggtgtcgcgcgcgtgagtgccgggccgttcgtccgtgatggcgacgtcgtcgtggtggtgctgtcggcgcaagctcgagatgttgtgagtcggagtctcgagctcgtcgctgggatcgttgcgtcgggacgcgaggaagcctggcgggttgctccgccgctctacgacgacccgttgctcgaagccgaggcgtcgctcgcgagccgaggtgatgccggcggcaccctcgatgaggcccagtcgctcatcggtcgttgggcgaagcgtgtccgcgacgtcgagcgcctcgatctcgacgcggctgatgaattcatgcgcgcgttgaacttcggtcggctggtcctcgcggagacccgaagcgtcaccgatgatcgaggactcctcgacctgtttgcttggctcatcgaggcactcgtggaggccctcctcgagggttgacgcaccctacccttgcgtcgtcacgctggacgagcgcaccgcacgacagtagggatctcgcacgtcgacgtcgacccgcgcggctcggcgtggtcgtcgagcagcgcggcctcgggcgtcgtggtgcccgaggccgtccctgcgacgcggccgctcagtcgccgagctctctcgggatcgcggtctggaagctgcggaacagctgcgtgaggtccgcgtagccgaggcccgatcccggattgaacacggcgccttgggagccggtgtagaagtcgttcgtgttggtgaactcaccggagatcgcaagctgggcgttgccgatctggccgctgtagtaggccgagccgtcgatggtgttcgaatcgagcggcgtgaacggcgacgacgtcgaggtcgcgaagcggtagatgttcggattccagaagccgagccgtacgcccccgagggcgctctcgtagacggcgtcggtcccgttgagctgaggcgcgatgaagctcgtgccaccgaagtccaccagctttgacccgtagacgctctggaactgtgggtcgtagaccgcatagccggtctgggggtcggcgttgaacgccaggtccggcgtgacgcggccaccgctcatgcccgtctgaagcgtcggggcagggttgaacgagaactgcgtcggctcgacgaggcctggtgcgacctgctgtggatcgatcggcgtcaagaactcataggccgagtagctccctgcccccaccatctgaccctgttggtagagcggacggccgaagagggtggagtagccaccgcctgatcccaccggcaagctcgtggctgcttgggcctcgttctggaagccgagtgcgatgtacatcggccacaggtagtcccagccccaggtcatctgctgcgggatggtcaccgactcggtgccgacttgggtcccgttcgccatgatcgggtaggtctgagtacccgggagcgtcgtgccgccagcggcggtgtcgtagggggagtcggagggcgagataatgccgaggttggtggtgccgatgtcacgagctgggttgtaggccccataatcgccgctcgcgatgaagttcgactgtccctgcgccgccatctcgaggaaggcctggttgaacgaggccgcataccccggtgactcctgcgctgcgtccaccgcagcttggatcgcggtctcggactcaccccagctcgacgagacggagccggcgacgttctggctggccgcctcgtagaaggcgtcgacgaagccgtagtcggtgttgggcgcctggtacacgacgatcttggccatcggcgcgatcgtgcccgactgctcgacgtcgagggtggtctcgtcggagccagcgttcagcgacaccggccctgcaccgccgtcgacgttgacgagcgcaagacgattcggcaacgtcacgacgtgcgcgatgttcctccagaagtacatcggcaccgaagggttcacgctcgccaaggtcacgatgccgatggtctgcccctgaccgaggtagcccgcttgctggagcggtgtgaggttgtagtcgctcgtgaaggcctgcggcagctgatcggtgggtgctgcggtttgcgacgacccagccgtgggtgcgacctggttgatgccgggcaccgcgagcgactcgtagggcgcgtagttcgacaacccgagcacggccagaatgttcgacgccaggttcaacggcatctgcggcgcgctgcgcgtcccgtagaccgtctgggtcgtcgcgggcgcactggctgcgggcctggtggtgacggtgaagttctcgagcaagatcccaagggccttgtcgtactgtgcggccgtgccctgcgaggtgacatcgaggccatcgctcatggcctgggagctgatgccgaactcacggaggaacccacgcagcgcgaggatgtactcttcggtctggccgtactcgagcgcgaactcatggggcgtcaggtacggaccacgccaaccagcagccacccgagaggcaagctgtccctggttgcgcatcttcaggatgaacgacacccgcatcatcgtcgacccagccgtggtgcccgtcggggtggcgtgcgagagcacatcggcaccgatgccctgcgacaccggcaccagcggatcagacgccgacgcgagcgactgcgcgcctggcatcgccagtgcagcgccgacgaggccgatggatccgaggattcccaggtatttcgtgcgagccaaacgcttcatcgctccaaccccctctgtggatgtgacgagggatctcgcagaccccgctggatcatacatcgcgtcgcgtcgtgcggtgggatttctacggagagtttgtgcgcttggcacgcagcggcaacattaccactcgatgtgggcgcgagaccacaaacgatgggccagagctgggcgcggcgcgctgaagtgagtggtcgggcgcaccgtgcgaggtggcccttccctgccgccgcgactcgcgctttcgaccagacagagccgcgtgggaacggtgcttgggctccatatcccagggcatcgagccaggactcatcgtcgtggcgctgagttcggctcgcctccgagctttcgacacacgcattggcgctcggagttcgccgacgtcgcagcggtcgaccaacgaggagccgagcaggtcgcgggcgcccgacgctgatgatgtcctggccgcgtaaggctctggtcgacaagggtggtctcggacagaggtcgtggtgtgccccgccggctgggtggtgagccgaaggcggtggctgtgcgggtgctcggtcggcgccgggcacgggctgtgccggcgatgtcgggtcacacgaagcactcgtgtcgacgacggctcagggcacgaggatgaccttgcccacggtggtgcgaccggcgagggcttcatgagctcgacgggcctcctcgagggggatgcgctcggcgatggtcacctcgaggaggccagcggcgacatcggcaaagatcgcctgagcgcgccatctgagctcctcgggcgtcgcgacgtagtgcggcagcgacgggcgcgtgaggaagatcgatccctgccggttcaggatctggggatcgacgggcggcaccgggccgctcgcctgtccatagagcacgagcatccctctgggtgcgagcgccgcgagcgatccatcgaacgtcgcacggccgacaccgtcgaaggcaacgcttaccccaccgagcctacgagcggcatcgacgaatccgtcgtagtcggtcacgatctgagcgcccagacgacgggcacgggttcgcttctccgcggtcgaggccgtcgccacgaccgtggacgcgacgcgacggacgaggtactgcacgagcagggaacccacgccgcctgcggctgcgtgcacgagaaccgtcgcacccggttccactcgagcgcaggagttgacgagcgcatggacggtcatgccctggagcagcaccgcggcggcgacatcggccgtgacgtcgtcgggaatcgtgacgagccgaccagccgggacgaccaccacctctgcgtaggcgccgagatgattggcaaaggccacgcgatcgccgatgctgacggaggtgacaccttcaccgacctcgatgaccgtgcccgcgccttcgctgcccaggacggtcgggagcgagaggggataccagccttcacggtggtagaggtcgatgtagttgacgccgatcgcctccagtttgatcgcgacctcaccgggggcggggtgcggctcggggacgtcggcgatctcgagcacctctgggccgccgtggcgctggatcagcaccgccttcatggtcgcctcctggttcaggtctgtgcgctagcaacggtagcctcgtggtgcgacaaggagggtcacggtggggcgagtgttggtggttggagccggcatcgtgggtttgtcgacggcatggcacctcgcagagcggggggaggacgtgacggtgctcgagcgccgagacgtcgctgccggcgcttcctacggcaacgccggctggctctcgcctggcctcgccatcccgctcaacgagccgtcgctggttcgtcagggcctctcgtcccttgcgtcgccgtcatcgccgctgtaccttgcacctcgtctcgagcgaagctggttggagttcgtgatccgtttcggcctcgcatgcaggacggacgtctggcgacgatcgatgcagatcctcggtgggctgaatgctcggtcgttggaggcgtgggaacgactcggcgatgccgtcggctaccagccgacgaccgcaccgatcgtggcggcgttcgcccgccgtagcgatgctgcggcgctggagcacgagttcgctctcattcgcgaggcgggcttctcgctcgagacgaaggatctgagcggcgacgagctgcggcagatggtaccgatcgcggcccccgcgctctcgttcggcatcgccatcgaggggcagcgcttcgtcgacccggcgcgcgcgacccaccgtgtgggttcggccctcgctgagcgcggtgtcgccgtcgagcgcgcagacgtggttgatctcgagcggcgcggagctcacgtcgtcgtgcgtacggtcgagggggccgagcacctcgccgatggggtggtggtcgcgatcggagcgtggctcggcccgctcgcccgacgtctcggcgtgcgagtaccgctgcaagccggtcggggctactcgctgcgcgtgccgatcgaacgcccgctcgacgtcccggtctacctcccgactgcgcgactggcgtgtacaccgctcgacggtgagctgaggatcgcggggacaatggccttcgagaggcccgacgatccgccgcgccaggcgcgcttcgacgccatgcgtcgtgccgcgcggcggttcttcgaaggggtgcagctcgatgcgccacgcgaggcctgggtgggcccgcgacccgtgacggccgacggcttgccgttgatcggccccaccgcggtgccgggggtctggctcgccgacggacacggaatgtggggcatgacccaaggcccccttaccggggaactggtcgccgagggactgctcagtgggacggtaccggaagcgttgatcccactcaatccgctccgctgaggtgaagcgatgtcacgctcttgtcgctcgaatccaacgggcgccagggagtgtgccgcctcgtcagtggtgttctcgagcactgcaggctgcgcaggtgccgacgatcgcgaagtgtgacaggcgtgcgcgaaagccccattgggtctcgatgcgcgcgatggcgggcgcaaagacgtcctcgggaatctccgtgaccgtgccgcagtgctcgcacaggaggtggaagtgcgacgatcctgcgaggtggtaggtggcggggctgtgaccgatgtggacgtgttcgatgatcccgacgcgttccaaggcgtcgagggttcgatagatggtcgcgcgatggacgagtgcatctcgctgctcgagggcgcggacgagttcgtccgccgtcagatgaccgcccgcctccgcgagggcatcgatgatggcgcgtcgcgcctgggtgacccttccgccccggcggcgcagacggtcgagggcttcgtcgcgatcgagggtgacgcgcgtgcgctcaggcacgggcgtggtctcgttcgagccggtagccgacccctcgtaccgtggcgatgatgctcgggttgttgggatctggctcgatcttggagcgaaggcgcttgacgtgcacgtcgagcgtcttcgtgtcgccgtagtagtccgacccccagactcggtcgaggatcagatcgcgcgtgagcacgcggccggggttgcgcaggaacagcaagaggagatcgaactccttcggaggcaggcggacctcggtccctcggacatcgacttggtggcgatcgacgtacacggtgatgccgtggctctcgaggatctcctctgcggcctgggcttggccctggtgcttggtgcggcgcatctgcgcacggatcctggcgaccagctcgctcatgcgaaacggcttggtgacgtagtcgtcggcgccgagttcgaggccgagcacggtgtcgagctcaccggaacgtgccgtcaccatgatgatcgggaccgaggactcctgtcgaatggtgcgacagacgtcgagccctgacaggcgcggcagcatcacatcgagcaggatgaggtcgggatggtgcgagcgactcaacgccagcgcctcttcgccgtcgttggccacgatcgtctcgaagccttcgcgcgtcaggccgaggacgagggcctcgacgaagctcggttcgtcgtcggcgatcagcaccgtgccgacgtgggcgcgcttgtcgtcagcggccatcgttcggaccacctcgtggaagcctcagctcgaatgtggatccaacgccctccatcgaggtcacgttcagcctgccgcggtggttctcgaccacgtgcctcactatagagagaccaagaccagttccgcccgttgcgcgtgagcgggcagcgtcgacccggtagaagcgttcgaagatccgctcgcgatcgcgagcggggataccgatgccctcgtcgcgcaccgcgagcacgatggtgtcgtcgctcgcgtcgaggctgatctcgaccgtgccccctggctcggagtacttgatcgcgttgtcgacgaggttggacagggcgctctcgagttgccaacggtcgccgacgaccatcgtgggcgtgacgggtacgagcgcgtccagggtgagatccgctcgacgtgcggtctcgtcgaagcgttcacgcaccgcttcgaccagggatcgggcgtcgaactcggcgagcacgacgccgctgccctcttcgatgcgcgacaggtcgagcaggtcggagacgagacgagcgaggcgatcgccctcgtccacgatgcgctggaccaggcgttgcgccgtcgtgggctcgtcctcctgggccagggcctcggcgaggagaacgatcgcgccgaccggggtcttgagttcgtgcgagacgttggccacgaaatcgcgccgtaccgactccaggcggcgcagctcgctgacgtcctcgacgaggatcagctggcctcgatcgtcgagccaggttcgacgcacgagaaaggtccgccttggcggaccgaacagctcgacagcgcgctcgacgtcgccgtgggctgccgggtcgtggagcaacgtggcgatcgctcgatcgagcaagatgcgctggttgagactctccgcaccgaatttcgcctcgacgtcacgatagagcgtgtgtccttcagggtcgacgagcacgatgccaaagggcatcgtggatgcggcgctgtgccagagccgcgcctccgcagtcgtcgtcggcatctcggctgggcttggttcgggagtgtccaccgtcgctccagtctaggagcctcatcgcgccctgatcgtgtcagtgatgacattctatgctacgctatgcctactcatggatgatggtgtcgtccgcaagggcgtcactcgagcaaaggagtgcaaggacatggtcacatggacgttcctcgacgtgtcgctggcgccggatccctcggcgttgccgggaggctccgtcctccagaccctgatcaacggcctggcgggctgggcgctgctggcaagcttggcaggtctcgtcatcggtgcggccgtgtgggcactcggtgcacacagtcagaactaccagcaggcctacctcggtcggcgggccgtactggtcgcgggggccgctgcgctgctcgtcggggcagcccctgccatcgtcaacttcttcttccacctcggacttggcgtggggtaagtcgtgggcttcctccttgcacacggcgcggcggcgatcgcccgtgcggtgtggacgacgttcacctccggcctcgatcacttcgccaccagcgcgatcgtggcgctgctcgcatggctgctcggcaatctcgggcctgttgttgccgctgccccgaccgtgctcccgaccgcgccggcactcgtcggtccgtacgatcacgtggccacggtcgcgggagccttgctcctgccggcgttcatcgtggcgatcatcgcgcgcgtgcgggagccggctcacggatcgatcgccgaggtcctcgcccgacctgcagcctgggtgctgtcggtcatcgcgacgccgcccgtggtggccacgctcgagcgctgggttggcgtggtctcggccagcgcctacggagcgttcgccgtggtgccgtccgctgctctgtcgttgcggccgaccgtggtggccggagggttgcgctcgagcgccgcggtcgtactcgcccttgtcgcagccctcgctgccctcgcgtgctatctcgaggctgtgggacgcggggttgcggtcgacgtcctcgtcctgctctggccactcgtctcgatcgggctggtcctgccgggggcacgaaccctggtgcgccgaagcgccgaggtcctcgccggtctcgtcctgctccaactcgtgctcgccctcacgctcgggctcggggccgcgattgcgcaggcgaatggttcgcgtacaacggccctaccggtgatcggcgccgccctcgtcgtggcggcgagcctggcgccggcgctcaccttcggcatcgtgccgatcgccgaggtgcgtctgttcgaggtgacccggggccttcgacatctggcgagcacgggcctccgacggggcatcgaggtcggagggggagtcgtcgccgaagccatgccacctggagacgctcgccctacgatcccgccgtacgaggggtatcccccgcccccggaggtgctcgagcgcgcgaagcacgacccatgggtgcgggcgctcgtcgacccccctcgtcgtcgtccgtggcagcggaggcggggatgagcggcgtcgagctcggcacgccggccctcgggtcgcgggtcttcggggtgccggttgccaaggcgctcgcatggggcgcggtcgctgtggtggtcgcggcggctgcggcgcgcatcggcgggatcttgggcgtggtggtcgcggcggtcgtcgcgaccggcgtcgctggagctgcctcgatcgccgggtggcacccactctggtgggtcgtggtcgcggtgcgggagcgcgcgcgacgcgctaccgagcgggttggccagccgcgacgcgccgttcgcttcgatcccgatgccggcagtgtccgcattgctcggctcgtggcacgccacgctggcgtcctcggtcgggggcatgatggaagtctcgacgacgcgtggggcgagctgctccgggtgctcgggacgagcttgcgtggccgcgaacggtttctcgtgcgttcggatgtgatcccggcgatcgaacgagagcagttcgctctcgagccagacgatcgctggctggccgagcggacctggatggtcgagacccatctcggggtcgcgagtgacgagcgccgtgggcgtggacggcgcgtccgactcgtccgcgctctcgaggccgccgaagctgcggctcggggccagctcgcgctcgagccgatctcgtccccgtctgccgtcgcatggagcgtgctcccgcgcacgggtgaccgtccggatgccgtcctcgagcggaccgacgcactagagatcgacggcggcttcgtgcgcgccctccacgcggcacgctttccggttggggcggtccacgcgtggcagctggcagggctgttcgcccccgcaggaccgcgccgcgtcgtgaccctcgtcgcccaaccgctcgatcctcgaagtgcgcttcgccaactggggcgccatcgtgtcgagacagctgccgaccaggagcttcgccggcggcatggctatcggctcgggatcggtgagctcgggcgatcggatcgtctcgacgagatcgagcgggagctcgcgaacggtcacgccctgtgtcgatgggagctgttcgtggtcgtggccgcgccgacgctggccgagctcgcagctgagaccaccgccgccatcgagcgggccgcagcctgcagcgtcgatcttgccaccgtgctcggacgccagcgtgaggcggtcgaactcgcgctcttgggggtgtccggatggacctaggttggcaggactcgacccgtgcgctctcggtgctcgcgtttgcgcccacgcctccgccgcagccggcgccgagcaccgtcgtcgggatcgctggcagtggcggactgtttcgcttcgacgccttcgacctctacacccatgggtggctgacgaatcccaatgtgctgatcctcggcgacgtcggccgcggcaagagtacgctcgtgaagctgctcctcgtccggtctgcgatcgcggcctccggcagcttgctggtgctcgatccgaagggcgaatatggcgccgtcgctcgcgccgtcggcgcgagcgtcatgcgcccgcgcgcggaccatggcgggatcgatcccctcgctggctcgctcgatcagcgagagcgggctcgcgccctcggcagcgtgctcgaagcgttgtgtgagcgtccgctcgacgagctcgagcggcgtgcggtgtcggccgtgtgcgtgggaccgctcgcggggctcgccgacgccgctcgacgcctcgcggcgcttgacgcagaggtgttcgatgcgcgacttgccagtgccggtctcgaacgggcggcgcggctggcgctgtggctctcgcgcgtcgtcgacggggatctcgcggggatctgggagacgcgaggtggggggagtgcgctggctccgcgggtcgtcgtggatctcagcgacgtcggcgccgagcgttgggttcggatcgcggtcgcagcactcctccgcatgcggttggcgcagcttggcagcggtgaggttgcaggtgggctcgtggtcgtcgacgaggcatggacgctcgcgagcgagaccagtacgcgaacgctgctcgtgcgagcgctcaagctggcgcgcgcctacggcgtcagtgtggtcgcggtgacacatcgcctagccgacgtcgccggtgcgatggatctcatcggcgacgtcggtaccgtcgtcgccttcggacagtcgtcgtctgcagcccaggacctcgtcactgagctccatctcgacgagcgcgtgcgcgagctggtcgccggtctcgggcgcggtgtcgcgctgtggctcctcgggggacacagctggctggtccggcacgtcgttcgggaggaggaggtcgcactcgtcgacaccgacgcgcggatgcgggctccagcaccatgagcctcggtgcactgatcggaggcctcgctgccatcgcgaccctggccggtgtcggcaggccccgtacaagagagcatcgcagtggcccgcgaccactgccgcgcaccgcggggatcggcatcgtccgcagcgacgagatcgtggttcgactcgggcgctggcgccgtgtcggcgtggggcgaggatcgtcgttgctcgtggtcggcccgacccagagcggcaagacgcgcagggtcgtggcggagaacctgcgacgtcatccggggaccgtcctcgtcacctccgtcaagggtgacgtcctcgatgcgcgtgcgctcgagcggcgtcacgacctcggggacgtgtgggtcctcggtgatacgccgcgagcgacgcacgagtggcagccctggttcgaggccatcgacgacacccatgcactcgcgatggcagatcgactgctggcgatggtgcccgagcgcagaaccccgagcgccgaggttcggttctggcacgagcttgcacgtccctacgtggccgcgtggctgcgccttgcgtggtacggagagcaggtgccggtgggtgagttgctcgtccgcgcagccgaggtggcgggggacgaacttcgtgcggcccttgatgagacggtcgccgatggccgtcagcgtgactcgctgcacgtgaccatccaggcagcgctcggcgcggcccgaggaccgaggagtcgtgggtggccggtccgactcggcgaggccctcgccccgacggtcgtggtggtgggttcgctcgccgagcaggagcgccgctccgcctggtatgcgacgctcctcgacacggccttcgaggccatcttgcgccagccggccaacacgctcgtcctcctcgacgaggtggcccacctcgcgccggtgcctcgcctcgcgcacgtcgctgccgtcagcgtgggtctgggcgcacggctggtgacgatcgcacaggactttgcccagttggaggcggccttcggggtcgaagcagcctcattggttgccaaccaccgtgcccgactgttcctcgaccccgcccacgatcctggggttcgagcgcacctcgcggccctcgggctgcgaggtgacgagggcgccatcctcctcggccctcgtggtgcgcggcgtccgatccttgggtcggtggcttaggttcggcgaggcgctgccgatagctcgcacatgagcccttccacgattgcgcaggcgcttgacgacgtcgaggtcgcactcaccgctctcgaggcggcactcgaccgagacgacgtcgctgcgctcggacccgcgtccaacgagttggctcgtgcggcggtgtcgctcgggtcactcgtggccgaggaggcgccggtcgacgccctggatcgagaacgttatcgctccctcatgccgcgcgtcgacgcggtggtcgctggctgtgcgtggcgtgccatgctggtcgcgcagctcctccgcgacctcggagcggatcttggtatctacggtccggatggactcctcgaggtgaccatccccgagcgctcgagtcagctcgcatgagcggcggtgccctctacatcgcactctccggcctcgaggcgcagcaggtcgggctggacgtcgtcgcgcagaacgtcgcgaacgccaacactccgggttaccagagcgagtcggtggacctcgcgaaccagcaactcccaggcagcccggtcggcgacggggtcaccgtgcaaggagtgctccaggcgcagaacacgttcgcgcgctccctcgagctcgggtcgcaggcggcgtcgtcgtacgcgacgcagttgtcgtccacgctcaccgcggcgcagtccgggtccttccaggagccgtcgtcgaccggcatctccgagcagctcaacggactctggagtgcctttggccagctgtccgacacgccgacacagctggcatcggcacagtcggtcgtcgctgcggcgcagcaggtcgccgaggcgctcaaccaagcggcctccaacctcacgggtctgttcaacgacacctcccagcaggcttcgctgctcgtggcacaggtgaacacgcaacttgcgcaggtggcgtcgctcaacggccagatcgcggcgcagagcggcggtgaggtcggagcggcgaactccctcatcgatgcgcgcaaccaggtgctgtcccaactcgccaacgagatcggtgccacggtggttccggcgtcgtcccagcaggtgaacgtcctggtcgggggagtgacgctggtccaggggacccagtcgaacgcgctcgccgcagcgatcgcggctcccggctctccgccgaccgcatctgggacggcccagatcctgctcgcggggacgagtacccaggtgccggtcacgagcggatcgctcggtggcatgctcgcgtcgttgaacaacaacctcccgcgctacggcacccagctcaacgcgactgctcaggcgttggcgacccaggtcaacgggctgctcgcgtctggtcagacccaaggcaccactggcccgattgcaggccctccgttgttcgtcgcggctggaggtggcacgctcgatgccggctcgatcgctgtcaacccccagatcgaagcctctccgtcgctgctcgcggcctcgacgacgccctatgccggtggcaatggtcagaacgccgccgcgatcgcgaacctcggcagcgccgcagacggcccgaatgcactctggtcacaggcggtgggtcaggtcggactcgatgtgcagtcggcgacgtcgctcgcgacctccgcggcccagcaggcccagagtgctcagacagcggagcagtcctctgtcggcgtcgacgtcaacggccagctcgtcaacctcgtcacctatcagcaggcctaccaggctgcagcgaaggtgatctcgacggtccagcaagccctgtcgtcgttgctgtcctcggtgtcctaggaggggcgatgcaacccatcatgacgtccatcagcctggcgaacacgctgtcgtcctcgctcgatagctaccaaagccagctcagccagctccaggtgcagctgtccaacgggcaagccatccaggcgccgtcggacaaccctgccgggacggtgaacctgcttggggcccagacccagctcgccgcctaccagcagtaccagtccaatctgtcgtacgggcagacggtggcccagctcgcgaactcctcgctgacgcaggcggtgagcatcgtccagcaggctcgaagcgtcctgctccaagcaggtgctcccggggtcacctcacaggtcgcctcggggcttgcaacgcagcttcagggactcgagacctcgctgctcggcgttgccaacacgacgtatgagggccaggccatcttcgccggcacggcggacgtcgcaaccgcctatgtccagcctggcgggcccggtactgcggtgacctatcaggggaatcagcagagcgcgacggtcgcgggcgcgccgggcgtcgctctggcgacctcgttggccgacccattcggggcctccagcccgaccggcggcgtgttcgccgcgctgaaccaggcgatctccgacctgagttccggcaacacctcggctgcgaccaccaccgatcttgcgtcgctgactaccgcgctccagaaccttacgaaccaagcgggggcggccggtgaggctgtcacgcagttccagaacctcacgcagcaggtcacggcggcgattacgcaggtgcagagccaggtctcctcgctgcaggggctgaactatgcccaagtcacgacccagtaccaaacgctgctcaacaactatcaggttgccttgtacgcagcggcccaggtcaagcagccgacactggcctcgtacctcgcctaagggatctcgcatgacacgcacaacggaggatgccgctatggccatgaccaccacgcagccggcgatcgcgacggtgccgatcaccttcccggtcggtgtgcccggcttcgaggaacatcaccgcttccacctcgtcggactcggccccgcctatggaccgtggctcgcgctccgatccgcgatcgagggaggtccgaccttcgtcgtcgcccagccctatgagctcggcgtcgagctgacggtcgagatcgacgacctccatcaggccgtgctcggcattgcggatccgcagcaggtcctcgtgctggtggttgcgacgctgcgcaacccacacccgaccgtcaacctgcgcgctccgatcgtcgtgaacgtcgaagtgctgcgcgcggcgcagatcccgcaggatcgggacgactacctgctcgaggcgccggtgaccgtcccgctctacgacaccgctcgcctgcgcccgtcggaggcgagcgacgagcccggggctgatcgctgaggccccaccgtcaggatcacgcgtggcgctgcctcggcgcgacgggatctgccgacgcccgaggttggcgccctcgaccgacacggttggttggctgccaggatggggagctgcggcctctccgcccccgcatcggctcatggctcgcgagtcggtgagcggccactctcgtgtcatgacggtggtcggccacgagggaggcgtcgttcgacgtcggtctcgagcgacaggctcgttcgcactcagtttcgcgattgaccgtgccgtcgtcgtggtccgcgctcgacgtggcgaagcacggtcacaactggccgccgcgccggtcgcaagggcgtgtcgagagcgtgatgagtgcgacctcgatccctaggcctcggctcccgggcctgaatcctcgagatgcgctggatctgtgagtactcgagcactctccgcggcctcacggttcgcctgttggagcgcctcgaagacttcttgtcggtggacgtccacggatttcggcgcctcgatcccgatccgcacctgatctcgatgcacatcgagcactgtgatgacgatgtcggtgccgatcacgatgctctggctcgccttgcgtgtcaggactagcaccgcgcctccttgcgcccgaaggcactcgttcatgcccccaccagggggcagttcctccacggtcgagaggcctcttgcagctctttgcgctgctctgtgcccacgacgcgcctcgttcgcaagtgtagcatcacggtcggactccgatccgagttccttcatcgatcgctgaggcttcaagcgaacgtcgcaacgtgccgatgcgccaaggtacgagtgatcggaggagcgatgaccggcgcttcgccagaggagcttgcggagttccttgcggagtcacaggagaacttggaccgcttcgatcgtgacgtactcgcgctcgagtcggacccgtccaaccgtgacgcggtggcctcggccttccgcgcgatccacacgctgaagggcacatgcggcttcctcggcttcggccgtctcgaggggctcgcgcatgacggggagagcttgctcgcacgggtgcgcgacggggcggtgcgagtggacgccgcggtagcagacgcgttgctggctctcgaggacgcggttcgcaggagtctcgacgccatcgccgccaccggcgacgaggacgacgagcactgggaggagctccgcgcacgcttggttgcgctcgcggagcaggcccacgaggcgccgcggtcggtcgcgggcgcgaacgccgtcgtcttcgcgccagcgccatcgtcgggcgcgcctgccgagctctcgtcgggacccgagtcgcaggcgtccgtcgagggcgacgtggcgcgcggcgccgagccggatgggaagtctggcgctcggccgacactcggcgagaccgcggtgcgcgtggacgtcgggctcctcgaccgtctcatgaacctcgttggggagctcgtgctcgcgcgcaatcgggtcatgcagctcgcccaatccgagggcagtgcggcgctcgcagcgagcacgcagcagctcagcatcatcgcctccgaactgcaagaacaggtcatgaagacgcgcatgcagccgatcgacaccctgttcgcgaagttgcctcgagtcgtccgcgacctcgccagggaactcggtcgcgaggtcgaactcgtcctcgaagggcgcgacaccgagctcgaccgcacgatcatcgaggcgatccgcgatcccatgacgcacctcatccgcaacgccatcgaccacggcatcgagccacccgacgagcgccggtcccagggcaaggcggcccatggcgtcctgcgcatcgacgcctaccacgagggcgggtcggtgattatcgacgtgagcgacgacgggcgaggcatcgatctcgaagccgtgcgggctcgtgcgctcgcccgcggtctcgtgcacgccgacgagctcgcacgactcgggccgcgggaggtggccgagctgatcttcgtgcccgggttctccaccgcgacgaccgtcagtgcggtgtccggccgtggcgtcggcatggacgtggtcaagaccaacgtcgagagcgtcggcggcagcatcgacatcgactcggatccgggccgaggtacgcggatgcggctgcgcatcccgctgacgctcgcgatcatcccggcgctcatggtcgagacgcacgggcagcgcttcgcgatcccgcaggcggcgcttgccgagctggtgcggctcgagctcgatggtcggcactcgctggtcgagatcgtcgaccacacccccgtgctccgccgacgcgaccgtctggttccgttgctcgacctcggagcgatcctcgggcttgcgccgcccttccccgagcgaggactcgatgcggtgagcgtggtgatcttgagcgctggcgccacgagcttcgggatcgtcgtcgatcggatcgtcgacacgcaagagatcgtggtcaagccgctcggacagttcgtgagccagctccagtgttactccggggcgaccatcctcggcgacgggcgggtcgcgctcatcgtggacgttggcgggatcgcgcagctcggcggtctcgcggtggagcgtgcacacgagacgacgtccgagtcggtaggggaagccgagtccgaggctgagcccgtgatcgtccttgctgcgggcgggacggagcgactcggggttcgtctccgcgagatcgagcgcctcgaagagttcgcgctcggcgcggtcgagtacgttgaagggcacgaggtcgttcagtatcgcggtggcgtcatgcgtctcgtccgcctcgctcacctggtcgggctggcgtcccagcctgcgcgccccgacccgatcaacgtgatcgtggccgttgatcctgctgggcagctcgtcgggctcgtcgtcgacgaggtgctcgacatggcgctcgccccggtgagcaggacgcacggcgcgatcgtgctcgacggcaagctcgtccgggtcctcgaactcgacgcgctgctcgagcgtgcgggtgaggtgagccatgtctgaggtctcgacgctcgcgaccttccaggtggcccatctccggttggcgctcgatgtcgagcgcgttcaggaggttctgcgccgccaggaggtcacgccggtgccgctggctccgagttcggtcgaggggctcatcaatcttcgaggccagatcgtgaccgcactcgacctcgccgacccgctgggggtgaccgagtccgggacccgcgagacggcgttgatcgtccgtgtgggcgacgagctgctcgcgctgctcgtcgacgacgtcggcgacgtgatcgaggtgcccgacgagcagcgtgcaccgatcccggagacgctcctcccaccgctgtcggacctcgccgccaacgtcgtcgtcggcgctgacgacgtggtcgtcgtgttggacctcgagcgactcctcggtgcgttccgttgaggtcactgctcgtcgtcgacgactccggcgtcgtgcgcatgatggtgcggcgctggctgctggaggcctgtcgtgatctcgaggtcgtcgaagcctcgggtggtcgagctgcgctcgagctcctcgagcagcgcaccgtcgatctgatcctccttgatgtcgagatgcccgacctcgacggcctgagcgtggtgcgcacgctgcgcgtccggggcgttcgtaccccggtcgtgatgttctcgaccctcacgagtcgcggcaccgacgtcgcggtggcggcccttctcgccggcgcaagcgacgtcatcgccaagccgcaggcatcgaaccagggcgcgggccgtcaagcgctcgtggaacgtgtctgttcgttgctggcggccgaggaggagctcatcgtggccgcggcaacccagggcgtgcctgcgtcggcccgggtcgtcgagcccgccacgccgcgcgtgggcgcgggtgccccacgcatcgcacaccgcgtgccgtggcaggccccggcgatgcgcacgagcccaacaccgcgtcgtcaggaggtgccgacccatcgtgcggcacctccgctgaccgtcctgcgccccagacggccacaagccccgggcctcgtcgttgtggcctcatcgaccggtggaccccaagcgctggcttcgttcctcgcgggcctcggtcgagtcgcggtgccgacggtgtgcgtgcagcacatgcccgccagcttccttccgctgctcgctgcccgcctcgccgagcagctcggctcggacgtcgccctggccgaggacggtgaggtcgctcgcgcgggcaccgtccgactcgcggctggaggccgtcatctcatcgtgacggcggatcgccctgacgggagccttcggctgggctacgtcgatcaaccaccggagaactcctgtcgcccatcggcggacgtgctgtttcgctcggccgccgcgaccggcgtgcgagcgatggcggtcgtgctcacgggcatgggggccgatggggccaagggtgctgctgccgtcgccgaggcgggcggtgtcgtcgccatccaggacgcggcgagcgctgtcgtctgggggatgccgggtgcggtcgatgccctcggcgtggccagcgtggttgcgccgccagccgagctcggcgaccgcgtccgtcggctggttggcatgccctgatggtcgatcccggcgtcttccagcgcattcgtgcgttcctgcgccgcgagatcggtgtcgatctgggtgcggatcgggcctatctggtcgagactcgcctcggttcggcgcgatcgctcggccgttggcgctcgatcgatgcgttgacgcaggccgcggaggccggcgacctcgaggcgcggcgtcgcttggtcgaggcgctcgtcaccaccgagacgttcttcttccgagacagtgcggccttcgacgcactgcggacgcgcgtcttgcctgagctgttcgagcagcgccgcggtggcaccatcgcgatctggtgcgctgcgagttcgtccggccaggagccgtactcgatcgccatcttggtggcgagccgatttccgtcactgcgctcgcgggtgcgcatcctcgccaccgacgtctccgaggacatggtcgagcgcacgcggcgcggggagtactccgcgttcgaggtgcagcgcggcctggaaccgcggatgctcgagcaagccttcgtcccgatcgccggagggtttgccgtacgcgacgagatccggcgcatggtcgaggtccgtctcctcaatcttgcccagccgttcccgtcgatcgggcccttcgacgtcgtcttcgtccgcaacgtgctgatctacgtgccgccaacggaccgacccgccatcttggcacgcgtcgcagaacggatgcggcccggcgcctacctcgtcctcggcaacggtgagtcggtcggccctgaggtgcgcgcgttcgagcgcgcgagtgacctccgggcaccgatctatcgtcgggtcgacggagtttgccgagcaacgcagcatctgcgagactcaagggcagcgccgagccgaggaggagggggtgccacggggtagcgtcgtgccgctttcccagagcgcgtaccagagcatcagatctgccatcgtggacctgacgttgccaccgggatcgttcttcctggatcgagacgtcgcggatctggtcggtgcctctcggacgccgattcgtgaagcgctcgcgcgtctcgaggtcgagggttgggtcgagtcggtgccgcgcaagggctttcgcgtgagcggcgtggacctcgacgaggtcagtgagatggccgagatggtggccgggatcgaagcggcgggctgcatcagccttgccaccgagcaagatcgagtgcgtacctcgctgctccgtgagaccaacgcgcagctcggcgtgttcgccgaggagggcaacgtcgtggccttcctcctccacgacgaccgattccaccgactcaccgcggcgggtgggctcggtcatcggctcaccggttcgatctactcgctcttgatcgatcaactccatcgcgcgcgccgactgcgccccgcgtctcccggtgacctcctgcgtcacgtcgaggagcatcgcctgctcatcatgtcgctcgagctcggtgatgccgaggccgcggcgctgatctgtcggggccatcgtcgccgcatggtcgagcgactgcgcacgacgatcgagagcctcggacgtgaggtggtcgagacgacctcgatgctggtagacgccgcgggtgacgagacctcgtcgagcgcgagcgatgaggaggccgcggtcggtgacgcggcgcgatcggacgccaaggaacccgaggaaatcatcggccagatgagcgctgaggccgccgagcgttcgcagcgtcgtcgggtgaggctcgggcggcgacgccgcagtgagggaggctgaggaccaggaggcgtcaagcgtaggccgcgccgtgccgataccacgatggaagaacgagtggcgcaaggaggcacggtgaagattctggttgcggacgactcgcgggcgatgcgcatgatcgtcattcgacagctgcgtcacgcggggctcgacgacgccgagttcctccaggcagagaacggcttcgacgcgctcgagctggtgcggcgcgagcagcccgatctcatcttgtcggactggaacatgccggagatgaacgggctcgagttcctccaggcgcttcgctccgagggcagcgacaccccgttcggcttcgtcacgagcgagggaaccccggacatgatccggatggctcgttcggctggggcgacgttcctgatcgccaagccgttcacgcccgagggattccgcgagacgctcgagggtgcgggggtcttcgcgtgagcggtgtcctcgacctgtggtcgacggcactcgccgacggcgtcgcctcgatgcgtgaaggcatcttcgcgctgttcgatggcgtggtcgagcaggttcccggagcgagcgtcgagggcctgccaggtgcgtgggtctcctacgtgggggagcgcctcgccgtggagtttgccctcgtcgcgccagacgtgaccttggtggcgctcacggcggccctgacaggcctcgcagagccctcggaactggccgtcagcgacgctgtgatcgagatcgcgaacatgctcggcggcgtcgccaagcgtcgcctcgtcgccgctgatccgacgttgcgcaccggcatgccgaagttcctctacgccggtgcggtcgtgccacgccagaccgattcgctcgtcctcgaggccggcaccgtggccggtccggtgctccttggcgccatggtgagccgcgcagcggatcgcgagcttgcggagctccacccatgaccgtcgctggctacgacgtaccgttgctcccacgcctcgacgacctcgagcggttgttcatcaccttgctcggtcgagaggtgcggatcaaccgactgcgccagggcgtgacgatcgccgagcccgatcgcatcggcacctatgtggaccgtagcggcgccctccggtgcgtcgtggccgtcgatcgcacgctcggtgctggcctcggcggagcgctcgcgctcatccctcccggggcggttgaggaggacctcgccgagtccgacgagctgcccgagcacctcgcggacaacctccatgaggtgctcaacattctcgcgagcgccttcaacgagacgcgcgagcgggcgctgcacgtgcgccttagcgacgtcgtcaccgccagcgagggctcggaggcagttcacgcactcctcgcaggaggcacgggtcgcgtcgactgcgacgtcatcgttcctggctatcccggcggccaactcgcgattcggatccagtgatgctcgttcgcgtctgtgaccacgagcgtgtgggggccgacggtgcggcgtgggtgctcgttcctggcgagtccgtccctcccgaccagatcgctgctgcgcctgccgtggtcatcgtggtcgaggatgcgctggtcgatgcgcggagcgcgcggcgtctcgtcgaactcgcgagccagggggtcgtcgcggtacctcgctcgccgagtgtcgtcggcagaggacatgtcctgctcacgaccggtgacgacgtcgggaccgtcgagggtcgtgaggcgctcgccgaacgagtctcgaagcactttgcgggcctcaccgaggacctcgagctggtgcccacgctcgccgtggccgtgcccggcgcttgggcagcgagagcgctggacgaacgttggacgacggtccatgagctcttcgcgcggctcgtcgactcacggccagccgaacttgcgttcgatgccgtcgcggtggcgcggcgtcccgttgaggggctcgtgccggctgcaccgcggcgacgccccctggtgtcggcctgcatgatcgtgcgtgatgaggccgtgtggctcgctgacgccatcgattcgttggctggcttcgcggacgaggttgtcgtctacgacaccggttcgaccgacgcgacggtcgatgtggctcggcgtcacggggctcgtgtgatcgagggcacgtgggatgacgacttcggagcggcgcgcaaccggagcgcggcggacgcgcgcggcgagtggatcgtttggctggacgccgacgagcgcctcggtggcgatctcgccacggcccgggcacgtctcgcagacccgctagcgcagtgggagggctacagcgtccggatccgcaacctcacgggtgtggggctgacatgggcggatcactttgcgatgcggctctttcgccgtgcggcgggcgcctggcgcggagccttgcacgagacggtctggtcgcgtgatcacgctcggccgctcaacgcgcacccggcgagcgagctgcatctcgttcatctcggctacttggacgtggtgatgcgccaacggggcaagggggagcggaaccttcgggttgcatcgcacaacgagtctgcgtccgaaccgctcgaggcgctcgtgcacgagatccgctcacggttgctcgccggtgagcacgccacggtcgttgcgctggtggaggaccgggtcctgccggctcctcctgggccgttgcgcaagctcggactgctcgctggcttcgagagcgccctcgcgctggggagcttcgacgtcgcccgtaccttcgtcgacgcattggccacgcagcccgatgtcccagccgccttcgcgctcgaggcgagcgctcggttggccgccacgaccggcgacctcgagggggcccttcgcgatctcgccggcatcgacacgcgcgtcgaggatgtcgacggtctcgtggtcgatcccgagcgccttgccggcctcaccgctcgctgtctcgccgggctcggccgcttcgatgaggcgagcgacgtcgtcgtcgcggcgctcgcgcgtggcacggtcgacgtcgatcttcgcgaagtcgtcgcctggttcgaccacgccaaccgaccactcgccgatcttgagtccgcgatccatcccgagcagcgtcagctcatcgcggcctcggtactccccgctgcggagcttgccgagcgtctcttctgggcgttcgtcgaggcgaaccccgcttgcaccgtctggcttgccgcgggcgagctggcagcgcgacgcgtcggcggcccggtccacgagcggtggcgtcgactgctcgccgacgccggcctcgtaccgagtgcctagtaggggtgcactggactgtaacgcactggactgtcacgcgcgggcgctgcaagagccatcggctccaggcgggaagagagtggcgcctccgggacggccggcgctggtgtgcggcgtcctctctccggtggctggagcagagatcgcaccccggtagctccgagtggcgccagccactgcctcgcgcgtcgtcgtccccgacgcaggcgagggctccggtgccggtcctctcgctgcgcggacggccgtggggcgtggtggcgcgtgcggaaggccccggagcgagccctagtcgtcatccacgtggataggagcgctgctcgtgtcggtttcgcgagccgtgcggggccgtacatcttggtcggtgcgacgacgtgagctcctcgccggggatgattccagaatctgacccatcccgtgctccgctggtgggtgtcgatcgggagagggcagagcagttcaagcacgcggaggagcgtgactgacgcgaaggaagccttctcggccctcaggcggtggtggcgtcgctcaaggggagtgtgacgtcatcgaatgcgagttcatggccctgacgcaggaggcgcaccgtaccgactccgacgcgctcgagggtgccgtcgcctcgaacgacgaggcccgtctcttcatcgatctcggcaaccgtgacgttgggtggagcaagacgaaccgtgcggcttcgtaggtcgcgtggccaggtgtcggcgtgcgggatgacggcgagaccggggatcatcccgagccccaccgtgagcgcgccaccacgtgggtcgaccatgggatcgccgatgaccatcgccccagccgacgaggcgaggacggtcgccccctgatcgagtgtggcgcgcagtgcatcgaggatcggggtcgcgcgcagcacgcctcgcaggtgaaacggtgagcccccgatgaggtagaggcaccgcgcggtgcgaaccatgtcggcgagcaccggatcgaaggcctgagcgcgctcgtacagcggtagctcgacgacgcgaacccctgctgccccgagtacggattgggctcgttcgacggcgcgttcgggtcgctcgaaggcggccgctgtcgggacgagcagcagttcgccccctgcctcggtggcgaacgtcgcttcgaagctcgcgcgcgaaccgaactcgccacccccgaccaacacgatggttcccagccccacgtcgaggatcctaggccgcgaccgtggcgagcgcgccggccacgtccccgataggatcgcgccatggagggcagtgatccacccttgtcgatgcccgatcccgtcaggcggctcggcgtcgtcggtacggggacgatggcgaccggcatcatcgaggtcgccgcgcgaaaggccatcgacgtcgtcgtctgggcccgctccgaccagagcgcgtcagcggtccgggagcgcttgcaagcccggctcgcgcgcgaggtcgctcgtggcgtcatcgctgagcaggccgcccatgaggtcggggagcgtgtcagcatcacgcgtgcggtggatgacctgggtgggtgcgaggtcatcgtggagtcgatcgtcgaggcgctcgagcccaagcgggttctgttcgcgcagctcggctcggtgaccggtcccgagacggtgctcgcctccaatacgtccaccctcggcatcgggcagctcgcccaggtcaccgagcatcccgagcgtgtgtgtggactccacttcttcaaccccgtgacgcgcatggagctcgtggaggtggtccggggtctcgagacgtcgcccgcgaccatcgctcgtgcgactgcgttcgcggtgcagctcgccaagacgcctatcgaggtcgaggacgaagccggcttcgtcgtcaacgccttgctgttcccctcgatcaacgccgcagtccgcctggtggagcgtggtgtcgcgagtgccgaagacgtcgaccgcgcgatggtgctcggcgcgaaccaccctctcggaccgctggccctcgccgatctcgtggggctcgacgtcaccgtcgcgatcctcgatcggctctgggcggcgactggagacccggcgctcgtgcccgcgccgacccttcggaggctcgtcgcggcgggccggctcggtcgcaagagcgggtggggtttctaccgttacgacggaggggatcggtgatccgccttcccgagcccgaccgaccctgggtcatgcggacctatgcgggtcactcgagcgcccgggccacaaacgcgctgatgcatcgcaacctcgcacgcggtcagaccggcctctccatcgcgttcgacctgcccacgcaactcggctacgaccctgacgacgcccttgctgagggcgaggttggcagggtcggcgtgccgatcgcccaccgcggcgacgtcgccgaactcttcgacggtctccggctcgacgccatgaacacgtcgatgaccatcaacgcaaccgccccctggctcttcgccctctacctcgaccgggcgagcgaggaggggagtgcgtggggggcgctggcgggtacgacgcagaacgacctggtcaaggagttcctctctcggggcacctacctgctcgaccctgccaactcgaagcgagtcagcgtcgatctgatcacgttcgctgtcgagcacgtgccgcgctggaaccccatcaacgtctgttcgtaccacctccaggaggctggcgcgacgccggtccaagaggtcgcgatcgccctcgcgacggcgatcgacgtgctcgatgccgttcgagctcgcggcgtcggtgacgacgtgctcgcacgagccgtgggtcgcatgtcgttcttcttgaacgcaggcattcgcttcatcgaggaagtcgccaaggtccgggcattctcccgcctctgggaaggcatcgttcgtgagcgctatggcatcaccgacccacgtctcgcgcgctttcgctatggggtccaggtcaactcgcttggcctcacggagctccagcccgagaacaacgtctaccggatcatcctcgaagcgctcggggtgacgctctcgcgcgatgcgcgggcgcgggcgttgcaactgccggcgtggaacgaggcgattggcctgccgcgcccggtcgatcagcagtggtcgttgcgggcgcagcagatcctcgcctacgagaccgacctcctcgcctacccggacatcttcgagggatcgtacgtcatggagcagctcaccaccgagctcgccgatgcagccggcgccgagctcgagcgcatcgtcgccgacgggggtgcgttcgcctgtgtcgacacgttgaaggcggagctcgtcgcgtctcaggccgagcgcctccgagccatcgaggccggcgatcaggtcgtggtcggcgtcaatcggttcgtcgagtccgagccgtcgccgctgcgtcgaggcgacgacgtcgtccaccaggaggtcgaccttgccgccatcgaggcgctcatcgcgcggctgcgcgagcatcgacgccagcgtgagggacgtcgtgtcgtcgaggcgcgccgggccctcgaggaagcggctcggagtggaacgaacgtcatgggacccacgttggagctcgtccgtgccggcgggaccaccggtgagtgggcggcgacgctccgcgacaccttcgggtcctatcgcgccccgaccggtgtgggtgcggttgccgaacgcctcggccggcggggtcggtcggtgtccatcgtcgcctcgccgccgccgcgcctcctcgtcgccaagccgggactcgatggccactcgaacggcgcggagcagatcgcggttgcggcacgcgatgcgggtttcgaggtcgtctaccagggcattcgccagcaacctgccgacattgcggcggtagcgcgcgacgaggacgtcgacctcgtcggcctgtccatcctctcgggctcgcaccgcacgctcgtaccgcaggtcctcgaggcacttcgggcagctggcgtgacggttccggtcgtggttggcgggatcataccgccacccgacgcggcctggctcgaagagcacggtgtggctcgcgtcttcacaccacgcgactggcgtctcgacgagatcgtgcgcgagctcgtcgtcctcgcgcgtggtgctcgctcgtgagcggcgtcgctgctcaagccgacgagccctgtgccgatgattgggcatatgcggcggttcgtcgacgtggtggcagcggtcctcggtctcgcgggggtgctgctcggggtcctcgggactcgtacgcaggtggccaacgatggactgctggggtcgctcgtcggcgccctcgggatcgtcgtgctcctcgttgctggagcgcgacgcctcgagcgcagacagctgggtcacgacaaggcctcgacgacggggggtgagaggactatgacacagtcggcagcgtcgagcgacctcgaggtcgtcgtcgatcgcgaaacgggactcatgaacgcagccttcttcgctggtctgctcccgacgaagctcgcgacggcacgacgacgtctctggccgctcagtatcgtcttgatgcgggtcatggaggctgaaggcgaggcgagcgccgagggtcctgcgaccatggccgggtttgccacttcggtgctcgagaccattcgcgctgccgacgtggcgtgtcgggtcgggggcgacaccgtcgcgctcgtcctcgacgacaccgacgaggacggtgcggcatgggtggccgagcgggtacagatccaggctgcgcgttcggggaatgccggcatcgccaaggtctgctgtggcgtcgctgcctatccctctcatggcatcgaggccgacgaactgctcgccgtggcgcacgaagcccttgcgcgttccgtcgccgaggcggaggggccggggctcgggccggtgatcgtggctccgacgcgtccgctctagcgacgagccgaggtggcacatgtcataagctggcgcctggtgagagtcgggtgagtggcgagcctacgacgtgagtgatgcgtccgagcgtgtcgtgctcatcggcttcatgggggcgggcaagaccacggtgggtcgcttgctcgctcgtcgcctcggtgcagacttcgtcgacgccgatgacgcgctcgttgccgagaccgggcggtcgatcccggatctgtttcgagtgcgtggcgaggtcgggtttcgccagctcgagggggatctcctgggtcgcctgctcaggtcggcgcgtggcgtcatcgcgctcgggggtggggcgatcgagcacgacgagctcgcggagctcgttgctccgtggctcgtgatctatctcgaggtcccctacgacgttgcccgtcagcgagttggatcggacgacgggcggccgatgctgaccaggtccgatctcgagtcggtctaccgacggcgcgtcgctcgataccggcgactcgctgacctcaccgtcgacgccaccgacgcaccgtccgtcatcgtcgacgagatcgtcagcgcgtttggtgcgctgggcgacggctgaggaagtcgtagagaacgacgaggaagagcgtcaaggtcatcacgtggacgctcgtgcaccagaggcagatcgatccgatcttgacgatctcggcgtagaccagccaaaggacgaacaccacaccgaccccggccagcgcgaggcgcacggcgtcgagcgcgcgatggcgccacgcgaacggcagcgagagcactcccatcgcgaggaagaatccaagacccagcaccgcgaccgggatgccgaggatggtcgactcaggcgaggtggtgaccttggcgcagttgacgatgccggtgtcggggcacgcgagcgtcacggtggtgtcgtagtgcgcgatggtgagatacgtcgccacgcccaggcccgcgagcgcgatgagggcgacgaggccgcgcacccatcgcggtggcgtggctagagctgcgactcgaggtgcgagatcactggatcggtgcatacggcccctggtgcgttgtgggtgagcgtgcagaacgcggcggtgaactcgttggcgagcgagtcgattgcctgggcgggcttggtcgacgggtcgcgcaggcttgctgcgatcgtttgccaactcagcccatcgaggatcgacggcgtatagctcgcgccgatgtcgaggaacttgccgcccatgtcgatgaagggaatcgatccgtcgtactgcgtcgacggcacgtacggaggggcatcgagcttggtgagcagtgcctgctcggctcgggtcggagcctggagggcttggtaggtccgcgtctcgatctcgaccgggacgaagctcaggtaggggctcgtgtagtgcgaaccatagaaggtgaaggtcggggtgttcgcgaagacatcggtcgacgacgagcgcatgaggtgcaggttgctgaacgtcccaaaccgagagagtgcgacgatgagcccccagcgttcggcggcgcagtagggacagtagtcagcgccgatgtagagcacttccggcttgccatcggcggtgagcgcgggctggccggccagccgatggaacgtgctcacgacggagctgtcgaagccgaccgcgtcgagcgccgagcgaggtaccgaggtgatcgccgtctcgacatcggctgggaccggggcattgatgctcgatgcgtcctggctggttccggaggagcgtagggcgaagaaggcggcgacgacgacgatcaccacgacgacgaccacgctcaccgcgatggcaggtcctcgacgagtcgggggccgttgtgcggttcgcgctcgagccgtcatggttcgctcctttgctaccgtcgtcgacgatcgccagcctacggcttcgatcgtctcgatggctcgcgtctgactcagggaacgctccgaggatgcagagcaacagctgaatcggcgccggctgcactgctagcgtggcgccatgagcgcactcgatcggctccgggaccttggcatcgaactcgttgcgccaccaccagcggtggggtcgtacgtgcccacgctggtcgtggacggttggtgctgggtgtcgggcatgctcccgctcgccgacggctcggtcgtccatccgggcatcgtcggcgccgacgttggtctcgaggaggctcgtgaagctgcgcgcgttgcgacctcagtcctgctgtcgcgtctcgcggcggatctcgggtcactggatcggatcgagcagtgggtctcgctcacgggctacgtccagagcgctccaggattccacgatcagccggcggtgatgaacgccgcctccgacctcgtggtcgaggtcttcggcccggcggggcgacacacgcgcgccgcggtgggggttgcggcgctgccgctcgcagcaccggtggagatcgcagcagtcctgcgcgtccgctagacgtccatgctgggcgttcggcggcgctgacctgtctggcgcggccactgcgccagcgcgagcccgatcgcgacgagcgcgacgccgacgagtggtcgaggaccgatcggtgtggtgtggagggcgagccccccgacgagggcgcccactgggatgagggccacgtagggcgcggcgcgtgcgacaccgagacggtggatgcctcgaaaccagaggacaaatgcgccgacggtcacggcgagcgcgatggcgacgtcggcggcggtctcggtcacggtgggggcaggcggcactccgccggtgatgagtccgatcgcgacgaggccgatgcccgctgcggcagcgctcacggtggtgagctcgccaggttcgaggacgcgcaagagcggcgctgatacgagggtgaaggtggcgtcgctcgcgagcgcgacgactgcccaggcaagtccggcgggcgcgaggctgcctgcgccgttgaccacgatggcccccatcgtcgcgatcacggtgcccgtgatgagcgctcgagggatgccgcggcgagaggcgagtgcagtgcccgcggcgatcacgaggggagcgaggccgaccacgacgccgacgcctgccgcggtgccgtggcgcaacgcctcgatggtcgccacggagaagagcccgagtcccacgaccgtatcgacgacgagcaggagcagcatccgcgcagggaggtgacgctggagcggcagagcccgccgtcgcagcacgatgacgagcaccacggcgccgatgaggtagcgtgccccctggctgatgagcggtgggtaggcgacgagcaaaccggaggtagcgatgccgagcccgacgagcaacggggcggctccggcggtgaggtgagcgccgtagctgggatcatcgcgtggcatcactcttaccttacggctggctcggcgtgcgggccctcgggtggatcccgtagactgagcgcggcactcggggagtggaggtgtgcgagatgctgagtgagcgggtagttcgagccaggactctcggggacgtcgtcgcgcccggggcgctcgcgcgtgtcgtggcggtcgtcggctacgcggccttcatcggagtgctcgcccaggtggcgatcccgctccccttcacgccagtgccgatcaccggtcagacgttcgccgtcctcctcggggccctggcgctcggtccggggctcgccttggcgggcacggcgctctatgccgcggtggggctcgcgggggtgccgtggttcgcgggagcgacggggggcctccacatggtctctgatccatcgttcggttacatcgtcggtttcatggttgcggcggccttcgtgggctggctcggaacgcgtggtgcggatcgtcgaccgctcaccacgatcgtggcgatggtggtcggcaacctcgccatctacgccgtcggtgtcgcctggctcgccgtcgcgctcggcgtctcgctcccacgggcgctcgaactcggcatggtgccgttcgtcgtcggggacctcgtcaaggtcctgctcgcggcgggcctgctgccgggagcgtggttcgcactgcgccgtctcggtgcacgtggtgtcgaggggtcgcgtccatgacgcactccgtcgcggagcggctcgaggagctgcggcggcgtcgtgaggaggcgtaccacgccggcagcgagcgtgccgtcgagcgccagcacagccagggcaagatgaccgcacgcgagcgagtcctctacctgcttgacgagggatcgttccaagagctcgacctgctcgcgcggcatcgggcgcacggccttggcctggaggagcgccggccctacacggacggcgtcatcaccggcttcgggacggtgaacggtcgcaaggtctgcgtcttctcgcaggacttcaccgtcttcggcgggtcgctcggggaggtgttcgccgagaagatccacaaggtcatggacctcgctgccgcgtgcggcgtgcccatgatcgggttgaacgacggcgcgggcgcacgtatccaagagggcgtggtcgccttgcactcttacgggggcatctttcgtcgcaacgtcgcgagttcgggcgtcatcccgcagatcagcgtcatcctcggcccctgtgctggcggtgcggtgtactcgccggccatgacggacttcatcttcatggtcgaggggacctcgcacatgttcatcaccggtcccgatgtggtcaagacggtgaccggcgaggaggtcaccctcgaagagctcggcggagccatgagtcacgcgacgaagtcgggcgtcgcgaccttcgtgctcccggatgagaagagctgtctcgacgaggtgcgctatctgctcgagttcttgccgtcgaacaacatcgagatgccgccggccgtgcaggcgaccgacgatcccgatcgcgaggtcctgtccctgcgcgaggtggtacccgacagtcccaaccagccctacgacatgcacgacgtcatcgcggccgtcgtcgacgatggcgagtatctggagtacttcgcccactgggcgcgcaacatcacctgcggcttcgcacggctcgacggcaaggtcgtcgggatcgtcgcgaaccagccctcggtgctggccggggtgctcgacatcgactcctcggagaaggctgcacgcttcgtgcgcacgtgcgatgcgttcaacatcccgctggtgacgttcgtcgacgtccccggcttccttccgggtgtcgaccaggagtacggcggaatcatccgacacggcgccaagctcttgtatgcgttctccgaagccacggtgcctcgcatccaggtgatcactcgcaaggcctacggcggcgcctacgtcgtgatgaactccaagtcgatcggcgcggacttcgccttcgcctggccgagtgccgagcttgcggtgatgggccctcagggcgcggtggaggtcatccaccggcgcgaactcgcggccgcagcggatccgacccgtcgacggtccgagctcatcgacgaatacaccgagcgctacgcgaacccctacgtcgcggccgagcgcggctacatcgacgacgtcatcgacccggcggacacgcgacgggtgctcatcggtgcgctcgcgatgctcgagaccaagcgagaggatctgccgcggcgcaagcacgggaatgtgccgctgtgagcgagctctcgtccgaggaggaactcgctgcggtcgtcgctgcgctctgggcgcaccgggcgaggtcgtcgcctgctgtggccgagccggcccaggacgacaccaggtggcgtttccagcgccgatggtggctccagggcgtcctgtcgctccgtcagcgacctcgtccgacgctgtgacagacgccttgccgccgagctaacctcgcctccgtgtcgaccatcgatctcgctgcgtatgtcgacggcgtgagccttgcggccgcgttgcgccgtcgcgaggtgggcgtcctcgaggtgctccaggcgacgctggagctgatcgacgagcgcaacccggcgctcggggcgatcgtgtggctggaccgagacgacgcccgccgccgggcggagcgggcggctcggcgcctcgacgccgacgaccccgcaccgttcctcggagtcccgctgccagtgaaggacctgcacccggttgcgggatggccgatcacctacggctcgtggggaggtccggagggggtgagcgcccggagttcgatcgccgtggaggcgctcgaagaggctgggttcgtcctggtcgggcgcagcgcgacaccggagctcggcgaactgcccgcgaccgaaggggatcgctacggggtcacgcggaacccgtgggacctgtcgcgcacccctggcggctcgagcggtggtgcggcagcagccgtggccggcggcatggtcaccgtggcccatggttcggacggtggcggatcgctccggatccccgccgctgcgtgcgggctcgtggggctcaagccgagccgaggtcgtgtgccggcgcgctcggccccctggttcggtctctcgacggaaggtgtcgtgacgcgcagcatccgtgaccaggcggcctgtctcgcggtgctcgccgctccgcgtcgcggtgcctggctcccgcagccgcccgctgggttcggcgacggtggctggcacgtggcgccgacgcgcctgcgtgtgggggtcgtcaccgaaccaccgttcggcctcccgatcgacgatgcccggcggctcgcggtcggcgaggttgcgcgtctcgtcgccgatctcggccatgaggttcgggaggtgaccctcgcgttgcccgacgagctgatcgaggccgtctcggtggtcgttggggcaggcgtcgccgagcacgacgatctcgattggagtcgggtcgagccccatacggcggccgagtacgagcgggcgaaggcgttgccggcgaccgagctggttcgccagctcatggtgctcgagcgcacgggctcagacctcgcggcagccctgccaggcgacgtcgacgtgctcctcacaccgacgacagcgatcgcccctcccccggtcggtacggtgctcgaagcggcgcatgcggccgcccacaccggcctccctgcgctcgaggtggtgtcgctcgcgatcttcaccctgccgtggaacatcgctggcctgccggcgatctcgctcccgacgcacctcgacgtcgatggcttgcccatcggcgtccagctcgtcggaccgcccgctggcgaggcgacgctgctcgcgctcggggcggcactcgaggaggtctacgagtggaccacccgacgacctcccgttcagcgctagcatccgagcccatgacccttgcggaccctgtgtgggtgcgccgatggctcgaggatcacggtgtcgcgttcctcgagcgcttcgtcgccctgaacagtctctcacctgcgttcgatccggagtgggagcgccacggcacgctcgccgccgcgatcgacctcgctgcggagacggtcgaggccgctggtttcgaaggaaccgagatcgtgcgccagacgatccccggccgatcgcccgccctggcggtgcgcatccccgggcgcgggcacggtaccgccctcgtctacggccatctggacgtgcagccggccgtcggcccgtggcgtgacgggagcgatccccatcgtgtggtgcgtcacggcgagaggctggttggccgcggcgtggtcgatgacggctacagcgtcgtggcggttctcgccgcactcgagggactgcgggcgatgggcgcggatgccccgacggtgtgggcactcttcgagacctcggaagagagcgggagcccggacctcgatgcgcacctcgacgccctcgccccgaccatcggcccggtggacctcgtcgtctgcttggacgcaggcggtctcgacacaaagcggctgtggctgacctcgtcgcttcggggcaacctcgtggtcgtcgtcgacatcgccgtgctcgaccatggcatccactccggtgaggctggaggggtcgtaccggagaccttccggatcctacgggccctgctcgagcggctcgaggatcccgtcaccggcgacattcgtgtcgatgccctgcgatctgcggtccccgagcccgtgcgtgaggcggcccgcgccctcgtcgaggcgctgggagatccgttcgccggtgcctaccccctcctcgagggcgtacgcctcgagggggcggacccggtcgaacgactgctccgccagagctggggcacggcgatcgcgctcaccggcatcgacggggtgccgagcgtggacacgggcggcaacgtgctgcgcccgtcactcaccgccaagctgtcggtgcgcatcccacccgacgtcgatgcggtccgcgccctcgatgcgttggtggcgaccctgagcgccgatcctcccaacggcgcgcgtgtgcgcgtcacgccggaggcccccgcgcagggctgggcgggggcggccctcccggactggctcgccgatgcgctggctcgcgggtcgatcgcgagcttcggtgagcccccgcgatcggtgggggtcggtgggtcgatcccgttcctcgcgtcgctgggcgagcgcttccctggcgtaccgatcgtcgcgaccggagcgctcgccccgacgtcgaacgcgcacgggcccgacgaagtgctcgagctgccggccgcgaccggcgtggcggtcagcctggccgaggcgctcggcgcactcgctcagcgatcgttctgaggctgtgccagccgagcgtaagcccacaggcgggcggagcagtggtcggagcgtgcggcgagctctctggtgatggtctcggccaccacacgcacatcgtcgtcgacgagaccgatcgggagcgtggcgagcagcggtacgccgaggcgctgcgcgagcaaggttccgcccccttctccgaagggtcggatgaggtctccgtgttcgcatcggagccaggacaggttctcgatgacgccgaggacgtcgaggttcgccttgcgggcaaaggtcccagcacgtacggcgacctcgacggcgagcggggagggcgtggtgaccacgaccacccgggcatctggcagcaggcgtgccagcgcgagcgggacgtcgcccgtgcccggcggcagatccacgacgagggtgctgggctggccccaggcgacgtcggccacgaagtgctcgagcgcgcgagcgagcatggggcctcgccacatgatggcgtcgtcggcgtcgtcgacgaggagccccatggacacgagtcggagttcgccgtcgtcgacctcgatgcgggccggctcgatctcccagcgatcgctggtccctcgcgcgacgaggcgttcgcgtcgttcggtgaggtggggctgcgagaagccccagatgtcggcgtccagcagtccgaccgcgttgccaccgtgtgtcagcgcacgtgccagggcgtgcgccaccgtcgacttgccgacaccgcccttgcccgaggcgacggcgatgacgtcggtgccgagcagcgcggccggaacctcggcccggcgctgagctgcggcccgcgcggcgcgcatggcgcgcgcacgtccggcatggtcgagttcggtttcgtcgacgatgagcgatcgtccgggggcgagctcgtcgacgatggccccgatctcccctcggaagcgagcgcgcgctggacagccgagcgtggtgagggcgatccccacgcgaaccgtcgttgccgtgaccgtgacatcgccgagcatgccgagttcggagagggtcgcgtcgagctcagggtcgcgaatcgcgccgatgcgagctcggagttcgtcgatgtcgacgccggccgtcatggctcacccgccgactcgaccggcagtgtctcgccaggggcgagtcgcgtgggctcgacgagcccatagcgtgggtcgccgggcaagaggatgcgaacgacgtcgccgtcgcgccagaggcgcggctcgatccgcggcacccgctcgagcgctcgggcccgtgcgagtgcctcggcgaccgagcccacgtcggcgaggaacgtgacgttcgccaccgtcggcgggaccatggggagcgcacctgcctcgtggtctcggagggcttggctcggcgcgagccagcgagcctcggtgacctccccggcgtcggcggacgcgtcctggtcgctcggcgctgctgccacgaagaagcgcgtgtcgaagcgccgtggactcccagccggggtcacccagtgggcgacgtagccgagcacggccacgtcgattccctcgaccgctcgcacgacctcgcggaagccgatggtgccggcgagcagacgctggcgcagttcgcccagacgatcggccccgagcgacacctgggcacccaacagcacgcccgcttcttcgaacgcttcgcggaccgcggcgacaccgagggccgcagcacggggctcgtcgggcatgtgcgctgcgaggtcggcacccgagcgcacgagaccgtcggcgacgagcgcttcgtcctcggcgtcgagcgacccgcccgggaacacgtaggtgctcgcgacgaacgcggcgtccttcgatcgacggagcatgagcacctcgagcccggtcgtcgggttgtcgcgcagcaccatcaccgtcgaggcgggacgaagttcgtcagtcactggtcgggaaggcgggatttgaacccgcgacctcagcgtcccgaacgctgcgcgctgccaaactgcgctacttcccggtgtggcttagtctacgccagctcctccggggctgctgcgccagcgacgccgagcgcgacggagctcgccggcaccggcgccaggacgggctggtaggagtggtcgatgaacacaccgccctcgaggacctcgcggacggccgtccggatgaggaccgggcttgcgggcctcacgacgaagccgtcgacacgagcgcgtttggccgtgaagacgtccgcccgacgatcgagcagcagcaggacgcgcgtcggccggagtcggccggcgtcggcttcgagccgaaggtccaccgtgcaggcgataccgcccatcgtgccgatgtgggcgtcgagcacgacgagttcggggtcgagttcggcgaccgcacgccgaacgcgacgtccttcgtccacgccccagagttcgtagtcgccgtcggcgagtgttgcaacgagctcgtcgcggacttccggagcgtcggttgcgatcaggatccgtgccatgcgccgatgatcctagtgttcggggctcgcagattccagctcgcgctcgccaagccgtgcgccgaggcgtccgagggcctcgaccgacgcgatcggctcggcgagatcgtcgaccgcgagtaggtcgaccgggccgagggtctcgcgcacgcgcccgagaccgcctcggcgtgcgtcgaggagtcccatggcagcgcgacgcaggtccggaggcgcgtcggggtcgctcgggagcgagccgagatcgggcggcagacggttgacgaccacggcgcgaacgtcgcgttcgagctcaccgagcgccgtgcgcagccgacccgccaccgccatggcgtcctcgtggatcgtggtcacgagcaggtagcccgttctcgcggaggcgagcagctcctcggtctgggtggcgcgctcgcgaaaggccccttcgagtcctccgaacgcctggaagaacgcgatagtgtcgtcgaccacttgggcgcccaccacagaggcgatctgacgaacgaggctgcgggtggcgagtgccagcggtcgcaacaggagcggcggttggcgaaggaggagacgaaagacccgattgtcgaggaatcgggcgagtcgactcggtgcgtgcaggaagtcgatggcccactgcgcgggcggtgtgtcgaccacgatgacgtcgtagcggcccgtggctcgcagctcccacaggcgctcgaaggccatgtactcctgggtccccgacagtcgtgagacgaggctcgcgtagaccggactcgagaggacctcggcgacctgctcgggcgagttcgcccctcgccggaccatcgcctcgaaggtagcctgggcgtccagcatgaccacgtcgaagcgtgcgctccccacctcgacggtgaccgggtcgttgccgacccccacgaggccgagcgcgtccgcaaggcgtctggccggatcgacggtgagtacgcacgttcgccgcgaactcgcaaggagtgcgccgatggcagccgccgtcgtcgtcttgccgacgccgcccgccccgaccaccacgatcgtctcgaacggctggagtgcaccggtgagcgtcgtcacggctcgacctgctcgaggtggtcggccagcgcgtcgaggaagtggccgtggggaacgagatcgaggtgcggcaggacgaagctgcgcgctccgaggacgtcgcgggccccttcgagctgcgtctgggcgagcgcccaccgctggcggaggtagctggcggcggttgcctctcgagagcctggtcgagctgatcccgcaggcggcgcaaggggcatctgattgaccacgaccgagaggacgttgatgtcggcgcgcgtcgggagcgcctcgaggagctcgcgcgtctcggcgatcggcgtctcctctgggatggtcacgacgagggctccggtggtgtcgtggtctcctaggagttcgatgacctcggcgctctgctgggcgatcggtccatcggacgcgatatcggcgagcccctcgggagaactcagcaaggagagggcatggccggacgctggcgcgtcgaggatcacgagatccagggtcgccgcgttgacgagctgcttgaccttggcgagcaggaggaggtcgcgaatacccgggatcgcggtcgcgacggcgtcgagcaccccggcctgcaccagccgcccggcgagggcgccgaagccgtgcgtctcgaggtattcgagcatcactgcctcggggcgcagggtgaccgcgcgaacctcggggtgctggcgcggtgcgtcgtcgacgtggacgacgagcggtcgaaggcctgcacgctcggccaagaggccgacgaggagggacacggtcgtcttgcccgtcccgcctttgccggtgacgatgacgagtcgagggtcgccgacgagcgcgccgagacggatgcgcgcggtgtcgacgtccatgcctccaccctagagccggcgcagggctcgagcatgtgcacacagttgtgacgcggacgtcacacgacccttgacagcccgagcgaaggctgcataggctgcccgacaagaggtacggacaaagcgacgaggtggatggagtggacggggcgtgtcgtcgtgaccgactcggaggggcggtgcgaagatgatgcggctgatgtcgagcaggagcggcgtgctggaggggggcgagtgagccgacgtgctcggtgtgtggagatcgaccgggctccgatgtacgcctcggcgatcgagtcgactcgggcgctcgctgggcaccatgccatggcgatgcggggagcgacccctcgggcgtggggcgtagaacgctcccgtgcacaggcgagcatgtggtgtgggcgtcgccggtgcgcgtgggggtgctcgcacgttcgccgcatcagatggtcggcgggtgggcgcgtgtgaggtcgataccgacagtcggtatggctacgttggcgtagggtggtctgacgtcgtggcgtcggaccgatcgatgagctggaggggggcgtgctatgcgatcggagtcctggagggagcgagcccagtgtcggggagtcgggttcgacgtcttcttcccgccggaagatcctcgcatggaagggctcgcacagcgacgacagcgcgaggcgtcagccaagcggatttgtgcgcggtgcccggtcgcgggagagtgcctcgaatgggcgctggaaaatcgagagacgcgcggcatctggggcggacgtacggaacttgaacgcaaggccatcttgcgcgcccagcgtcgcgtgcgactcgtcgtgtgatcccgggcctgatcgagggcatgcggtatactttggacaggcacgctggttgggcaatcggctgcaccaaggtgaggagggctcatggcagtcacgagtgtgaagatcggtaagcgcccttcggtgatctcgctgacggattcggcggttcgcaaggtcgccgagttgatcgcgcaggaggacgacgccgcgtcattgttccttcgtgtggcggtggcgcccgggggctgctctggttatagctacgacatgttcttcgattccgagcgtgcgagcgatgacatcgaagcagagttcggtggagtgcgggtcgtggtcgatccgcagtcggcagagttgattcgtggctctgtcctcgacttcgtcgatggtctgcagggagctgggttccacatctcgaatccgaacgcaacgcgcacgtgcggctgcggttcgtcgttctcctaacccgcctcgttcggtctcgtcacgagccgggcagccctctggggctgcccggctcgttgctgtgagttcccctccgggtcgcatcggaggggtggagggggccgtggctcggcagcagtgtccagttggcgtggcttcgatgtctgggctggcagcgccaggaggcagcggggccgacgcgcggagggggcgcaatgggtgggattggtcgacccagtcgtggtcgggacccggtcaggcgtcgccgaagcggtagccgaccgagcgtacggtgtgaatgaggtgctcgtgcgcttcgccgagtttggcgcgtagccgtcgcacgtggacgtcgacggttcgtgcgcccccgtagtattcgtagccccacacccgcgagagcagggtctcacgggagaagaccttgcccgggtgcgatgcgaggaacttgaggagctcgtactccatgtaggtgagatccagcgcggtcccgttgatcgaggcatggtaggtgtcgagctcaagcgtgagcgggccatagcgaatgacggtcctcacgtcgccgcgtccgaagcgcacgaggaggtgccgaatgcgcatggtgagctccctggcgtcgaacggcgacaccgcgaagtcgtcgagcaggccctcgcggagcgcgaggtcgtcgacctggtggcgctcgacgaggaggagaatgggtggcgggggggcgaggcggcgcttgagttcccgggcggttccgagcgcccattcgagcccggtggttccgtcgacgaccgctgcgacgagtggtccgacggtcggcggcagtgcgtcgagggtcgtcacctcatggctggtccatccgatgagctgtgcgatgcgcgtcgcgtgctgcggcgagatgatcgcgagctgctccatgtcagatcagcgtgaggtagcgggctcgttcggcgtcggagacttgactcgccgaagcgcgccactcgtctcgcttgttgcggaggaaccactcggtgacgtggtcgccgagaaccgagcgaaccaggggcgacgcttcgagctcttccagcgcttctgagagtgtctggggaagacgggcgatcccgagtgaggcgagctcgcgctcgggcatggtgaagaggttgtcgtggacctccggaggcagctcgtagccctgttcgatgccttggaggccggctgcaaccatgagcgcgagtgcgagatagggattggcgccggcatcgggtgcgcggtactcgacgaacgtgtcctccccacgagctgcttcgggacttggaaccctcacgagcgcggagcggttgttgcgtgcccacgcgacgtgcatcggcgcctcgaagccagggacgaggcgcttgtaggagttcacccactggttggtcaccgcggtgatctcccgagcgtgccgcaggagtcccgcgacgaacgatcgtgcccggcgcgagagaccatcgggagcctcggggtcgaagaaggcgttgtgttcttcgtcgtgacggtcgtagagggctaggtgggtgtgcatgccggacccttggagcccctcgaacggtttgggcatgaacgaggcggtgatgcccttggcccgtgcggtctcggtgacgacgagtctcgcgctgatgacggcgtcggccatctgcaggacctcgtcgggcgcgaggtcgatctcgtgctgagacggcgcatcctcgtgctgagagtgcttgacggggatgccgagctcttcgagtaccacgaccgcctcgcggcgcagctcgctcccgaggtcgttcaatcgcagctcgaagtacgagccgtggtcgaggggctcccagtgtcccggggtggtctcgcggaggtagaagtactcgagttcgggggctgcgtggacgaggtagccctgctgtcgggcgcggtcgatctggcgacgcaggacgttgcgggggcaaccttcgaagggcgttcgatcgaggttcaagatgtcgcagaacatcctcgcggtgctcggtaggcccggcaccacgctgaacgtggccgggtcgggcatggcgagcacgtcggcctcgtggatgcgtgagaagccgtcgatggccgatccgtcgaaggtcatgccctcgtcgagggcggtggcaagttctgcctgcgtgatttggaaggctcgtgggatgccgagcacatcggtgaaccagagctggatgaacttcacccggcgatcctcggccatgtgacggacgtagtcgacgccgacactgcgctggtccggcacgggccacctccttcgcggtcatgctacgggggacgtccctggatcgctcgtcgcgccccgagcatttaactcggagttcacatggctctccggtctgcgtgctcgctggccataggttgggcgagcaacggcgacggatggaggagcccatgcaaccacgcgcaccacacgaggtgatcgcgatggccgaggagcagggggtcgagatggtcgaccttcgcttctgcgaccttccaggaacgatgcagcacttttcagtgccgatccgacagctcaccgaggattccttcgaggaggggttcgggttcgacgggtcctcgattcgtggcttcaagacgatcaacgaatcggacatgatcttgaagccagatccccgctcggcgtacctcgatccgttccgcaagcaccgcacgctggtgctgaactgcttcatctacgatccggtgaccggccagccctacgatcgtgacccgcgtcgcgtcgcagcggctgcggaggagcacctgcgcgcgagcgggatcgcggacacggcctacttcggtcccgaggccgagttcttcatcttcgacgacgtccgctaccaccaggacgagcactcggcatcgtacgtggtcgactccatcgagggtgcgtggaacaccgaccgtaacgagcagggctcgaacctcggcggcaagattcccttcaagcgcggctacttccccgtacccccaatggacaagttccaagacctccggtcggagatggtgctcaccatgcaggcgctcggcatcgagatcgaggtgcagcaccacgaggtcgccacggcagggcaggccgagatcgacatgcgctatgacaccctgctcgccatggccgacaagctcatgctctacaagtacgtcgtgaagtccgtcgcccagcagggtggctacaccgcgactttcatgccgaagccgctgttccaggacaacggctcgggcatgcacacgcaccagtcgttgtggcgcgacggtgagccgctcttctacgagtcgggggggtatgccgacctgagcgagctggcgctccactacatcggtggcatcctcgcgcacgcgccgtcgatcctcgccttcgcggcgccgacgacgaactcctacaagcgcttggtacccggttacgaggctccggtcaacctggtgttctcgcagcggaaccgttccgcggcctgtcgcatcccgatgtactcgctctcgccgaaggcgaagcgtgtcgagttccgctgcccagacgcgatggcgaacccctacctcgcgttctcggccatgctgctcgcggggctcgatggcatccgcaacaagatcgagccggccggacccgacgatcgcgacctgttcgacttgccgccggacgaagcccgggctctgccgacggtcccgtcgtcgctggagggctcgctggctgctctcgaggccgatcacgactacctgctcgaggggggtgtcttctcgcaggacctgatcgacacctggatcgcctacaagcgtgccgaggaggtcgacgccattcggcttcgcccgcacccctacgagttcgcgctgtactacgacgcctagcgcgtcgttgatccttcgcgaggccctgctcgtcctcgggcgagcggggcctcgttgctgtcatgggttttggtgcgatgggatcgagcgcgacacgatcgagcaacgtccacagggcgctcgacgatggccagctcaggcgaggcctgcgctcccgaggagcgcgcgcgggtcgaactcgtcgatcgggatgatccgaaccctcggcaggacgacgtcgtcgaggaacgcgtgcatgtcgcgctcgagatcgaggagctcgaggtcgtgtcggttgagcagctggcccgcgacgtactcggtgaagcaggccagcgcgacgcggtgaccgtggtcgaggagctgctcgagtgccggagcgaagtcggcgtcgtgcgaggcgagcacgacggacccgtgacgccgtccgatctcgccgagcgtcgccacgatcgcatcgtcgacgaccttgccgggacccgagaggaggaccggcgtgtagccgtgggagcggatcgcctggatgaacggcccggggatgaggcctgaggtggcgttgatgaagaagtagctcttcagcggcgccgatccccacgacgctgcggcgccagcgactcgatcccagcgaggtcgctcgttgggttctggccggtggcccaggatctggccgaggacgccgtcgatgttctcaccgtcgacgagcaagaacgtgaccggcgctaccaccccggccaccccgccgggagtgagccgaccaccggcccgtagacgatcccgcccggggcccccagtgccgacaggagctgtgagaagttgagtccgaaggccgtggagttcgagttgttccactggccggcgtagcccgcgtaggcctcgccgatcccgcccggcgccgcccagccggtctcgatgccgtcggatcccgggaaacaggttgcgatctgctgtccagcgctcaccgcttggcctacggcgaccgttgggaccacgtcctcggcgacgtagacgtagtcgccagcggctggaccgctcgtcagttgataatccaggaatacgccgttgggccagccgccttcgtaggtgctcacgatcctgccggccccgagcgcggtgatcgggccgttgcagaggtaatccacaccctggtcgatccgttcgacctggaggatctgggtgtcggcgagcggattgacgtagccgctcgggctggtcggcgttggggctggggccgacccgccgctcgggctcacgaccacggccggggtgggtgctgagtcctgggcggcacgggcttgctgggcctgggcggctgcgagtgctgccgcctcgcgctgggctgccgcggctgccgcctgggcctgggccgcttgttcggccgcgagttgctgggcgacgagctgctgaatctgggagttgacgctcgcgagctgggcctgggcctgcgcctgggcgttctgggctgcttgggcggcggactgagcctgtgcgctctgggtcgcaagatcgctcatggcgcttcgcagcgaggcttgctggagctcgagggcctgcttggcggtgacgtaggctgcaacggcggcttcctggttcgcggtcgcggcggtgacgtcggtctggatgatggccgcgtcgttcggggtgcccttggcgatcgagatcaccgacgaggacgcccctgcttgcgtgaagatgttcaccgcctccgaggcgaccttggccttgagccgggcgacgtcggcctctcggcgaacgatctgcccttggagggtggcgatctggctcttcgtcgtggcgagtttgagctgcagctgatcgtaggtgttcatggctgcctgggcctgttgatcgagcttggagatctgggcagtgagctgggcggcctcagccttggcctgggagagttgggtggttgcgtcagcgggtgtcacgttcggtgtcgccacggcgaacgtggcgatcgctgtggcaacggtcgtcgtcacaagcgtcttccaacgcacgagcgaacctccgtgcgagattcggggacctccgacgtcctcgacgaggtcatcggcatggtcgacaatcggttgagcccgtcgtgggcgccggcaccgcgagcctagcgggcgaggactcggggctcgggtgctctgtggcaatgttgccaaagttgccgtgctgcctgggaggagctcgagccgtgtcccatcggacgcggcgagcaaacggtgacgggcggtcgggacgacgggattggcggcgcgggttccgatccctgggtccgcgtggcgccgagcgcggcactatcgtggtcgcgtgcgctccctcgtgatccaggctgcgcagctcaacctgaccgtgggggccgttcggcgcaatcgcgacgcggttcgtgctgccatcgagtcggcacgtgcagccggcgtcgacgtcgtggcgttcccggagctgacgttgaccgggtacccacccgaggatctgctcctcaagcccgcgttcatcgaggagcagcgagccgcgctcgacgagctcgccgggtcctgtcgtgacatcgtcgccgtcgtcggtttcgtcgatcgcgagagcgacctccacaacagcgcggcagtcctcgccgacggtgcggtccaagcggtctatcacaagcagctcctcccgaactacaccgtgttcgacgaggctcgctacttccagcctggctcggtggcgccgccggtggtcgaggtcaacggggtgcgtctcgggctggcgatctgtgaggatgcgtggtccccgacgggtgcgatcatgcaggcagccgtcgctggtgccgaagtcgtggtcgtgatcaacgcctcgccgtacgaggctggtcgccaagccactcgcgagcggctcgtcgcggtgcgagccgccgacgcccacgtcgcggtgtcctacgtcaacctcgtcggcggacaggacgaactcgtcttcgacggcggatcgttcgtggtggacgcggtcggtgcggtcatcgcacgcgcaccgcagtttcgcgaggcgaacctcgtcgtcgagctcgagctccgaggcgaccgctaccgacagcgtctcgtcgacccgcggggcaaggtcgcgctcggcacgtcgagcgagcctgccgtccgactcgccacacccggagtgcgcgtggcgcgcgatccgatgccgctcgccccggctccggtcgacggtttcgaccccggcgaggtctacgcagcgttggtcctcgcaaccagcgattacgtgcgcaagacgggcgtaccgggtgcactcgtcgctgtgtccggcgggatcgattcggcgctggtggcgacgatcgcggtcgacgccctcgggccggatgcgctgaccctcgtggccttgccatcgcggtactcctccgagggctcgctgcgcgatgctcgtctgctcgccgaccgtctcggcgtcaccttggaggtcatcgccatcgagccggcgcacgcagcgctcctcgagatgctctcacctgccacggcgacgtccggggtcgtggaggagaacctccagagccgcgtacgcgggacggtgatgatggcactgtcgaacgccagcgggcggctcgtcctcacgaccggcaacaaatccgagctcgcggtcggctattcgacgctctatggcgacatggccgggggtttcgcggtcctgcgcgatctctacaaggaacaggtctacgccctcgcgcggtgggtgaacgaccgggcgggcatcgaccggatcccgacggctattctcgccaagccgccgtcggcggagctgcggcccggtcagctcgacacggactcgctgccaccgtacgagatcctggatcgggtgctgcgctccctgatcgacgaggatcgcaccgcggccgagtgcgagggcgtcgatcctgagctcgcgcgcaccatcgaggcgatggtcgatcgcgcggagtacaagcgacgccagggacccatcggcccgcgcatctcagagcgcgccttcggcaaggaccgacggatgccgatcgtcaaccggtggcggttgtgaccgacgagctgcgtcccaggtggctgggtggtggtgattggtggttaccgctcgcggaggtttccgaactcatccggcgtctctcggcggtgctcatcgatctcgcacgggtgtgcgcagacgcgcgcctgccggacgtattggtgagggccagcttcgagtgctcacgcgttctcggaggacatgcgggcgagcttgcccacttggacctgcatccacagcccgatctgctccagccagtggccctcgacggcaacgacgcgttcgcggcgctgcgtgatcgcctcgtcgagatcgcacccaccgaggaggccctcgacgtggatcggtggcgtgagacgctgcgtgtggggttcgacgaactcgaactggtcgcacgagggctcgggtcgtcgagcgggaccggccagacgaacctcgccgcctgggcacgcgagctgggctcgagccttgcgacatggcgcgagcaactcggtatcgacgggagcgtcggtacgaacggccgcgatcgatagcatgaatgcgtgctgtcctgcgtggctcggctccgcatcggttcgtgcatccagcgagccaggagtcctcggggggtggggaactcgtgacgaaggaacgtcaggaacgtgaggacgaggacctcgtccggctctacctcggagacattggcagccacgagctgctcaccaaggatgacgaggccgaactcggtcggcgtatggatcgtgcgcgtgacgcccagcgtcagctcgatgccggtgtgaaggaacctgcgcgcagggccgagctcgaggagctggtgcggcagggagaagaagccaagcgcgccttcatccaggcaaacctccgcctcgtcgtctcgatcgccaagcgctaccaggcttccggactacccctgttggacctgatccaagagggcaacatgggtctgatccatgcggtcgagaagttcgactggcgtaagggcttcaagttctcgacctatgccacctggtggattcgtcaggcgatcactcgaggtatcgccaacacgggccgaaccattcgccttccggtccacgctggtgactcgctctcgagggtccagcgagcccaggtccagctggaggtacgactcgggcgtgccccgacggttcgtgagctcgctgccgaggtggatctgccctacgacaagctggtcgaggcgcttcgcttccgtgccgagccggtctcgctgtcggagccactgcgcgacgacggtgatgctgagcttggcgacgtggtcgaggacagccagtcggcgacgcccttcgacgtcgcggccgagcacctgctcccgtcggaggtgtctcgtctgctcgctccgctcgacgggcgtgagcgcgagatcctgaggcttcgctatggtctcgatcgcggggagcctcgaacgctggaggaggtcggagagtatttccacctcaccagggagcgcatccgccagatcgaggcgcgcgcgatgtcgaagttgcggcacccatctgctgacatcggcgcgcgcgacctgttgaccggatagccgctgccgttccgagatcgcggcccgtcgcggctaggctggatgcatgaagaagctgttgatcctcgcggttctcggagccctcgctgcgttcgcggtgaagaaggttcgcgaaacgctcgcatagctcgtgggggcgtgggcagtcgtgtccacgccctttgcggccatggtgtgcaaaccggcgggtcggaggaccgacctgctgaggccggtgttgtcgggtggcccgatcggatgggaatcctcaagggcgcggtcgagtgtcgtggcgccacgagccagcgcgacggtcgcggcgcatggcgtcgtggcaaaggtcgcccgttgagcccgagacgcacgaggccgaggctcgggtggcctgatgttcggacggcttggctccgatgggtcgtaaggccgagggcaacagttggggctgtcggtcgtcatggcgcatctcccgggtgaggtcggtgcccaacgaggtcgtccgggtcttcgagtgaggagctggcgatggcctcgcctgagggttgtcagatgcccgggccggcccgactggtcctgaccgacgcctcgccggtaggctggtagtgcgccgctgtgtgatgctgtggcgtcggatgggtgccaaagagaggtccggtgtcgctcgttgctctgagcatcgcggaacgtgaggtcggtggccggtttgaggcgtgtgcgctcgaccgcgaccggaccgagcgcctcgaggacggtctcgcccgtctggtcgccaagggagcgattgtcgaggccgctgtgctcgcaacgtgtgcgcgcaccgagttgtaccttgccgtgacgcagttccatgccgccgtcgagcaggcagctggcgtgctcgccgaggtcctggacgtgccgcggagtctcgtcgagcagctcgcgaccgtccacttcggcaccggcgcgctccgtcatctctaccgcgtgagcgcgggtatggagtcggtcatcatcggcgagtccgagatcgtggctcaggtgaaggacgcgatcgcacgggctcagcgtcgacgtctcgcaggtggcgagttgacgcgcgtcttcgaccgagcgctcgaggtcgccaaggacgtgcgcgcgagtaccgaactgacgcacggctcggcttcggtcgtcacgatggcgaccgagctggctctcgacggagcatccgcgcgcgacgtggcggtcggggttgtcggcaccggtgcgatcggatccgaggtggctcgcgtgctcagcgaacgcggggcttcggtgacggtgctcacccgtcgggcagacgtcctgagtcagcaacccgtcggcgtcgaggtccgagccttcgagcagctccggagcatcatcgaatcgttggacgccgtggtgctggcgaccaccacggattcggcagtgctcgatgcgtcgatgatgccgagcggacaccccttgcggatcgtcgatctgtgtcggcctcgtgctgccgatccggcgcttgccgccgtggacggcgtcaagctggtcgatctcgaggaggtcaacgaactcgtcgcggcgcaactgtcgaagcggcgtgaggcgctcaccgatgcggaactcatcatcgagcgggcgctcgccaacgacggagtgctgctccacgctggtgaactcaaccccaccctcgctcgtctgcacgcgtggggtgaggcgttgcgccagtcggagctcgagcgcgcgctcgctcgcgtcggcgacgacgagaaggcgagagccgcactcgaggaactgagccatcgtctggttcgcaaggtgctccacgagccgagcaaggccctgcgtgctcacgcctcgtcggaggatctcggcgcattgctcgcgagcgtgcgcacgctcttcgatctgtgatggctccggtacgcatcgccactcgtcgtagcgccttggcgcgctggcaggcgagcttggtcggcgagcggctcggtcgctacgagctcgtcgaggtccacaccgcaggtgatcgcgaccaggcgagctcgcttgccgagatcggtggccagggcgtcttcgtcaaggaagtgcaggccgcggtcgtgcgtggcgaggccgacatcgcggtccacagtgccaaggatctgcccacagccgcaggcccgctcctgctcgcggcggtgctcgagcgcgcggacgcccgcgacgcgatcgtgggcgcgcggctggaggagctcgcgatcggcgctcgggtcggcacatcggccccgcgtcgagctgcgcagctgcgcctcctccgccctgacctcgaggtggtatcgatccgcggcaacatcgcgacccgtctcggtcgcgttggggagctcgatgcgatcgtgatggctgtcgccgcgctggagcgcctcggcctcgaggagccgccttggtggccgctccccgaggaggtcctctgtccacaggccggtcagggggccattgcggtggagtgtgcccccgacgccgatgggctgatcgagcgccttcggtccctcgacgacgatcggagccgccgcgagatcgaggcggagcgggccgtcctcgccgcgttcggtaccggctgcgcgctcccgctcggtgcgcgggcccatgccgatgggtcgagtctgcggctccgggcggtcgcggttgatcccgatggcacgcgccagctggaggtcgagcgcgagggagtcgatcccgcgacgctcggtgcaacggtcgccgaggtgctgcggcgcctgggcgccgacgcactcgtcggagctcgtccctgatgggacgcgttgcgctcgtcggtgccggccctggcgacccagagctcctcacgctccgcggtctgaggctcgtgcgtgcggccgacgtcgtcgtcaccgacgctctcgttgatcgacgtgtgcttgccgaggtgcggccggcggtcgcggtgcacgacgtcggcaagcgtgctggagcacccttctcgcaggctgccatcaacgaactcctgatcgacctcgcccgcggccatgagctcgtcgtgcggctgaagggcggcgacccgttcttgttcggtcgcggcggagaggagctcgaggcgctgctggcagcgggggtcgccgtcgaggtggtccctggcgtgccgagtgcgacggccgcggcggacctcgtcggtgtcccgctcacccatcggggcgtggcggacggcttctgtgtgatcaccggtcatcgccacggcgacgcgtcgctcgactacgactggcgtgcactcgtcgcgagtgggctcacgctcgtcgtgctcatgggggccgcttctcgtgcgaccatcgccaaggagctgatgggcgccggagctcctggtgagaccccggtcgcggtcgtgacacgcgcatcgtggatcgatgaagaggtccgctggacgagcctcgcggcgctcgggtcggtgcctgtcgcgtctccgagcacgatcatcatcggcggcgtggtcgatccgcggcgccgatggcgaccctcgctgccgctcggtggcctccgtatcgtggtgacacgcccgagagcggtcgcagatgcgctcgcggtgcgcctccgcgatctcggtgccgtcgtcgtggcgagcccggcgatcgagatcggtccgccgtcggatggcggtgccgcactggccgcggcgctctcgcacatcgaggactacgactggctcgtcctcacctcgcagaacgccgtcgatcgcgtcgtaggaggcatcggcgaccttcggcgtctcggtggcgtgcgcatcgcggccattggccccgcgaccgctcgggcgctcgagcgggtccacctcacggccgatctcatccccgggacgtgggttggggaggggctggtcgaggtgttcggccctggtcctggctcggtgctcatcgccagggcacgccaggcccgcgacgtcgtgccacggggcctcgaggcgaaggggtggcgcgtcgacgtcgtcgaggcgtacgagacgcgcacagcagcggcgagcgtgcctccagagctcgtcgagagcgccgatctcgtcgtgttcacggcaccgtccaccgtcgagggtttcgcgacccagtacccggggctcgtccctcgggccgcggcggcgatcgggcccgtcaccgaggaggcgctggtgcggcgagggtggccggtcgcgctgaccgcgacgcactacgacgccgatggcctcgtggaggtgattcgcgaggcgcgcgaagcgggtcggctcgtgcctcgatccgaggcgccctaggctcgtcgtcatggcttcgttcccaaggcccaggcgcctgcgtgccacgccggcgcttcgtgacctcgttgctgagaccgtcgtcagaccccaacagctcgtgctcccgctgttcgtgaaggaagggatctcgacccccgtgcccatcgcgtcgatgcctggggtcgtccagcacacggtggactcgctcgttcgagaggtcgacgaggcgctcgccgtcggcgtacgaacggtgatcctcttcggcgtcaccgacgagcgggacgaggacggctcgctcgcgtgccgcgcggacttcgtgctcgagcgcgcaatcgcggcgctcgttgcgcgcttcgcaacggacgtgacagtggtggccgacctctgcctcgacgagtacaccacgcacgggcactgtggggtgctcgatgctgccggacgcgtcgacaacgacgccaccctcgttcgctaccaggcgctcgccgtggcccttgcgagcgcgggcgtccacttcgtcggcccctccggcatgatggatcaccaggtcgccgccatccgtgaggccctcgacgctcatggattcgacgacgtcggcatcctcgcctatgccgcgaagtacgcatcggctctctacggccccttccgcgacgcggtcgaggtcgagatcgcaggcggcggcgaccgcgcgagctaccagcaagatccccgcaaccgtcgcgaggcgtggcgagaggtcgacctcgacgtcgccgagggcgcggacctggtgatggtcaagccggcgagcttctacctggacgtgctgtcggacgtcgccgaacgctcaccggtgccggtccttgcctaccaggtttcgggtgagtactcgatgatcgtcgcggcgagcgcgaacggttggctcgatcgccgtctggcggtgctcgagtcgctggtcgccatccgacgagccggagcggacggcatcctcacctactttgccaaggaggcagcgccgtggctgcgatgatcttcgagtccaacgaagcggcgttccgtgccgcgtccgaactcatggtcggcggggtcaattccccggtgcgttcgttcgcgtccgtcggcggcacgccgtatgtggtcgagcggggcgagggtgcgtgggtcatcgacgtcgaggggcggcgctaccttgattacgtccagtcgtacggggcggtgatccatggtcacgccgatgcgcgtatcacgcgcgcgatcgccgatcaggccgcccgagggaccaccttcggtgcaccaacggtgggcgagatccggctggcgagcgcgatcgtcgatcgcgtggccggcgtcgagcgggtgcgcctcacgagctcgggcaccgaagcgaccatgacggccatccgattggcgcgaggcgtgaccggacgatcgcggatcgtcaagttcgatggctgttaccacggccacagcgacgcgctgctcgcggccgctggatccggggtggcctcgctgtcgctcccggggtctgccgggatccccgatggagcggtggccgacaccatcgtcgtcccctaccaggaggtgcccacgctcgacgagcgcgtggctgcggtcatcgtcgagccgatcgcggcgaacatggggctcgtggcgccggagccgggattcctcgagggcctgcgcgccgagacccagcgcgtgggagcgctgctcatcttcgacgaagtgatcaccgggttccgcgtggcgcgcgggggtgcgagcgagctgctcggcgtgcaaccggacctgtggtgcttcgggaaggtcatcggcggcggtctcccgatcggggccgtcgccgggccagggaccatcatggatcacctggcccccgctggctcgatctatcaggcaggcactctctcgggcaatcccgtcgcgaccgccgctggcgccgtcgcgctcgaactcctcgacgccgggtcgtacccgcagctcgaggggcgcgcacgggcgctcgcgaccggccttgcctccgtcatcgccgaggcggggctcccggtgcaggttccgcaggtggcctcgttgctgggcctgttcttcagcgacgaaccggtgcgtacctatgccgatgctcgccgggccgtcgggtcgggttggtacgccccgttctttcatgcgatgctgcgacgagggatcgcgctcgcgccaggcccgtacgagatcctcttcccgggactcgcgcacagcgccgacgacgtcgaccggacgatcgacatcgcctcggcggccgcccgtgacgcgttcgtcgccgggcctgtgcgctaacgggtggaggcgcgcggagccagcgcgctgatcactcgcccgcgcctgcgaggcgcgcggagtagatcgagtagccgtcgaccgtgcgtgccaccgcggtcgcgagcaccgttgcgatcatgagcggcacgatgaggtcgaggcccgagtgggtgagctccagtaccagcacgatccccgcgagaggggcttgcattccggcacccatcatcgccgccgcgccgatcatggcgtaggagccgatcgctgcccccggcatgacgaacgaccagatgccgccgaggaacccgccgaggaccgcgcccgtcgacaacgtcggggtgaacaggccgccggaggcaccggtacccagtgccatcgcggtgacgatgggcttcaagaggaagagtgctgcgagcaagccgaggctaccgagctggttcaagaagaccgcgtgcgccatgtccttgccgttgccgaagagctggaaatagcgcatgccgatgaagccgaggatcgagaacgacaggagtggtccgatgaggacccaccgaccggtgaagcgatggtgcgtgacgaggcccatgaggcgcacgaaggcgaccgagaagaggccgatcagcggtccggcgatcacggcgaagacgatctgggcgaggtggaactggtagttggccaccccgacgtaggtcgcgtggtcggggaggtagaggtagccgacgtacgtggcgatgacggatgctgcgagtgccgggaggacgacgggcagggtgacctcacccatcatgatctccgcggtgaacagggcgccgccgaggggaacgttgtagacggcggcgagtcctgcccccgcaccgcaggcgatgaggaggcgcttctgcgctggcgacagcttgccccatcggccgaggtagctgccggacaccgcgccgaggagcttcggggcggcctcgcgtccgagcgaggcgcccatgccgatgacgacctcttggatgatcgaggtgccgaggctcttgcggatgtgcagatcgccctcgcccttccagacgacgtcgtccacctcggagcgctcacctttggtgaacttcgagaggatgaaccatgcgggcccaccgatcgcgccggcgagcgtgagcatctcgaggcggtagatcggcgcggagcgcccgacggccgcctggaacgagccgatgtggtagtggtacgtgatgtgctggacgttgaagaggatgaccatcatgaggtcgccgaagagcccggccccgacgcccgtcaggatgaggaaaatccagaacttgagcgtgagctctgcgtcaccatcgccggtggcgttgggctgctcggtcgcgcctcgcccggtggggagtcgacgcctgatgagcggctggggtgagcgaacgcgacgcaggtgccagggatgctcgcggtccgccttgaccatcgggactctctccagtcgctcgcttgcgttcggtgctgtcgcggggcctcggacgtcactcggcacccgccggggtatgcgcgctgagtctagtggccgtcacgtccggacaagtgcaacgcgtcgcatgctactgcatgagtatgcatgtcactacgacccagccgccccaccaggctaggcggcgatggtcgggaacagcgaggatcccccaccggatcaccgccccaggggagccgtgacgacgcgaggacgtggcggactacgccaaccagggaaaggctgaccagtcgggttcgcgtcgctggaggaaggcgtctcggccctccgttgcctctcgggtgccatagagcaggcgcgtcgcttcgcccgcgaagagctgttggccgaccatgccgtcgtcgaccaggttgagcgcatacttggcgaggcgttgcgcggtcgggctgcgatcgaggattctgcgcgcccatgcgacagcaaccgcctcgaggtcctcgtggtcgacgacggcgttcaccatgcccatggcgtacgcctcctcggccgagtagtcgaagccgaggaagaagatctcgcgggcgcgcttctggccgacgagacgagcaaggtacgccgagccgtacgcgccgtcgaccgaggcgacgcgggtgtcggtctgcatgaagcgtgcatgctggcgacttgcgatggtgaggtcggcgacgacgtggagcgagtggcccccgccgaccgcccagcctggcaccacggcgatgacgacctttggcatggtgcgaatgcggcgctgtacttcgaggatgtggaggcgtccatgggcgtgctcggtgtcgtggtactcgtagccctctgcgccacggactcgttgatcaccgcccgagcagaatgcccagccgccgtcggtcggggacggaccattgccagtcaggagcacgcaaccgacgtcgtcgcggagcgtggcgtcctcgagcgcacgtgcgagctcgtcgaccgtacggggccggaaggcgttacgcacctcggggcggttgaaggcgatgcggacgaagccgccctcacgggcgcggtggtaggtgatgtcggtggcgtcgaagccttcgacgggctcccacagcgacgggtcgaagagcggtgagggccgatcaggctggtgcacgatgccatgctatcgacgacgcgcccggtcgtctcaggctcgagcgcaggcgcgcctccagcgaccacgcagctcgggggcgcgggtcccgacatccaatcgtcggctggacgtaacctcgtcgtcggacgggctcactacggtcgaggtggggcggccaagtggcgccgcgcaaacgtgaggaggtggcgtgaccacgctgctgcacatctccgatctgcactacgagcgagctccggagcgcctgagcgtgggcgtcggcgagcgtctgcgccgcgcaaggaccgcactgcgctctcgtacgttcgatctgctcgccgtgagcggggatctcacgagctacgggacctgggacgtccgcgagctcgtcgaggcgcgccggtggctggaaggcttcgagcgccggatgctcgtcgtgcccgggaaccacgatctcggggccaatcccgagcgcgccgaacgatttccggtcttcgagcgctacgaaccagttccctggagccggacgaacttcggtatgaccttcggggagggcccgctcgtggcgcgtgcgacgggtgacctcctggtcgtcggcgtcggcctgaggcgcggcgatcccgatggcgcgctcgcgctgttggagcgagcgctcgcaggtgcgacgacgcccgtggtcgtcgttggccactacccgatcgtgccggtacgcgagtcgggcgtgctcgcgtccttcggcgcgatgggctacgtggatggcgaggtcgcggagctccatcgtctgatggtccagtccacgcgggtcgtcgcgtacctgtgcgggcacgtgcacgcggcgagcgcggcggtcctcgaaggtggtgtgctccagctgagcgcgggagctctcggcccaggccccgcgctgggatggctcgtgcacgtcgagcgcgatgaggtgcgcttcgagcaggtggaagcgcctgggcgaacgacgttttggccgagcgatcagttggggggtgtcgaccccgtggcctaccacgcgggggccgtcaggagtggcgtggtgccgctcggtcggaccggtcgccccaccctcgtcgattgagttcgcggttcgcgggcgccgtcgcgagaccgccgcggccagacgctgagctccgacgatcgccgcggtccgtgcgcggtgtggaagctgtgaggcgctgcgagcgttgccacctgccatgagtcatggtgctgcgcgctatgtcgtgaccggagcgaccggtgccgtcggccgctcgctcgtcacgcgtctggtcgaggggggcgccgaggtcgctgtcgtcgtacgcgatcgggatcggctccacgagcgcctcggtccggtcgccgacgcgctcgccgccgtcgaggttgctgacgcgcgcgatctcgagcgattcgaggcggcgctggtggcggcagccggtgcccttggttcggtggacggcatcgcccatctcgtcggtggcttccttcttgcgacgccggcacggacctcgatcgcgcagttcgaggagctcatgcgcctcaacctgacgagcgccttcgtggtcgtgcgggtggccgagcgcgtgatgggatcgcgcggtggctcggtcgtgctgatctcctcggcggcagcccacgtcggcctcgcctcgcacgaagccgtcgcggcttcgaaggctggtgtcgaaggactgacccgatcggccgctgcgacgctcgccagagctggcgtgcgggtgaacgcggtcgcccccggactcgtcgaggccgagatgacgcgcgggatcgtcgagcgagaggatgcgctcgcggcgtcgatcgagctgcacgccctgggtcgcatcggcaccggtgacgagatcgcccgaggcgtggcgttcttgctcgacccggagtcctcgtggatcaccggcagcgtgctcggcatcgacggcggtctcgggtcggtgcggccgcgcccgcgccgacggctcccttctcagaccgggggccaaggatagggccgtccgtgctccggcatgggcgggagcgcgccgcgtcgaacgagacgcattgctcgctggaggagcgcacgtcgttcttcgggctcgagcagccgtgcgaggtcgtcgggcagatcatctgccaaggaggcaagacgtgcggccaacgcggtggggagcggatgacccgcgagatcccagatcacggttcgtagcttcgactccgggtggaaggtgagcgcgttgtcgatcgcccagagtcgcccctcgtcgtcgaggaggacgtggctccccttgcggtcggcgttgtttgcgacgatgtcgagtgccgcgatcaccgcgagagactcgtggtgggcctggtcctcgacgagctcgaagtaggtgaggtcgaagtctgcgtccacgaaggcttggagggtgccgctgccgtagggtaggtcgtggcgcacgacgataggcggcacgtggcagatgccgacgaactcggcgagtgctcgaaaggcgagttcccggcggcccagccccggggggaagtcccacaacgggcgctcgagggcgtcgggcttgtagatcgcgagtgctccggagtggaccagctcgacgaggtgggcgccgttggacgacgcagtgatccgcccgaggaggcgaacctcgtcgtcgaggatggcaggatcgtctaacgcgctggggcgcgatgcccgttcgtccgtggacacgcgtggccttcgggattgatcggatagccgcagagcggacaggtcggtctgccttgttcgaccacctcggcgatgcggatcgcgagacgcgctgcgagctcccgcgagagggtgaaccgtgctcgacgtggctcgacgtcgacgtcgcgctcgtcttcgatggcctcgatgacgagcactcctgcatccacgtcgaccgcgagctggagttcgccgacgcggaaggctggttcggcgggttcggtgagcggtgtcgtcggtggcagctcgccgggtcgcgcgaggtcctcgagcgccgtggcgatggccctggcaagggcggccatctggagcttttcgacgaggagggtcacgatctcgccgttggcgccagcctggaacaagaagacgcgttcgccgggtctgccgtgggtgccgagggtcgcgaactccgcaggatcgaactcccagacgaactcgttcacctccgccacctggccccagtgcgttcgttgagcgtgagcaggccaaggctcgtcggcgtcacgctgaaggtggtcgacgaggccgtctcgacccagatccggtggacaccgtcgacgtggataccgagcgcatcggcggcgagcaggcggatggggtccgcgtgtgaggtggcgacgacgacctcgccgggatggcgctcggcgatcctggttgcgaagcctcggatccgggcgagcacatcgacgagtgattccccctcgggaaaccggaacgtcgacgcagccgcgaggagcgttgcccactccttgcggcgacgcacgcgtcccaacgaccagccggtccaggcgccgacgtcgacctcggcgaggtcgtcgtcgacgatcgcggtggtgccgaagacagcctcgagtgcggctgccgtctggcgagcgcgctcgagcgggctcgagtacagcctgatggcatcgaagcgccctgcaagcaccgctgcggtgcggcgcgcttcggcctcgccgcggtccgagagggcgagacccggccgtcggcccggcaactcggtgccggtcgtcggtgtgcggccgtggcgaaccagcaccagcgtcgccggtcggtcgctcatcgggccgtggctgtggtaggagcgattggcaccctcgtcaccttagcgccgaaggcgcggtccgtacggatcgacgcctcagtcgaggcgctcgacgatcatggccataccctggccgccaccgacgcacatggtctcgaggcccagacgagcccccaactcatcgagctcgtgcagcagggtcgtcatgatccgagcccccgtcatcccgaacgggtggccaagcgcgatcgcgcctccgttcgggttgagttggtggtcgatcgagatgcccgtctccttgacgacggggagcacttgggctgcgaaagcctcattgagctcgacgacgtcgatgtcgccgatcgtgagaccggcgcgttcgagcacggcgcgtacggcatcgatcggtccgacgcccatgatctccggagcgatgccggtcacggcggaggcgacgatcttggcgagtggccggatgccgagtgcctccgcgcgtgagcgctccatgacgatgacccctgcagccccgtcgttgagcgggcaggagttacccgccgtgacccgtccgtcgggcctgaacgctggcttgagcgtggcgagcacctcgagggtggtgttggggcgcggcccgtcgtcgcgccgaacgacgttcccactcggcgtcgtgacggcgatcgtctccgcatcgaagaagccccgttcctgggctgcgaccgcacgctcttgcgagatgaccgcgtaggcgtccatcgcctcgcgcgtgacgccgtagcgatcggcgacgttctcggccgtgaggcccatggggatgtacatgtgattgacgaagtccgcgcggctctcgtcggtgaagcgagggttcatgtcctcggggtcgaaccccttgatcgatgcacgtgtcgtcgactccacaccgccagcgatgaaggcgtctccctcgtcggccatgatcgcatggaacgccatgcgaatcgcttgcagcgacgatgcgcagaagcggttcacggtggtgccggggacggtctcgggcaggccagcgagggctgccacgttgcgcccgaggttcatggattgctcgccgtgctggatggccgctccccagatcacgtcgtcgacgctcgccggatcgagggccggcactcgggtaaggagctcggcgatcacgaggccagagagatcgtcagggcggacgtcgacgagggatcccttgaaggcgcggccgatcggggtccgggcggtggcgacgatcaccgcctcgcgcgccgtcatcgctcgcctccggtcgccagcgcgctccgttggcgcagctggcggagcacgcgctcgacgtggccggtcgcgcgcacgttgtagagcgcgtcgacgacggcgccgtcggcgtcgatgagcaatgtggaccgcaggacaccttccgtcgtgcggccgtaggacttcttctcgccataggcgccgagggctgtgatgacggaccgatcgggatcggcgaggatgtcgaagcgtaggccgtgacgctccgcaaagcgggcatgggatgcgaccgtgtcgggagagatcccgacgacgcgccaaccgagcgccgccagctcgtcgacggacgcgttgaactccgtcgcttccagggtgcatcctggggtcatgtccttcgggtagatgtagaggatggtcgcggtgccagcaaacgagtccgcgcagacctgctcgcctcgttggttgggcaggcagaagctcggaagacggtcgcctggcgcgagccggttcgtttcggtcatgggccaacgctagcgcgatcgcgcggcggtcacagggcgggcgtcgctacgctccgtcgaagaaggaggagccatgggagatgacgagctcgtagccctcgcgtcagcacttggccaagcacgcggtgatgctgagacgctggcatcggtgctcgccgatgcgctcgagcgatggctgggcaccggcgcggtgcgcgtgcagcggcgcgggttgcgcacgcgacggatcgtcgagctcgcggtcgacatcggcgaccgtcgactggtgttgcgcccaggaccaccggtcgtggcggagatcgtcctccgttcaggtggcgttgcgatcgctcatgatcgggtgtcgctctcggcgtggttgtccgcgctgaccgaggcactcgccgcgcagctcgggacggcaacggacgacgtgcgggcactgcgccgtgccctgggcctcgatgactcggtcgactagcgtggcactggtcccaggaggtttgcgtggaactgcagccatttgaagcaccccagtccgtcctcgtgatcagtgcgcacccggacgatgtcgatttcggactcgcgggcacggtggcccgttggaccgcggcgggcacggaggtcgcctactgcatcgtcaccgatggcaacgtgggcgggttcgacccgtcgatcccccgttcggacattcctgcgattcggcgccgcgaacagcgggctgcggccaaggtggtcggtgtcgagacggtcgagttccttgggtacgtggatggcgaggtgacggtgacgctcgggttgcgacgcgaccttgccgcggtgatccgacgtttccgtcctcacaccgtggtggcgcagtcaccagtgcgcaactttgcgcggatcggtgcgtcgcacccagatcacatggccgtcggtgaagccgcgctgtgcgcggtgtatccggacgcgcggaaccccttcaccttcgtcgagctggcagaggccgggctcgaggcgcacaccgtcagtcaggtcgcactgatggcgtacccggagccgacccacttcgtggacgtcacggaaacgctcgacgcgaagctcgaggccatctcgtgtcacgcgagtcagttgcccgatcccgaggcgacgcgcaccttcgtgcgtggctggctgcgtcaaggagccgaggctgccggtctcggcgacgatcgctacgccgagctcttcttcgtgttccccacggcctagggcgcccatggcgcgcacgtacggatcgggtcgccctcgctcgcgatcaggtgacgcgtgtgcggcttcgacgtggcgcacgcgtcgtcgtggcccagatgggacctctgccgtgggtgtgctcggtttcgagtagtgtggtggttgctgagtcggcagggctcggcgctccccgtgttcgagcgcgttgctccccgccaggtgagcgggcatgagttcgcgcgtcagagacgagcacggcgtgtctcaccacttcgtggtcatcggcgtgatgttgaggagtctcgttgcgtgctgctgtctttcatcgtccgggtctgatcacggtcgacgagcgtcctgatcctcgggtgctcgagccgaccgacgcggtcgtgcgggtcgtgcgagggtgcgtctgcgggtccgacctctggtactggcggggcctcagtgagcgcggtccgggctcgatcggccacgagttcatcggggtggtcgaggagatcggctccgccatcgacggcctccgccccgggatgctcgtgatcgccccgttcgcctttgcggatctcgcctgccccaactgccagtggggcgccaccgtgaactgcgtgcacggtggcctgttcggcgacggcactatcgacggaggccagggagaagcggtgcgcgttccgctcgccgagaccacgctcgtgcccgtcccgggtacctcgtggtcggacgccgagctcgcgtcgttccttgcgctctcggacgtcatgccgaccgggcaccacgcggcggtgtcggcgggggtcacgaagggtagcaccgtcgcggtgatcggcgacggcgctgtcgggctctcggcggtgctcgcggcgcatcgactgggtgcggagcgcatcgtggccctgagttcgcacgcggaccgacaggtcgtggcccgggctttcggggcgaccgacatcgtcgcccaacgcggcgccgaggccgtcgcgaccgtgctcgagatgaccggcggcatcggtgccgacgccgtgctcgagtgcgtcggtacccaggaggcgatggagaccgccgctgcgatcgcgcgccctggatcgatcgtcggtggagtcggcgtgccccacggtgtgatgcccgcgacggcgctgttcggtcgcaacgtcggctggcgcggtggcccggctccggtgcggatctacctcccggagctgctcgaggacgtgctcggcggcacgatcgatccaggtcgcgtctttacgtacgagaccgacctcgacggcgtcgtcgaggcgtaccgggcaatggacgagcgtcgggcgatcaagtcgatcctgcgcgtcagcgagccgtagcacgttcgctggggcgacacgacagggcgaagggcagaggcgagacgagaagcggaggtgaccatgcagtatcgaatgctcggcacgacgggggtggaggtctccgtactctgtctcggggccatgatgttcgggagctggggtaacccggaccacgacgagtcgattcgtatcgtgcaccgggcgctcgatgcgggcatcaacttcatcgataccgccgacgtctactcggagggcgagtccgaggagattctcgccaaggcgctccgaggtcgccgggatgaggtggtgctcgcgaccaaggtgcatggtcgtatggggcctgatcgcaatgccaagggcaactcgcggcggtggatcatccacgaagtcgagcagtccttgcgccggctcggcaccgagtggatcgacgtctaccagctccatcgccacgatcccgacaccgacctcgatgacacgctcggcgcgctcgacgacctggtccgcagcggcaaagttcgctacgtcgggcactcgacctggcccgcgagtgccatcgtcgaggcgcagtgggtggccaaggagcggggctacgcgcgtccgcgcaccgagcagccgccctactccatgctcgtgcgttcgatcgagcgggaggtgctcccgacctgtgagcgctatggactcggtgtgttgagttggagccccctcgccggaggttggctctctggccgggaccggcgcgatcgcttcagtggcccgcagtcggctgcacgccagcgggtcgctcgacgtttcgatctctcgctgccggagaaccagcgcaagctcgacgcgaccgagcgcttggcccagatcgcggcggaggcggacctttcgctgatcgaacttgccatcggcttcgtgttggcgcaccccgccatcacttcggcgatcatcggaccacgcaccatggagcatctcgagtcccagctgtcggcggccgatgtcgtcgtgccgaccgcggtgctcgacgcgatcgacgacgtggtggcgccaggaacgacgatcaatccggtcgacgatggctgggttccgccctggctcgagccgactcggcgtcgccgtccctcgggtgcgtgagctcgacgcagtcggcgcgctcgatgagctcgtgggttcgttcgggccgcacctcgcgttcggccgacggagctgctcgcacctcgacgacgatcttcgggaatcggcggtgctgcgacgaacgatcgaaccgagtcggtgatgcggcgtcctggccgcgtcgtggtcgctcgtgcaactcgagcaggacacggttcgcgaacgccgtctagcggcgacgcatcgtgactctccagagccgtcggggcaggtcgccctcttcgaaggcggtcacgtcctcgagctcgaagccgtcggcgaggcgatggacgaggtcctcatcgaagaagtggaccgcgaagccaccgttctcgaagcgatcgtcgccgaggtcgatgccctggccgtagtgggcgtcgcccttgtggcgcaccgtgtagacgcacgtcgcgcccggtcgcaggactcggtgcagctccgcaccgagggcgacgagctcggacgtcgtgaacgccatcgtgaagagcatgtgcgcgaagcaggcgtcgaagtagccgtcggccagcgggagaggccgacataggtcgtgggtgaccgaggtgagccgggcgccggttccacggccatgtgctgcgtcccagagggctgcgagtccactcacggcgtagtcgaccgccgtgacctcgaggcccgcatcgagaaagtgcagggtgtcacgaccgtgcccagcgccgagttcgaggacccgagcggccccgtcagcgagcatgcgtgagagagcccatcgaccagcctcacttggcgccgaaccgtagagctgcgggctggcacgaaaggtggcctcccagtgggcttgctggcgtgttccgagatcctcgaccggtgtgctcattggtctgcttcctccgtcgcgtctgcagggtgtgcgctcccttctccccgatgccatggcgtcgctggtcgtagcggcggcccacggtccccggcggctcgatcgggagatcgtcgatctgcgctctcgactcgatctgcgctctcgaccccctgcactgctcgtccgtccatgccacgatcggatttgtcgtcgggaacatcacggagggccccgtgagcatcgccgtcgcgctgatcggcaccgtgaccatgggtcttggcctcggtctcgcgtggctgtatcgccggctgatcgagccatccgaggcgcaacgcacccttcgagcgtactcgagtcgcgagcgccgttcgatggaacgtcggctgcttcgcggtggtggtgacgagttgcctcgctcgtacctgatggcgctggtccaagatccgtcaggtcgcccgatcatggtcgccatcgcggtactcatcgcgatcgtcatcgggttcggggtttggctcgtcctctccgccctctggggaccgctgcgacccggagtgatgctgtgggacttcgtggcgacccaagtaccggcgtggagcggcgtcgcttatcggcgacggcggatcgtccgggcagcgcaacgtgctcttggatcctcaccggcttcgttgcgtcgttgacccgctgaacggcacgatgcgtgctgcgtccctggagcgtgtcgctcgtgcgacctcgctgtgacgtgcctacactcaggagcatggttacggggaagtcgcagagcgtgctcgatgccatcggatcgacaccgctcatcgaggtcgagccctccatcttcgccaagctcgagtacctcaacccatcgggctccatcaaggcgcgcatcgcgcgctacatgatcgaggcagcggaggcacgcggcgagctcgagcccggcatgaccatcgtcgaggcctcgagtggcaacacgggcaacgccctcgcgatggtcgcggcggtgaagggctaccgcatggtcgtcgtcatgccagaggggctctcgtcagagcgcgcagcgatctcgcgcgggttcggcgcggaggtcctgcgcgtcgggaacttccacgttcagcatgcccgcgagaccgcggtggagatgggcgagcgcccgggtttcttctgcccgcgccagttcgattccgaggacaacgtggccgagaaccgtgagtggctagggccggagatcgtgaccgatctcggtgcaccgccggacgcgttcgtcatgggtgtcgggacgggcgggacgctcatcggcgttggtcaagcgctccgggcggtcaaccccacgactcggctcgtcgcggtggagccggaggagagctgcacgatcctctgtggtgaagttcaccaccatcgcatcgagggcatcgccgatggcttcgtccccacgatctacgagcgccaccggacgatggtcgacgaggtgatcccggtcacgagcctggacgcggttcgcaccatgcgcgagctcgcgcgccgcggcatgttggtcgggccgagttcgggggcgaacctggtcgccgcccgtcagctccgcgagaaactcgggccgaacgccacgatcgtgacgatctttgccgacgagggggagaagtacctcacggagtacttcttgacccgtggcgagctcgctgcgatcctcgagggcagccacgacgacgactgggtcgccgcctcgggcggcatcacggcgccgttgcctccccttgctcggtgaggaactgacgctcgaagagctcggcgtagagcccacctgcggcgagaagctcggcgtggctcccttgctcgacgacactgccggcggccatgacggcgatggtgtcggcaccgaggacggtggagaggcggtgggcgatcacgatggcggtccgtccctggagggtgtcgccgatcgctgactggatgagtgcttcgttctgagcgtccaggctcgaggtcgcctcgtcgaggatgacgatgcgcgggttgcgcagcaggacgcgcgcgatggcgagccgttgcttctcgccgcccgagagtcggtagccgcgctcgccgacgagggtgtcgaggcgatcagggagggcctcgatggtcgcgaggagctgggcgcgcgcgagcgcatcgcgcagctcgtcctcggtcgcggatggcttggcgtagcgaaggttcgcgcgcacggtgtcgtggaagaggaacggatcttgggtgacgacgccgatctcggcccggagctcctcgaggtcgagctcgcgcaggtcgatgccgtcgagcgtgacgcgaccgcgctctggatcccacatccgcgtcaccagcatggtcaccgtggttttgccagcccctgatgggccgacgagcgcgagggtatggccgggctcgacgtggagcgtcaccccggcaagcgcccaatcacgctcctcgctccgcgggacaccctgcttggtgaggctcgcgaccgcctggttccgaggatagcgaaaccacacgtcctcgagggcgaccctaccctcgacgcgctgcaggtgacgtgggttcgggggcgaggtcacggcgggttggacgtcgaggacctcgaagatgcggtcgaagctcacgagtgcctggagaaggttgacccgagccgaggagaggtcggtgatgggcccggtgaggcgggtgacgtactgcgcgagcgcgacgagcgatcccagggagagtgcgccgcggatcacctggtcacctccgagggcatagaccgcgatggtcccgatcgcgctcgcaagcccgagaatagcgaagtagaccctgccgaccagggcgaagcgcacacccgcgtcacggacgcgacccgcatgatgggagaaggtgtcgagctcgtcgcctcggcggccgaagagcgcaacgagcagcgcgccggagacgttgaagcgctcctgggtgaaggcgttcatctcggcattggcttgcatctgttcgcgcgcagcgtgtgcgacacgacgcgacaagaggcggtcgacgaggacgaagaccggcacgatgagcaacgagagggcggtgacgagcggtgagagcgcgaccatgaagccgagcgtgaagatcagggtcgaaagatcgctcaccaccgagccgagggtcccgacgacggcttgtgagctggtgacgtccgaggagatgcgcgagagcaccgagcccgtctgtgcctcggtgaagaagccgagcgacagctcctggaggtgggcgacgagacgggtgcgcaggtcgaagatgatccgctcgccagcgaccgaggagacgtagcgcgttcccacgccgagcgcgctctgagcgagcgacagcgcggcgatgatgacgacgtcgatcgtgaggcgcccgatcgagcgccgaacgatggcgacgttgatgatgtctcgcaccacgagcggcaccagtgcgccgaggagtgcggagatggcgagcgtggccaggtagacgatgatgagggcccgatggcgcttcgtgacgctccaggcccgccgaagcgtgcggcgatcgatcgagcctggccgcaccggatcggcggccatgcctcgcagcgcgcgcattccgccgaagccccctccaggctgcaccgcgcctcctctctcggaaccaggctagacgcggtggtgttggccgagcagggcggctcgcgtagggttgagccgtgaaccagctcgcgcagtcgctctacgaggtcgtcgtccgtcgtcgagacgtacgtcgggagttcatcgatgggcccctcgatcccgaggtcctcggacgaatcctggccgcggcccatcacgctcccagcgtgggcatgagccagccctgggacttcgtggtggtgcgcgatcgcgagctcagggcggcctttcgagatcacgtgctcgaggaacgggcgaacttcgccgcgtcgctggatccggagcgtcgggaacgtttcgacaacgtccggatcgagggcattctcgaggcgcaggtcggcatcgtcgtcacctacgacgcctcacggggttccccgaacgtactcgggcgccacgcgatcgccgatgccggcctctactcggtgtgtctcgccatcgagaacctctggctggccgccaccgccgaggggatcggggtgggttgggtctcgttctatcgggagccgttcctcgcctcgctgctcgggatccctgcggggatccgtccggtggcctggctcgcggtcggtccggtggcacgattccaggaggttcccgatctcgagcgagccgactggcagcgccgtcgcccactcgcgcccttcgtccacctcgaccgcttcgacgccgacgcccccggcgaggacctggtggtcctgccggagcgcctggtcggggaatcggcggacatggactgagcgatctgcgggtcgcgttcgtctagggcgcgatcgtcgtcgcgaccagcagcgcgagcagcacgtcgcgggcgccgagcgctcgttcgagctcgcccagagcgtcgtcggaaggacgcggggccccgtcgatgatctcggccagggcgaggcgagcgatccgatcggtgatctcctgcagtgccgccgcttcgacgagattcgccgggaccaacgcgcgtgcgcgctcgcgcaggcttcgtgcccaggtctgatccagcagccttgctgcgtcgtccgcacccacgcggccagcgatgatggcggccagcgcgagggtcgcgccgcgccaggctgcgaggcctgctacgtgggcgtcgtgtccctcggcctcgagcgcagccgcctctgtgcgaagccgctcgtcggccgtcagctcgttgacgagagccgcgcgctcggcaagcgtggttgggtcggcaagctcgagcggatcctccacgagcagacggaggtcgagcgccgcgtcgacgagggtgtcgcggatccgtccataggcaccaagccgacccgcgaagctcccgtcgcggcgccagagaaggcggcgagcgacgtcctcggcccccgtcgcgaagatggcgatcgtggcaaactcggctgcgcgcagatagctcgttctgccaagctgggcgatgcgggccacaccgaggatgccgaggtggttcacgaggaggttggcgagcgccgtcgcgaccaactcgcggcggagcgggtgcgccacgcctgcgtccgagacgaggcggcgtacctcgatcgggaagtagttgaggaagagctcgtcggtgatcggatgatcgagcaatgaggaggactcgaggagctgcgtgaggtggatcttcgcgtaggagatctcgatcgcgagctccgatctggtgagcgggcgccccagcgagcctccgcgaacggccgctggatcgggcagcgtctcgaccgccacgtcgagctcggcctcgcggaccaggcgctcgagcagcgcgccatgctcctcggcccttcgtccggcctcgtgctcctcgaggctgaggacccagttctggtagacgttgtcggccaggacctgcgcttcgacctctccggtcagctgtgcgaggagctggttgcgctcttcggtggtcaggtgaccctggcgccgcagctcttcgagggcgatcttgatgttgacctcgtggtcggaggtgtcaacaccggcagagttgtcgatcgagtcggtgttggcacggccaccgtgcatgcagtactcgatacgccctgcctgcgtgaggccaaggttgccgccctcggcgacgatgcgtgctcgtagctcggatcccgtgacgcggatgcgatcattggcgcggtcgccgacgtcggcgtcgcgctcggtcgtcgcacgaacgtaggtgccgatcccgccgttgaacaggagatcgaccggcgccatcagcatggcgtggatgacctcgtcgggttcgtgagctccgggggcaaggtccaggagcacggcagcctctggcgagaggtcgacgtgcttggctgatcgcgagaagacgcccccgcccgccgagatggcatcggcgggatagtcggcccagctcgtgccggccccgcgtgcgaagaggctcgcgcgtgcggcaaacgaacgttccgggtcggggtcggggtcgaggaagatgtgccggtggtcgaaggcgcccacaaggcggatcccgtgcgagcgcagcatgccgttgccgaagacgtcgccggacatgtcgccgatgccgatcacggtgatggggccgtcggggtcgcgctcgagttcgtcgaggtggtgtcgtaccgagatccacgcacccttggcggtgatgcccatctccttgtggtcgaagccgttcgacccacccgaggcgaacgcatcaccgagccagaaacccatctcgagtgcgatctcgttcgcgatatcggagaaggtcgccgtgcccttgtcggcggcgaccacgaggtagtggtcgttgccgtcggtgacgaccgtgcgagggggatggacgatggttccgtcgacgaggttgtccgtgagcgagagcagggtgcgcatgaaggtgcgatacgagcgctcgaccttgtgcgggttgcgctcaccgggtgcgaggtcgcgaacgacgaagccgcccttggagcccatcggcacgatcaccgcgttcttcacggtctgggccttcatgagtccgaggatctcggtgcggaagtcgtcgggccggtcggagaagcggatgccacctcgagcgatgcgtccgccgcgcaggtgcaccgcctccgtggtgcgcgagcgcaggtagatctcgaagcgtgggcgcggcgagggcaggtaggtgagctggcgcgggtcgagcttgaacgcgatggcctcgcgttcgggctggaagatattggtccgcgtcatcgccatgacgatctcggcgagcgcgcgcagcaccttctcgtcctcgagcgtcgctgcggcctcgatatcggtggcgagctgggtcgtgatggcctcgacgtcacggggtcgatcgagttcgctggcgtcggggtcgaaccgcgcgtggacgagccggacgagatcgcgagctgcgagcggggtgcgggtgagcgtgcgtcgggccgaagcctcggtgacaccgagcgtcccaaagcgcaagtaggcacacagcgcgcgtgtgaggtcgatgtcatcgaggtcgagcgcggccgtcgtcacgagggtgttcaggtcgtccgcctctgcctgacctgcgatgaccgcttcgatggcgcgttcgaggcgatgggccgctgcgtcgtcgccgagcccatcggcgacccccgctggccagcccaggcgaagctcgatgatccacacatcctcgccggcgacccgtcccgtgtaggggacttcctcgcgtacgcgtgcgccgaagccctcgaggaccgggacgatgtcggacagcgctggtcgttggccgaccgcgacgagccgaagtcgctccacctctccggtcgcgggtcgacgtaccgcgagccgtactggcgagcgtcgcgctcggccgagcgcgaggacgtcgagcgccgcctcgcgctcggtggtgtcgatggcgtagctctcctccatgccctcggcgagcgccgtggcgaggctcgaggtctctggatcggcatcgggggtgctgagggcattgacggcagcctcgaggcgcagacggaagggggtcgtggcggcggcgatcgccgcctcgagctgactcggatcctccgggacgcgatcgaggaggtagtcgaggacgagtcgccgctcggagaggttctgcgtgagctgtgcggtggcaacgaggccacgctcgacgagcaccgcctcgaggcgatcctcgacgccatagtcgacccgagcggccggcaccacgaccacgagcctcgcccccgcctcgaccgggatcacgagggcacggggcagcccgagttcctcggcgagcaatccagcgcgacacagctcgtcgaaggttgcgtcgtcgactccgatcgccaggtcggcagggagcgagccgacgaagtcgcgcaacacgcgccatgagtggctcgatggcaggagcgcgaggagctggcggacgcgctcgaggcggctggcgatctcgggtgcgccaaccccgatcccgctgacgagcgacgggcggaaggtccccacgaagtgcacggcgcccgacgacgtcccgatggacagtgtgcgcagcggcgagtgatcgaggatgggggctgggatcgcggtgggctcgaggcgccactgccctgccgagaccgccagggttggcacggcgacgtcgatgccccgccgctgttcaccctcggcgctgactcgcagttcggcgatcgggaggaagtgggcgatcgccgaggttccgggcgtctcgccaccgtcgaggccctcggtcgcctccgcaagcgttgcgagctcgtcgcccatggcctcgcgatcgtgctcgagtcgcagcagctgcgtcgcctgcgtcgcgagggttcgcgcgaggtgctcggtctcgatgcgtgacaggcgggtcggtgtcgtcgctgcgaagaaggagacgaggtgggagccctcgacgaactcggcgttcgcgtcggtgagctcgccttcttccaagatgggatggaacgtgctcgcgttgtccacgatctggcgtaccgcggcgatgaaggtgtcgacgagccaagggacatcccagctcacgaccacgatgctcgtgagggggcgcgccggttcggcgatgacccgctcgagatcggtcgcgccgtcttggccacagtgcacacggaggacctcgttgtcctgggcgatctcgacgatgcagcggtcggagcccttggcgttcgtgagcgcatcgaagagggccgcgaccgcgacgccgatgcgctcggtggtgagcgcgctggtctcctcgtcgtcgaggtggcgcgcgaggctcgcgacgaagtgttccagggcgccagcgtgcgacggcacggcgccagaatgtctgcggaccgatgacaagagggacgccgtttctggacgcccagtaccagcttcgagcatcgtacgactcctttgtcgactttgcgatgccccgagcctaccgagctcgtgcgacttcgccaagggctcgccgggcgctcgaggcgctcggagccctatcggcagcttcggcgacgacttgcgtgcgtcgtgcacggctgcggtggagcgagctgcgacctggaggttctcgcccgtcgcagcgcccctcgcagctagcggcgcgcgatctcaggggccataatcgagatgaggtggtaggcaacgtgggaggccgcgatggtcgtgacctcagcgtggtcgtaggcaggtgcgacctcgacgacgtcggcgccacggatggaaagatcgcgtagcccatcgaggatcgcgagcaattccctggaggtgagccctcccgcctctggtgtgccggttccgggcgcaaaagccgggtcgagcacgtcgatgtcgatcgagacgtagacaggtgcggtgccgacacgatcgcggatgcgctccaccacgccatcgacgccgatgcgatcgacgtcacgtgcggcgaggacgcgaaagcccatgtcagcgtcctcggtgaggtcggagcgcgcatacagcggtcctcgggtgccgacgtgcacgctcgcgtcgggggcgaggaggccttcttcgaacgcgcggcgaaacggcgtcccgtgcgtgtagggcgcgtcgaagtaggtgtcccaggtgtcgaggtgagcgtcgaagtggacgagggcgagtggtccagtgcggggcgccagggcgcgtaacagccccagtgcgatggtgtgatcgcctccgagggtgacgatggttcgaccagcctcgccgagctctcgcgcagcactcgtgatggcagtgagcgcagcgtcgatcgagaacgggttcgccgccacgtcgcccgcgtcggcgacctgtacttcggcgaatggccagacgtcgaggtcggggttgtatgggcgcagcagcttggagcccgctcgaatggctgaggggccaaagcgtgctcctggtcgatacgacgtacccgcgtcgaaggggacgccgaggacgaccaggcgagcgtgaggcgcctcgtcgagacggggcaggcgtgcgaaggttgcggggccgccgaagcgcggcgcgacgagcgcgtctggcggtccgatgatctcgtcagtcatggagccctcctccgttccccgggcccatgcgcgctgtgcgctggtgctccttgcaccttagaggcagtgtgcggcctccgccatggcgagctagcgtgaggacgtgcaggctccacgctttccgatcggcgagcggctgcgccatgctcgcgagcaacggggtctctccctggccgcagttgccgagcgcactggcctgtcgaaggggttcctctcgcgggtcgagcgcgacggggtgagcccgtccatcgactcgttggtcgcgatcgccgatgccgtcgggctcgccgtcgcggacgtctttgcggtggcaccggtggtggtttcacgctccgtcgatcgcttccccgatggactgcctggcgagggagtccgggacacgttgctctccccacccgacgatcggcgcgttaccgttctcgagacggtcgcggcacccggagggagcggcggtgacgagctctatcacctgccatcgcaggtggaactttgctacgtggtcgccggtcgtatcgaactcgttttcgcgagcgagtgctacaccctcgatgcgggtgactcggcgaccttcgctgccgacgcagcccacacatggcgcaacctcggcgacggcgaggcccgggtgctctgggtgctcgcaccggcccttcgggatccctggacagccaaggagcgccgcgacgacggttcggtcgcggacgtgcagggcgaacgtgtctaggaggacgcctgccaccgcaggagccgctcgtgtcgtgctcctgacgcgcgacctgttgggcgcgagccgactcgactcggtccggatcgtgcgctcgagcacgagcctcgtcgacggagacctcgacctcgtcatcgtcgatgtgcgtgcggcgcccgagggatggcgatcggccgtggcgggactctcatgtccttgggtggccgtcgtctcgcacgtcgacgacgctggccgggatgaggcgctcgcactcggtgctcgacgcgtggtgacgcgcagctggctgttcggtgcccgcgacgtgggcgcgcgtctcgagcgcttgctcgtcaccgacacgaaagcgacgggaacggacgcggtggcggacgcggaggacgactgatgcgccaccatggcttcgtcctggcgcccgtgttcttcgtggtgctgggcgcgttgttcctcgggtccgttgcgttgatcggactcgatgtgctgtcgtttgcctatgtccgcgttggcgtgccggccgcctggctcttcggtgtgctcgtggcgtcgctgctcggaagcttcttcaatgtgcctgtatggcacctcgagacgcctggcgatccctacgacgagggcatcgtgagggtgttcggcgtgcagtatctgatccgacgcccggtcgcaccccagcggacggtcgtggcggtgaacgtcggaggtgccctcgtgcccaccgcgttgtcggtctacctggtcgtccacgaccacatcgagctcgttgccctcggtgccaccgtgatcgtcgccctggtcgtccacgtcgttgctcgaccggtgcgcgggctcgggatcgcagtgccgacgctggtgccggcggtgctcgctgcgctcacagcactcgtcatcacgagtcgcgacgtcgccgcggtcgcctacgtcgccggatcgatcggagtcctggtcggcgctgatctgaccaacatgaccaagacgcgttccttgggcgctggcatggtctcgatcggcggtgcgggaaccttcgatggcatcttcgtgacggggatcctcgccgtgctcctcgcggccctctaggaccgctctcgggttcgtcgcaccgatcgggtccttcgctgcgtgcacgcgagccgaaggaccctggtggcgcgccgcctcgctcatcacactgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggcgaggagtgccgccgtgatccgtcgtgcgccgtaggtgccagaggatgcctggtggaccgcgaccactcggttctcgaggtcgcgtcttgcacatgcccgacgcgacggtgctacctgggtgcgtcgccatcggtagtagccagcccgggagacctcgagtaagcgtgccatccgtttgatctcgaagcgagcgtactccgcctccatcagcgcgaatctctcttgcttggtggcttcgcggcgaagtacgcggctgcttttcccaggaactcgttgtccttgcgcagctcctcgagctccctgcgcagcctgatgagctccgtgcgctcctgcgccgtgaggggcgggctgccagtggcgttggctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcacactgtcaatggcggtcgttggagtgcgaatgactccaccgtcgcccatgcatccagattgaggaggtacaccatgagacgccgcgtctttgacgtgctgacgagcgccgtaggcctggcgatggtcgtcgtcttgctcgttgcaggatccttgctcatgtgggggtccagctttgcgagctcacaggtccacaaccagctcgcacagcagcagatctacttcccgcctgccgccgcgttccgccacgccaagcccggtacggagatcaccccatcgatgatcccgtcggtctcgcagtacgcagggcaacagctcctgaccggtcagcaggccgaggtctacgcgaacgacttcatcgcggtccatctgtccgagatgccctatcacggtgtctacgcgaagatctctgcggcagcgatggcgcagccgaagaacgccgagctccaggcgctgcgcctgacgtcgttcgaaggcaccacgctgcgcggcctcttgctcgaggcctatgcgttctcgatcttcggtgagatcgcattctgggcttcggtcgcggcgttcgcgctcgcggcggtgatggccgtcctcgtcggactcggcttctggcacgcggggcgcgtcccgctcgacaaggagatcctggtcgattcgaactccgaacgccaggtccacacgatggcttgagggcgagatcgttcacacggtgtcagcgcgctctggggcaggtcctcagggcgcgctgacgtctgcgtggttgtctcgccacgtagagttgggtcgtgagcctccccagtcgtcgatcgcaggagcgtcgagccgatctgacaacccctgctcgcacctcgacaggggtcgggcgccgaacgacgtctggagccctcgggccagagcagctcatcgagctgcagcgcacgatcgggaacgaagccgtgcagcgcaccctcgcacgccacggttccgttggtcgccggcgctcgggcgccgtcgccgggatccagcacgctccgtcgacgttggcggcgatctctgcacacgggtcgacgatccggcacgcggtggcggcggcggttgctgcggtcgtcgttgcgggggtccagaaggcgacgggatcgaagggcgggtcaccggagggtgacctgctggatgcggcgctgggcttcgcacgtgcgctcggtgcgagcctcgagcgagacgtgcgcacggggagtggtctcgtcgcacgatctggcgacgatcgcgcgacgcttggcgcacgggcacagttgctggccggcgaagggagcctgtccgacacgaaggcggcctcgacgatggccaccaggctcgccgaggtctacctgaccacggctctgaccgaggaggcagcggccgccgctgagcgcaggctcgccgagatcgcgcccgagatcggtcagatcgacggcgagctcgctcgagcgatcgcgcacgcgcagtccgaattggaggtcgaacagcagctctcggcgacgacgcacaccctgaccgatcgtctcacgaaggtcgccgtcaaggcgatcggtcagaagcagcaccgtgcggtgcgcgatgcgatcgcggccgatggccttcgtggcgcgacggacgtgctcgagcggacggtcatggcggagtccggcccgaaggccaccttgagccagacgtcgaagtcggtcatcgccaaggcactcggttcgtcgctcagtgcggacgcgctcgaggtcgtcgacgaggcctatcagtcgctgcgtgcagcggtcgcgacggcggttgcggcggagatcacctcacggatcgagggtggatggttctcgcggggatcgaagcgagcttccgtgctcgaggcacgagccgaggccgcccggctcgccgacacgctggcgttcgccttggagcgggaccttcggaccggcaccggcgtcgccggcacctatcgcgcgaccggagacgcagccacggatcgggtgggttcggcgacccacacccgataccgggctggtctgctctcgaaggagcgcagcaaggcacccgagacactcgtgtcgcagcttgccaaggcctatgggcatctgtcgctctcgcgtgcggccacgacggcggtgacgtcacacctcgacgagatcgatccgtcgcttcccgaggcacggctccggctcgtgcgcgcggtcgacggtatcgccgatcgggatcaggcgcgcgccgtggtcgccaagcagctcgcgtcgctcacgagccgctccagcgcgaacgccgtcaaggccatcacctcctcgtcgaacaagccgcttcgcgacgcactgaaggatgagagcgcgaagggcgccgtcggcgagctcgaggctgtgcagcgtcaggagtcgggtccgagcgctcgccaaagctccttgaccgatcaggtcctcgcccagaccgtcacgttgccgtcgctcacgccgttcatgtcgctcgtcggggcgatcatcgatcgatcggtgcagcacaacggggacgagatcacccttgatcacagcgtgcgcatcccggtgtcgcacggcgcattcgtcgggctccgagccgtgggcaaggcgtcgcgtgaccacgacgcgacacgtgcgggcatgaccttcagcttcacgggcggatgggacgccgccatcgcccgggcgatggccggtctcggtggctacctgaccatgacctcgaaccgtggtggacacggcgccatggagatggcttcgtacaccctctaccgacgctttcgggagtcgcggttggtgcccgccgatctcacgagcaccctctggggcatggggggcatcacgaagggcgccgacgaagagcaagctgcggcacagtaccgtgaggcagagtcctgggcctcgggcatcgagcagtcgatgacggaggcagatgccgctgagtcgggtctccacgccgaggtgagcggtcgcctcgggcatgcgagcgttgcccaggtcgagggtggattcgctgtcaacaccggtactcgctacaccaagcagacgttggagcgctctggtgcgctcgcagcaccgcttgcaacagcgggctccggccgccagccgttgcgcggcgagcgggtgacgaccttcgaagcgttcgccggagcctcgggtgggggcggcatcggcaccacggaggcgtacctcacctacagcgctcccgacgcgagcctgcacaagccctatcgcttcagcgtccaggcctcggccggggccatgatccccggcatgcccggtcagatcgtggactgggcggtcgagggagcgtccaagctgacgagcgctgcgatgggggcggtcaacaagtgggagcagggcagtaaggggagcgcggcgctcaaaggggcggaagtcaccgccaaggccgggctcgaggtcatcgagttcccggtgctcaagaacgctctcaaggaatcggctggtgtggcagcgatcctcggggcgccgatcgtcgacatcgccgagtcgtcgacgctcgcccaccagcccagcgtcgtcggcgtggccgctgcgcccctcgtcggaaaggccaatcgggagtacgccaaggaggctggctcgctcgcctccacgcggttgatgtccgcatcgaacccgacgagtgggctttccttcaccctctacatcgacttcttgcacccgaaggagcgcagctacttcgcgctggcgcgccagacgtcgacgcaccatgacgcgcacgtggtcgaggcgaaggtcgtcaagcgcacgtcgctcttctacttcgatccgaagtcgggtcgcctcgaggctggcggtgcgcgcctgggaacgacgcgctgatggcgttcgatctgttcgacgtcgttgtcgatgcgtgtcgtgtgcagggcttggacccccagcctgtcggcggctacgaccatgtcgtcgtggccgaggtcgaccggggggatcgccgttggcgcttgttcgccgaggccgatggggcaacccccggcgtcatcgtctactcggtgttgccgtacgccgtcgcgtcgacccatcgagacgaggtggctgggttcgccgtgcgggtgacctacgtgctccgctacggggatctcgaggtcgatctcgacgatggggaggtgcgtgttcgaacgagtgtcctggtcggggctggcccggtcgcactcgatgtcgtggcggaactcatcgagcacaacgtggcgatcgccgagacggtcttcccgctcgtcgagcgtgtcgccgtaggcgagctgagcgccgacgaggcgttcggtgtgcttgcgtcatgatctggggagggtcgacgttcgtcgtcgcattcgccccgactcggacggacgctcgagggacggcgctgctcgagatcgagggtgacctctcggatcagcgaacgggagtgtcgagaggcttcgggccgcctgagggtcggtggctcgcgcgggtgggccgttcggcgcgaggagcgggccgctgcggtgttgcggtgtgtgcacgcaagcggacggtttctgtggggcgttgagacggcaggacgcggtgccgtggttgcctgtctcggtggggctgtcgtaggatcgtcgcgtaccgatgaccatccgagtggaggttggtatgcggagtctctggcgtgttcgccatccggtgcgggcggcgatgccacgctccatccgacgagcacggcgtcgggcgtggcgcctacgtcatcctctgcgtgcgtcgctgtggacgctcgcgagaggtcgccgtccgcgccgacaccgccatcggtgaacaccagtgcgatcgacgggcgtccgtctcgatcctcccacgtggcgtgagctacgatccgctcatggatcgcgcggctcaggcgtcgtgggagacctggtgggtcgagggcgaagcgtgcttcgcagccgttgtggcgacgctcgaggccgatgccctgacagggccatccttgctcccgggatgggatcgtgcgacggtcatcgcgcacgtcgcaacgaacgccgacgcgctcagcaacctgctccgctgggctgcaacgggagttccgaccccgatgtacccctcaccggaggcgcgtcgtcgagcgatcgccgagacggcgagcctccctcgcgaccagctcgtcgcgcgagcggagagcgcgcgaggcgagctcgccgcacgcatgcacgatctcgctccagaggcatgggatcgcccggtcgagacccgtgacggacgcgcgatcgtggcgagagaggtggtgtggatgcgttgtcgcgaggtgtgggtgcacgccgtggacctcgcggcgggcgttgggttcgagtcgatgcctccagccctcctcgtcgcgctcgcggacgacatcgtggccatgtgggcgaggcggagcgtcatggcgccgtgtcggctggtcgccggtgagcacgcctggggcgtcgaaccgccggtcgtggaggtcgatctcgcgaccgcggtggccgttctgagcgggcgtaccccgctcgagacgctcggccctgcggtggcagggctcggtatgcctgcgtggatctgaggttgtcgtgcgcaggtgctgtcgggtcggtgtcggcgccggcgcggatgtggcaacgacctgtcgggcgacggtgacggccacgtgcagcacggcccgctgcccgacgaacgctccgcgcgaccgacgttaccactgggtcgggactcctcagagcgcatcttgttcggggatcgttgtcccatgttggccggcgcgtctcgcacacggccgtgaccgagggcgagggcgaccacactgggacgatgaccaacgtcgagaacgtccctgaagttcgtgtcgtgagtgccgctcgagaggtgcacgcgacaccggcgaccatcttcgagctgatcgccgacccgtcccgtcatgcgtcgtgggacgggaacgagaacgtggcctccgcgagcgaacaccagcgtgtgacccgtgccggcgatgtgttccgcgcgaccctcacgaccggcgctgtccgggagaaccacgtcgtggagttcgaggagggtcggcgcatcgcgtggcagccggctgagcccggcaaggagccgcccgggcacctgtggcgctgggagctcgagcccctcgacgcggagcgaacgctggttcgccacacgtacgactggacggccctcaacgatccgaatcggttcgctcgggcccgagccacgacctccgagcggctcatggcatcggtcgagcggctgtgcgcactcgcagagcgcgaggcctcggatcctgcctgagcgtgcgcacgccgttgagcgtgtgttcgatggggcgaacgttcgctcgtggatcaaggccgatgcctcagacgtcgatcgggtgatctcgaaggcctggcagagccggcggtgggattcgaacccacgacctgacgattacaagtcgcctgcgctaccactgcgccacgccggcgggcgcctgcaggttagcttgcctccaccgaacgtcgggttcaccgcagcgccgctcgccgtacggttcagcgagcgtcgtgggcgaggccacggtcctcggggccctcgcgatcgcggggccgagtgctgaccgcgaggaggtgggcgatggtcgttgccgcggcgaccatgcgatcggtctcgcgcatgatgacgcggttgcgctcgctgacgtgaggtgcgctggactcggatgcgaggagcgcggtcgccagctcgatctgggtcgtgcgggcgcgagcgacgtcgacggcgaaccgatctccgcgggccgccgccgcacagctttggaggaggtccgcgaggtcgttgccgaggcgtccgaggggcacgcttggagccggtgtcgtgcgttcgaggtcgaggagtcggtccagcacgagggcgctccagacatagcgccgcacggcggcgaggacgccgaggacccgctcgtcgtcgttgacggggtcggagcccgaatgtcgtggctcgtcgagccagcggctgaccgaggcctctgcccgctggcgcgccagccgtgctcgtcgacgcgcatcggtgaccgcgacccgagcagtcggggtgcctgactcccacgcgctgccgagtagcgctgcgtgctgcgcatccgcctccaggagggtggcgagccgctcgccgactcggcctcgttcccagctcggccacgcgatcaccgccatcaccgcgaggagactgccgagcaccgtgtagacgctgcggtcgatcgcgaggccgagcgcaggcgctcccgtgaaggcgagcagaacgacgacgagcgatgacaccgcgaagctgaagagcaggtagttcgcgcgctgggtcgcgatggcaaggccggcgagtgcgacactcgccgcggccagcgtgacggtggatggatgtgtgagcgcgagcagtgcagtcacgagcccgacgcctatgaccgtgcccatgctgcgcgcgaacgcacgacggagcgtcgtcgtgaagtctggtcgaagcacgaagatgaccgtcagtgggagccagtagcggtgggccaccggaagcgaggccgcgagcgctactgctactacgagtgtcgccgcgacacgtgcgccatggtgaccgacctcggacgagggtgccagggaccgtcgaagcgtcgccatggcgtcgtggagcgatgcgcggagctcaccctcgacgcggagattcgtgccgtcggcacggcgcatcggtgccgctcgccccaggaccactgcgccgagatggtcgaggctgcgcaggctcgcggcgaggttctcgatggcgaccgtcgcctcgcgagccccctcgccgagagctccgtgatcgtctcctgcacgctcgagcgtccagagggcgacgccgagtatccgcgcgatcgtcggcggcggctcatggtggcgctgggtcatgagccgacgtgcgagcacgtcgagcccgtcggcgagcgccgtgagcgccgtgtcgatcgcgtcggcgacgatgcgtgcgtccgggacgtcatcgtccagcgccacctgaacatgggttcgggccgtggcgatcgcggctgcctcgaggcggatgcgctctgcctcgtcggcgatggagcgtagagcgtcgaggatcgctgggtcgctaaagggctgcggttcgcgaagagcctgtcggagcgtctccgatccctctaggtcgagcacgctcggaggcgcagaaccgatcgcacgaagggtcgaggcgcgctctgcgagaagcgtcgcggcggcggtccgctccatcggtgacctgacgaagggaagggcgaagccgacgaggagcagctcgccgagcccaccggcgagcgtccaccaccctgcgacgagcgctgggccgagcgccaggtgttgatccgcgaacagtacgacgccaagcacggcctcgaggccgatgacgccagccgcagggccgagcgcgacggcccaaccggcggccaggccccagatcgcgaggatggccatctcggctacgaggacgtggccgagggtcgcccccacggtggccgaggcggcgaagacgatcgccccgaccaccatggtcacgatgcgagatcggtaggcaccttcgagcgagctcatgccggcgatgatggctccgatcgctgcctcgatggcgcccccgagatggtggctcagcgcgccggccgtgatagcgaccgcgacggcgagggctactcgagcgccagcggcgactcgcaggccgcgccgatcgaatcggtggagatcgagagccgggcgcgaggccgctagcgccgtcaccgtagccccggccccagtgctccggtgctggcctcaagacgcaggagccacgtcttgcgttcgtcgccgccggcgtagtgaccgggcgcaccgtctgcgcggatcacacgatgacagggaatcacgagcgggagcggattgcgggcacacgcagtgcccacagcgcgcgcggctcggggccgaccgatggcggctgcgatggcgccgtagctcgcggtggtgccgtagggaatgcgcacgagcgcggtgcgtaccgccgcgtcgatgccgcgtgctggtgcgagatcgatggggacgtcgatgtcacggcggcgcccacggaggtatgcatcgagcgcgcgctcgacgacgacggcgagcgccgcacgtcgcggcgagagtccgggcgtcggctcgaccgcgtcggcgtcgaacgtgatgcgcgcgagcccacgatcgctgaggccgatcgccacggttccgaggggtgtctcgacgagtgaccacgacacgtcgtgtccgttggctctgccgtcgtcaccgaggtccgctcgcacgtggcgtgccgtgacgtcgtgaccagcccctcggggtccccgatcgtcgtgcgggctgatcgctgtggcatcgatgccatgtggtgccagcgcgctgctcaccgcagtgcctcctcgtgttccaacagagaacccgatgcgcggcgcaagcgctgcggctcgggacgccccgtgcggtcacggtgcggccaccaggcggcgctggctagcgaccactggggagagtctactcgcctcgcaggtgctggtgccgggccgcgcccgactccgtccccctggtcgagatctcgctcgcaccagctagggtggttccgatgccgtgagcgttgggctcgcggacgctggcgcctcgtgacgccaggcgggccaacgagatcagttctcggccggtgtgatgcactggccgtggtgtcaagtcggccgttctttctcgagccgacaggagacattacgttcatgcatgctgacctcacgacgcccacctccaagcccgttgctggctcgtcgttcgccgacctcggcgtcccggaaccgctcgtggcggtggcgacggcccaggggctgctcgagccgactcccattcaacgcgctgcgcttccggacgccctcgctgggcgtgatgtgcttggctcggcgccgacgggaaccggcaagacgctcgccttcggtcttgcggtgctcgcacgtgtcagcgcgagcgcacgcgcgaagcatccgagggcactcattctcgcgcccacccgggagctcgcgatgcagatcgcggacgcactcgatgccttcgcacgtgcagagcgccgctcggtcgcggtcttctatggtggggttggctacgggcgccagctccagcagctgcgccgcggcgtcgacgtcgtcgtcgcgacgcctggtcgcttggctgatctccgcgagcgtggcgacgtcgacctcagccacgtcgaggtcgtcgtcgtcgacgaggcagatcgcatggccgacatgggcttcttgcccgaggtgcgtcgtctcgtgcaggcgacgtcgagcgaacgtcagacgatgctcttctcggcgaccttcgagggtccggtcgagacgctggtgcgcgagctgtgccacgacccggtccgccacgtcgtgacgcgaccggacgacgagcagggtgaggtgggtcaccacttctggaacgtcgatccgagcgagcgtctccaggtcacggccgccgccgtgcgagctgcgggaccggcggtcgtgttctgccggacccgtcgaggcgcggatcggatcgcggagcggctccgcggcgagggccttgcgacggccgcgatccacggcgatctcaatcagcgtcaacgcgaacgcgccctcgagggctttcgtgctgggcgcatcgatgcgctggtcgccaccgacgtggcggcacgcggcatccacgtcgatgacgtgccgctcgtgatccacttcgatccaccagagcggacgaccgactacgtccaccgttcgggccgtactggtcgagcgggtcggcgtggctcggtggtctcgttggtcggaccacgtgagcgctccttcgtccgatcgctccaacgcgaactcgggttgccgcacggtcttggagcaccggacgcggctctccttcctggctcaggtcgcgtcgagcatgtcgggggccgccgtcccgccgtcgggcgcgaggtcgaagagtctcgtgcggcgagcgaggggcggggtgtgccacgtcagcgcgatccgagagcccgccgtggctctatcggctcgcgtcagggtggcgccgttcggagcgacgcgcgtagcgcgcgtgcggacgcaccgagaggcggggctgcttcgcctcgtcggcctcgtcgtccggagcgctaggcgcgaggcgtctggtcgctgctcggcgcgctcgagcgtgcgtgtgttcgccaggcgccgagcagcgccagtcgacgtcgctgctgggaggcggcggcgcgatcgaggccgtggtcgcgctcgatgagagccgcgctcaccgcatcacggagctcgaccggcttctgatcgtcgtacttgaacttggcgctgacctcgacgatctcgagctcgagcgctcggatcgcgccgagcatggtgccatagggcggctcgccggggacgacggcagcgtgacgaccctcgggctggagatcgccgagctggcgctcgaggatcgccgcctttgcctcggggtcgtcgacgatgcgtggtcgacagacgaactgaacggcgctgtagtagctcgtcggcacgccgtctgccggggccgtcgcatctggcgcgcgccaatagcccggaatgaacgcgtagtcgccgtggaacgcgacgcgcacgcgcgtggctcgctcgaggtgtggccatacgggattggtgcgcgcgagatgagcaacgagcacggtgtcgacgagggagaggtggagcggcaggacgaggggagcctcgtcggggtcgaggttggcgacggcgaggacgccgaacggctcgtgctcggcgagccaacgacgccactcgtcctcgctggtggctgcgtcccacgggtgaatcagcatggcaggtcccttgcgtgtgtcgcgacggctctcggtgcgccacagcgcacctgcgcagcgtaacacgatcgccacgcggacccacacggtgccgtcgagcgcgccctagccttcgcgctgcgcacgagcgcttgtgcggactcgtaggtgacgacggcgcacgagtctcgtccgaggcatgggtcgtgaggggatgatggcggagtggctcgaggaccatctggcgatcctgttcgtggtcgcggtcgggatcggcgtcggcgttgggcggcttggcgggggaggtgccgtcgcgatcgggccgacgctcgcactgctcgtcgcagcgagcgccgtgaccgtgggcgctggcagtggcgtgcggtcaggttcgcgttggcgactggtgctcgtcgtcgtcgttgcccaggcggggatcgtcgtcgtcaccgagctcgtcgccgcgatcgagtccggcccgcttcgcgatgcggtgctgtgcctcggggtcgcgcccagcgaaatcgcaacgatcggtctggcggcgttggtggggcgggaggcagcccgcgctgcggcggtgctcgtggcgggctcggcgatcctgagcgtcgtggttgcgggccccgtgctcgggctcctcgcagtctcggggcatgtcgcgtcgaacggcgtcctcgtcgctctggcgctcgaggtggccctgccgggagcgatcgggatgggggtcgcgcgtctcgtccgacgtccttgggttcgcggcactgggcgtctcgtgagcccactcgcgctcctcgccctcggcgtcgaagtggggacgttggcgccgatcgccatcgctgacgtggctgcgatcggaagcttcgcgctcgtcatcgttgggagtgcggcggttgcgctcgcgatggcgatgctggttgggacgactgcacgtgccggtgtggtgctggcggtaggggtgcgggacttcgcggtcgcctcgggcatcgccgaggcggcgatcggggcgcacgcagcaggcgtgcttgcgctctacggactgctcggcgttggcgtcgcggccggtgccgagcgctggtggcgctcgagaggagcgcgctcctagcggctcccgagcaccatcgccgtcggcgaggcggcgtgcgcccgccgcctcggtggtctagcgtgaggcgcggaggcgatgggcgtgggagcgacggtgcgcatcgagcgagcgggtgccgtgtggacggtcctcatcgatcggcccgcggtgcgcaacgccgtcgatcggccgaccgccgaggcactggccgatgcgttccgagccttcgacgccgatgacgaggccgctgtcgcggtgctgagcgggaccggcggttcgttctgtgccggtgccgatctcggggccttcgggaccgagcgcgagaatcgtctcgacccgaccggtgacggtccgatgggcccgacccgtatggtcctctcgaagccggtcatcgccgccatcgagggctgggcggtcgccgggggtctcgagctcgccctctggtgtgacctacgggtcgcggccgaggacgccgtgctcggggtcttcagccgtcgctttggcgttcccctcatcgacggcgggaccgtacgcttaccgcggctcatcggtcgatcgcgggctctcgacctgatcttgacgggtcgggcggtcgacgcgaccgaggcgctcgcgatgggactcgtcaatcgcgtcgtcggtcgaggggccgcgctggatgcggcgacggagctggcgaggcagctcgctgggtttccgcaggcgtgcttgcgcagcgatcgcgcggcactgtatgcggccgagggacagtccgaagccgacgcgcttcgcacggagttcgtcgcaggtcagcgtccgctcgaggcagaggcgagagccggtgctgggcggtttcgccgtggggcgggacggcacggacggccactggatcaatgaccagggacgtggctgcgttgacgatggcgggccgcgcccagatcagggacgatcacgaccgcacccgtgcagtggtgcgcgacgcgggcgctcacggacccgatgagtgcatcggcgaaggggcggtgtccgtgcgcgccgacgacgaggagctgggcgtcgcgggcttcgacgcagagctgctcagcggggtctccctctcgaaggaccgactcgacggcgacggtgggatggtcctcgtcgatgtcggcgagcacgtcgtcgagcacacgtcgagccgcgcttgccaatgccgtgtcgtcggcgatcggtccgagatcgcccgctccagcgagttcgtagtcgtagggcgagcgccagacatgcacgacgcgcaccgtcgcgctgcgcagggcggcctcggcgagcgcccaacggagcgcgagtcggcttggttgggagccgtcgacgccgacgacgatcagttcggccatcagatcatgtcctccttccggtcgtggcctcggtagcgcccgctggagcgagggccgccgatggctccgctctcgacggtgcgctccgtacctgtctgagcagaggcgccttgatcgtgtcgagtgcgagtgtgagcaccccgacggcaccgatgaggccgacgacgtctgggaacggtacgggggccatgaggatgcccgtggtcgcaaggaccgccacgatcacgagatcggcaagggacgtgagggcgagccaccaactcgggggcgaggtccacagatggccgggttcacgcacgaggtagaccgtcgcctgaccggttgcgacgagcatgacgaacgcgagcgtctgcgtggatgccagcgacagcccgagcacgtcgcgtccgatcgcgacggtggcgaaggccacgaggagccacggcacagcgatgacgagggcggccagggcgagctggttcactcgccaacggtccggggagggggagtagctgacacggtcggtggcgagcgacatggtgacgacgtcgttggcgaacagcaggaggaggacgagtcggggcgtcgtcacgaaggtgttcatgacgaggagcccgagaccgagaaacagcgagacctggaaggtcttcgcgatcttgttgagtgtgtacgtgagcatgcgctggtagacacgacgcccggtctcgacggccgcgacgatgccgccgaggcccgggctcgtcagcacgaggctcgccgcactcttggcgacgtccgtcgcgttcgagaccgcgataccgacctccgcacgcttgagcgcgggggcgtcgttcacgccgtcgccggtcatcccgaccacatggccgcgtcgctgtgcccgctcgacgaggaggagcttgtcctcgggaaggacgctcgccatgacgtcgacgtcgatcgggccgtcgcttcgtcgccgaaggtcgtcgaggtcaccgaggcgctcgccgatgccgacctcccgagcgaccgcgagtgccgtctgtggtgtgtcgcccgtcaccatgatgacccgaacgccgagctcgtgcaggtggctgacgagcgcgccggagtcggggcgagcaggatcgccgagggcgatgaggccgacgagctcgagggtcgtcgtgcctcgcgcgaccgcgaggacccgcgcgccgcccgaggccagcgccgcgacggcgtcgtcgaggccggggggtgggttctcacagaggctggcgacggtcgctggcgcgcccttgacgatgcgcgtctcggtgtcggccgcgtcgcgccagagcgcctcggagcgcttggtcgcaggatcgaacggcgtgaactgcacgcgctcacctggtccggctggcgacagtgtgcgagcgagcaccgcgaggtcgatcgggtcttgggtggctgcgtcggaggcggctgcggcgaggccgagcacgtcgtcgcgggaagtgtcgccgaaaggggtgaccgccgtgaccgtgaggacgttctgcgtgatggtgccggtcttgtcgctgcagagcagatccatcgccgcggcctcttcgatcgcactcaggtgcgtcgcgagcacgccctcgcgcgcgagcgccatcgccccgacggaactcgccagcgtgaaggtcgccggcagggcgaccggaaccgccgcgacgagcaggatcaagacgaacgggacgagggttgcggggtcgagatggcgaacgagaccgtcgacgacgatcgcgaccacgagcagagcgtccaaggcgagcagggcccgcacgatacgcaggatcgtctgctcgaggtggctctgggtcgtcgccgtccgcaccagttgtgcggtgtgaccgaagtaggtgcgctcgccggtcgcgctcacgacggcggtcgcctcgccgcgcacgacgaccgaaccggagtagcacgtccccgagccatccaggttgaccggtcgcgattcgccggtgaggacggatgcgtcgagcgagatgcgtccgtcgacgacgtcgaggtcggcggggacgatgtcgccgacgcggacgtggacgacgtcgccagggacgaggtcggcggcgtcgacggtgcgccaggtgccgtcacgccgcacgcgagcctgtacggcgagtcgttggcgcagcagtgcgagcgcgccgtcggccctgccctcttggacgaagctcagggcgccgttgaagacgatcaggagggcgatgatgatcgcttcggtgaggtggtgatcgagcagctcgagcacgaccgcagcctcgaggaggtaggcgatcgggccggtgagcttggacagcaagcgccgcaggacgtgtggccgttcgggtgcgacggcgttggggccgatggcggcgagtcgagacgcggcttcgcgctcggtgaggcctgcgggctcgggcgccgaggggctggtcgcagactggaagggatccgatgtcgtcggttccgtgtccgccatcgggcctcgctcagcgatcggtcgcagattgcgggaggtccgtggtgtccggcacgatgacgatggggaccggtgcgtggtgggcgcacgtcgtcgcgatcgacccgaggaggagtgccgcgagcgagtgggtgcctcggcgccccacgacgagcaggtctgcatcctcggcgtggtggcacagctcgcgtcgcgggtcgccgcctacgaccacggcttcgacctcgaccgaaggcgcgacggaggcggtctcgtcgatgaccgcctcgaggcgctcgcgcaccgcgcggagcgcgacctcgtggtcgacttggaacctcggggcctggagctcgaaggtgagatctccttcgtaggggtcggaccagaccgagagcgccgtaacggaccaccctcggcggcgagcgtcatccttggcccaggcgagtgctcggcgcgatccgtcggacccgtcgatgccgaccaggatgcggccggaccgcggaggcgcgtcgcctgcgtggccgggccgtgtgatgagcagcggggacgccgcgtggcgggcgcaggccgaactcaccgagccgaggagcaggcgctcgaagccgccccgcccacgtgatccgacgacgaggagcgacgctccgatgctgcgatcgcagaggacgtggtcggggccgccttctgagacgaccgggtcgaccgtgagcccaggcgggaccgacgtggcctggagcgcatcagccagcacacgtcgggcggcctcggcgatcccgtcgtcgagtgctgggtcggggacgtcggctccacgtgcggccacgccctgccatgcggtgaccgcctcgaccgtcgcacccctgatggcggcctcgtcgagcgcccatcggagggcgccgagcgatgcgtccgagccatcgacgccgacgacgacgcgctctgccatgacgacctcctttgccaccgtgtccgtgagtgtagggctcgctcgacggctcgaccagggacctttggtcatggggagcctgccgaccggctcatgggcccgtgatcctacggtcgtagcgatcgggcggctcggtcgatgccctccgacgccatggggtgggggaaggccatcgtcgcgagctggtccaccgtgagcccggcgtggatcgcgagcgcgagcggcgcgatgagctgcgctgcgtcgacgccgagcacctgggcgccgagcagggtgccgcggtgcggctctgcgatgagggcgaggaacccttcgcgttcgtcgaggatctgggcgcgcgcatcaccggcgaagtcgtagtgacccaccatgacgtcgccatggcgcgtccgcgcctcgacctccgtcagtccgacgctcgcgacctcgggctcggtgaagacggtcgtgggcaccgcatcgaagtccattgcgtcggtagatcgaccccctgccatgatgcagtgggcgacgaccaggctctggcgtacggctgcgtggaacagtggggtccgtccattcacgtcacctggggcccacacacgtgggtgcgaggttcgaagctgggcatcgaccgtcggcgcgcggtcgggagcaagcccgagcgcgtcgatcccctcggggagctggacgtggcggcccgtggccatgatcacgagatcaccccgggtgacgtggacgtcgccgccgtgctgccagctcacctcgtagtcgctgccgacgcgcgtgatgctccgcacgagcgcgtcgacgtggagctgcacgcgctggccgaggaggctcgcgaggcccgtcgcaagcgccgcgtcgtagcccggcagcaggcctccggttgcttcgaggatcgtcggtgcggcccccaggttcgccagcatggaggcggtctcgacgccgatgtagcccccgccgatgatgacgggtcgcgatgggaacgggagatcggcaccgaggcggaagagctcgtgcgatgtcacggcgagatcagcgcctgcaatggcgaggcgactcggtgcggagccggtcgcgagcacgaggtcgtggaagcggacgagcgtcgtggaaccgtcggcctcctcgatcgcgatccgttcggcatcgtcgatgcgggcggtcgccgtcatgaaccgaatcgtggaggctcgcagttcgtcggtgtgctgctcgtagcgcaagcgctggacacggtccttgtgtgcgagcacccccgaccagtccacgtcgagcgcggtgcccctcaggccaaaggtctcggcgcgcgtcgagcgcgcacggatgaggcttgcctcgcgaacggccttggatggaatgcagccctcagcaaggcagttgcctccgaggttgccgatcggatcgaccagcaccaccgagcggccggcccgatccagcgcgaacgccgcagggtagccaccacctccggctccgacgatgacgacatctgcggttgcttctcgtgccatggtgacctccaccgtcgatgacgaccgtagcgcagccttggcgtcctctcccgtcacgcccgtgggcgtcggcgagcggctggttgcgctcgtcacgagtctggagcgcctcggcgcggcgggggctgcgagggcacagaaagggacagaaaagggaagaaggtcccatattggaatggatccaaggttggaagtgtgctaggttggacgtcatggagaacgacggcgagcgccgtgcgacgcacgcgaccgagcagcttcgcgcggcaggtctgcgggtcaccgctgcgcggctcgccgttgtgcgggtcttggagcgccacccgcacgccgatgccgagtcgatcatcgccgaggtgcgaggcgaactcgggaccgtgtcgcaccagacggtctacggcgtcctccaggcgctcgtcgaggcaggactcgcccgccgcatcgagccggcagggagtccgggccgctacgagctgcgcgtcggcgacaatcatcaccacatcgtgtgccgaagctgcggtgcgacggtggacgtcgactgcgtggtcggcgagcggccctgcctcacgccctccgagacgcacggctacctcctcgacgaggcggaggtcacgttctgggggctgtgtccggcatgtcgcgatggcgagcgcgcaaggcactccgagagggtcgatgcggacatcgacactggcatccgtggaggtacgcaatggatgagatgacagacgcccagggctgtccggtgctgcacaccgtcgagctcgcgaatgcggccaagcagtggtggccgaatcaggtcaacctcaaggttctcgatggacctgctccgaatcgatcgccctatggtccgagcttcgagtaccgtgcggcactcgcatcgctcgacgtggaggcgctccggcgggacctcatcgagctcatgacgacgtcccagccgtggtggccggctgactttggccactacgggccgctgttcatccgcatggcgtggcactcggccggtacctatcgcatcgccgacggacgcggtggggcgagccgcggggcgcagcgttttgccccggtggggtcctggcccgacaacgccaacctcgacaaggcgcggcggttgctctggcctatcaagcagcgctacgggcgtgcgctgtcctgggccgatctcatcgtcttcgcgggcaacgtggcgctcgaggcgatgggtcttcggacgatcggcttcgccttcgggcgtgaggacgccttcgaaccaccgctcgacacgtactgggggcccgaacggacctggctgggcgacgagcgccatgacgaggagggcgagctcgagaacccgttcggtgcggtgcagatgggtctcatctacgtcaacccggagggtccgagcggtcaccccgatcctttggctgccgcgcgcgacatccgcgagacgtttcggcgcatggcgatgaacgacgccgagaccgtggcgctcatcgtgggcgggcacaccttcggcaagttccacggtgcggcaccggcgagcttcgtcggccccgagccggacggtgctcccctcgagcagcagggcctcgggtggcgcaacacctacggcacgggtatggggaacgacacctacacgggtggcccggagggcatctggaccccgacgccgacgcagtgggacaacacgttcctcgagcagctcttcgcctacgactgggaactggagcggagcccagccggcgcgtaccagtggaccccacgcaaccccgaagcgcaaggaacggtgcccgacgcgcacgatccgacggttcgtcacgcaccgaccatgctcacgacggatctcgctcttcgcgaggatcccatctatcgcgagatcgccctgcgcttccgcgaccatcccgacgagctggccgacgcgttcgcacgtgcctggttcaagctcatccatcgagatctcggtccggtgagccgctatcagggtcctctggtcccgagcgagacgttcgtgtggcaggatccggtgccaccggtgacccatggcctcgtgggcgaggcggagatcgcagagctcaaggatctcatccgcgccagtgggctcacgactgctgagctggtacgcaccgcctgggcctccgcctcgacgtttcggacaaccgatcggcgtggtggagcgaatggtgcccggatacgcctgttgccacagcgaacctgggcggtcaacgatccggccgagctcgctcgcgtgctcgcggtcctcgaggccatcaaggttggcttcgacgagcgccatgggcctgcggtcggtgtctcgctcgccgatctgatcgtcctcggcggcgtgacggccgtggaggacgctgctcgtgcggccggcgtcgaggtgtcggtgccgttcacgcccggccggaccgatgcgaccgaagccgacaccgacgcagagagcttcgcggtcctcgagccacgggccgacggctttcgcaactgggcccgaccgggagagaaggtgccgctcgagcatctgctcgtcgagcgggcgtgccgcatggggctgaacgccccacagatggtggtgctcgtgctcggcatgcgtgcgctgggcgcgaacgctggcggctcccctcacggtgtcctgacggagcgtccaggcgtcctcagcaccgacgtcgtgcgcaacctgctcgacatgggcatcgagtggcgtccggcgaccggcgaggatcagacctacgtcggtgtcgatcgtgtctcgggtgctcccagatggacggcaagcgccgtcgacctcgtcctcggcgccaatgccgagcttcgggccatctgcgaggcctacgcgagtgacgacggtcaggcgatgttcgtgcgcgacttcgtcgaggcgtgggacgccgtcatgatggcagaccggttcgacgtgcgctgaggtcgcgtccatacgagcgcgtcggcgggaggggtgaatgcccctcccgccacgaccatcggcaccggccggacggcgaaggatccaggccgcggccaggcttgccggcgtgcgcgggctgccgagctcaggtgtcagccgtccaggccgaggacgaacgtcggcttcggtgacgtgtcggggaggcggtgctcgtcagcgagccgacgtacggcggtcccgaccgcgaggaactcggtcgcatgttcaccccagacgtggttcgcgacctcgacggagaccccgacgatcccgttggcaccagctcgggtggcctctgcctgcatcctggtcagcgcaagttcgcgtgcctggtagatggcctcggtgaaggtgaccatctcctgattccacatcgactgacggagcgagccgaacacgctctggtgggcgacgtggtacacgcaggtgccgaggacgaacgcgaccgggacgatccctgtcgcgaggagccggtagaagtcctgggcggacaggtctgacgtgaagggcccgccgtcgggagcacggtgcgcgcctgcgcccgacagagaccgcaccgcggtgccggtggcgatgaactcgagcacatcttgtccccagacgtacatctgcatcgtgaggttgacgcccacgatgccatcagcaccaagctggtcagcctcggtgcgcatccgggtcatggcgagttcacgagcctcgtacatcgcctgggtcagaacctggagttcctggctctgtccccagcgtgcgacctgcaggccgacgtggtagatcgacgagccgacgacgaacccgaggggctcgaatccagcctcctccaggaggacgtattcggagaccgacaaatcggacgtgaagacgccgtgtggatcgcgtccgagggtgtgggcgagacgctcctcagcggcgcgtggttcgtaggcacccgaggcggcaggtgctgttcccggttgcgcgtttgacgggtcggggcggaacaagggcatggtggcctcctcgaagagcgacacgctgacgctatcacctggggcgcatcggcgctgagcgcctacgctggcagtggtgacacgtgcgcagatggcgggcggtcgtggtgagcgccgcggtttcgccgacgcgcgtgctgcgcttcgtgtgaggcgcttcagtgcatggtgggtggcccagctgctctcgggcatcggatcctgggctcaggcggtggccattccgtggtacgtcctcgagcgcaccggatcggcctcggccgtcggtatcgtcacgaccctgcaattcctgccggtgctcgtgctgagcctctttggcggggcgatcgccgaccgtgtgtcacgacgtggcctcttgctcgtcacgcagctgctcttggccttctgggcagcgatgctcggcttccttgtcgcgagccatgaggccccgatttgggtcgtcgacatccttgcgctcgccatcggggcgacgaacgcgatcaacaacccgacccagcaggcattcctgccggagctcgtaccgcgtgagctgcttgctccggccatcgcgttgaacagcgtgcagttcaacgcagcacgcatgatcggaggtgcggttggcggcgcgctcatcgccgcactgggagtcgccgcggcgctgtgggtgaacgccgtcagttttctgccggtcgtggccgtcttgatcctcatcgcctcccacagcgctcgggccgttcggcgcgagcgacccgccggcagcatgctgagcgagctcggttcgggacttcggttcgtgattggggcggcgccggttcgcagcgtggtcctcgtcttcggcttcgtcggcttgttcgggttcaactggcaggtcgccgtacccctggttgctcgctttgcactgcacgagcatgcgaacgggctcgggttgctcatgggagcgctcggcgcgggagccctcgtcgcgtcgttgctggcatcagcgttgggacaggcgacgcagcggcggctcgtcgttgcggggactgctctcggactctcgctgatcggtctcggcctcgcgcgctcgatgctggttgcagggttgctgctcgtcgcgggtggcttctttggcgtgctcgcttcggtgagcgccaacacgaggctgcagatgctcgctccgccgacgctgcgtgggcgagtcatggcgatctatgtgctgctcatgggcggtacgacaccggtgggcgccttcgtgctcggcgagcttgcgagctggctggggtccgcgtgggcggtgctcgtcttcggggtcgcaaccgcggccggcgtcgtcgctgcgagcctgtggggacgacaacgttcgggatcgagcggccagcgtgctgcgacggcccccatcgactagataatcgtgccgtaggaggcccaactcgaagcgacgctgctccgggcgtgccgtcatggtcgggttggttcgaactccgatgatccttcgtgcggggctcgtaccggttcggtgattcggtctcgtccgtgctagccggccggattcacgattgccgacagtccctgcgaggtgaattggccgtaggtctgcacgatgacgcccacggcggggtcgacggctgactcgacgagcccgtcgccgaggtagatgccgacgtgtccagggtcggccagggttccgtcgctaccagggacgagcaccaggtcaccaggggcgatctcgctcggggggacttgtacaccttcgttcatctgcgacacggtgtagtggtcgagtgccactccggcctgggcccaggcctccatcgtgagcccggagcagtcgaacacattgggtccggcaccgccccagacgtaggcgtctcccagcttcgagagggcgtagttcagcaccacctgctcttggggggtggtgcccgaagggatcgtatagccggccggaagcccatactcaccggcgggcaggttgccaccaagcccccctgtggctggaggcgcggccgcctgctgtgccgcctgctgtgccgcctgttgggcggctgcttgctgtgccgcctgctcagctgctgcttgctgggccgcctgctcagctgctgcttgctgtgccgcctgttgggcggctgcttgctcggcggcggcgcgcgcggctgcagcttgctgtgccgcctgcgcagctgctgcttgctgggccgcagcctgttgggcttcttgctgggcgacgagcgtttgaatctgggagttcacgcccgcgagctcgttggctgctgcttgctcagcgttcttggcggtggtctgctgggaggcgagctgggccaccagcgtgcgttgccgttgttgctgggcagcgagcgttgcctgctcttgctggagttgctgcttggcagcgacgtaggcgctgagtgcctgctcctggatggacgaagcgacgttgacatccgtctggacgagtgctgactgattcgggttcgccgagaggaccgacacgacggtcgagccagtgcctccgcgtgagaagatcgtgatcgcctcgtcgacgacctccgcatgcagctggtgcagccgcgtgagttggtgggcaatggcctggcggaccgtgctctcctcgcgcaccgtggctgcaaggcccgcttgcgcagccgtcatctgggacgtggcttggttgtactcgctctcgagtgcattgagcttctgagcgatggccgcggcttgggcgcgcatcgacgacaccgagtcgacgagacgtggaggtgggctgtcgacgtaggagaggccgatcaggccgacgagcgcaagtgttgcgacgaggtggcctggtcgggggcgacaggcgcgccagcgcgtcactgcgctcgtgcgggcggcctcgcgctgtcttgctccccaaggagcgtggagaccacctgatcgctgccgatgcgcgtccgtggcgccaacctcctcgtgacccgtcgcgtgttcttggtccttggatcggcacgcagcctatcactcctgaagggtgtcggagggtcgcgctagatctcgcctcggcggacgggctccgcggcgcccgccgtccgatgccagatggcgacttgctctcggcgcgtggagcctcgcgacatcgctcggagcgttgggtccggggatgtccaaccatacgaggagccacccatgcctgctgcgctcgatcgatcccgtctgctcgaggagctcaccgatggcgttctcgcgctcacgcagtcggagccctggcggcgctacctcgacgtgcagcgccgcttccatcgctacagtccacagaacgtcctgctcatcgaccgtcagcggccatcggcgacgctggtcgctggctttcgtcagtggcagcgccttggccggagcgttcgtcgtggtgagcacggaatctggatcgtcgccccgatgcgagtgcgacggacgacctcggacgatctcgacgaggaggtgctggctggctttcggtgggtctgcgtcttcgacgtggcgcagaccgaaggcgctgcgcttcccgaggtagcgacccgcctcgtcggagaggatccggctggggtcctcgccaagctcggcggcgtcgctcacgcactcggctttgccgtcgaggatcaccgcttcgagggggcgaccaacggcgactgttcgcacgagcagcgacgcatccgcctctccagcgaggtctcgccgcgccagcgcgtcaagacgctggcccacgagctcgcgcacgcgctcatgcacgagcgactcgagtcgcgtccgcaggcggagctcgaagccgagtcggtggcctacatcgtgtgtcgtgcgctcgggatcgacgcctcgaacttttcgttcgggtacgtcgcgagctgggctggaggaggcgcggcggctgtgcgtggcatcaaggcctcgtgtgtacgcatccagcgagcgtccgcgcagatcctcgagctcgctggcttcggcgtcccctcgggagcgggctcctagtcggtgcgtgagaactgccagatggctacgccgagcagactcaccgcagcgagtgcgacgagacccacctcgagcagggtcgggaggcgatagctaccccaggtgatcccagccccgaggatgcgagcgaggggtgccggtaccgacacgtactcgaagaccgcacggcgaagcggatcgaccgcgtacgacagcggatcgaaccgcgtgagcaccttcagccacgtcggcaagtcgcccgtggggaacaccgcccccgacaggaagaacatgggcagcacgatgaactgcgtcaccatctggaagctctccacctgagcgatccggctggcgacgaggacgccgaaggacgtcagcgcgaacgccgtcaggcccatctcaccaagcatcgtcaggaggaggagtggacgatagggcaccccgaccgcgccagcgagcaccaacatgatcgcgccctggatcgtcgcaacggtggccccgccgagtgccttgcccagcacgagcgaccatcgactgaccggtgcgaccagcatctcacgcaggaagccaaactcgcggtcccagacgatcgagatcgccgagaagatggaggtgaacaggatcgtcatcgcgatgacgccggggaacatgaacgtacggaagttgaagtgcgcggagctgacgacgatgccggagagtccggttccgagcacgaagaggaagagcaccggctgcacgagtgaggtgatgatgcgcaagcgattgcgcgcgaagcgaatcagttcacgcttccacacgatgcgcaccgctcgaagtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccaaaggtcgtccgacacacgaccttctgcctgggcgtagccctcccgataggcgttgtcgaacacggctgcttcggtggtcatgatcgcatcctcgctcgcatgaagggattggcacggaggccctcgagactcgagcgttcggcgtcgcggatcgtgcgacccgtgtaggtcatgaagacgtcgtccagggtaggtcgtgcaacccggaccgacgtgatggcaacctgcagttcggcgaagagtctcggaacgaactcctccccgttggcgacctggaggaggattccgtcgtcgctgtggcgggcctcgatgccgaagtgctcgccgatggcttcgatcgcgcgctcgtcgtcggcggtgcgcaactcgatgcggtcggtgcccacgctcgccttcagggcctcgggtgtgccaccggccacgatctccccgtggtccatgatggcgatgcgatcgcagaactcggcctcgtccatgtagtgcgtcgtcatgaaaatggtgatctgctcgcgctgctggagctctcggatgtaggaccagatgcctgcgcgcgtctgcgggtcgaggccgaccgtgggttcgtcgaggaagagcacccgtggagcgtggagcagaccgcgtgcgatctcgagcctgcgcttcatgccgccggagaacgtcttgacgctgctgcgtcagcgatcgccgagccccaccatgtccaggacgaagtcgatgcgctcggccacccgctcgcggtccacgccgtagagctcggcgtgaaaccgcaagttctcctctgcggtgaggtagtcgtcgagtgtgctgtcttggaagacgaggccgatattgcgccgtactcgtgcgcgctcgcgcgcgacgtcatggccaccgaccgtcgcactgcccgccgtcggggtcaggagcgtgcagagcatcgagatggtcgtggacttgccggcgccattggggccgaggaagccgaagatctcgcctgcacccacgcggaagctcacgcctcgaaccgcttcgacctcaccgaagcgcttggcgaggcctcgcacctccagtgcatacggcggtggcggctccgcatcgacgaggctcggtgtcgtggtcgtggccggctccgtactcatcgatcacctccatgcgccgaaagcttggcgcatgcaaccaccctaagggctccgggtggacgccgctacgcgtggagaacgcgcgcctagcgcaggcgcattcccgagatcgctcgagcgatgatcaggcgctggatctcgcttgttccctcgaagatggtgtagatcttggcgtcgcgatgccagcgctcgaccgggttctctcgtacgtacccgtagcccccaaggatttggatggcctcctcggtgacgcgaacggcgacctcgccggcgtggagtttggccatggagccctcggcgtgctcgaaccgctgtccctgggccgccatccaggctgcgcggtgcacgagaagacgcgcggtgtcgacggcgagcgccatgtcggccagcttgaaggcgatgccctggttctcgatgatcggtcggccgaactggacgcgttccttggcgtagtcgagagcccattcgtaagcggcacgagcgataccgaccgcttgtgcgccgacgagcgggcgggaggcctcgaaggtcgccatcgcggcttgggattgggcgcgcttgccctctcgggcacgggccagccgctcgtcgagccgttccttgccgccgagcagcgccgacccgggcagtcgcacgtcctcgaggatgacctcggccgtgtgcgaggcgcggatacccatcttcttgaacttctgccccatgcgcaggccaggggtgttgggagcgatgacgaagctggcctggccacgggcgcccagttccggctcgacgctcgccacgacgacatggatgtcggcgatcccgccgttggtgatccaggtcttcgtgccgttcagggtccacgtatcggtggccgggtcgtagaccgcgcgagtgcgcagcgaggagacgtcgctgcctgcgtcgggctcgctcacgcagaacgcggcgaggttggggtggtcggcagtcccgaagcactgcggcacccactcggcgatctgctcgggggtgccgttggccacgatgcccgagacggcgagcgtcgagccgaagatcgcgagcgtgatacccgcgtcgccccagcagagctcctcgagcacgagcggcatcgtgagaccggtcttgtcggcgaacgcgttcagcatgaagtcgtaggagtacaggccgatgcgggccgcttcctcgatgatgggccgtggcgtctcttcacgttcatcccattcgtgagcggcgggacgaatggtctcagcggcaaaggtgtgagcccactcgcgcagctgttgctgttcgtcggtgagtgcgagggaaaagggttccacggggacctcctttcgcgcgaagcgcgaacgttaccgagtggtaaccatagcgctggcttcgaggccgcgcaaggcatcaagccggcaggatctcgggcccgttaggggtgtcacgtacctggtaaccgagggcggcgatctcggcgcggagcgcatcggcgcgcgcgaagtcgcgatcgcgcttggcgtggtcgcgttcggcgaccagcgcagtgacctccgatggaatcgaggcacgcgggggcacggggagcccgagcgtctccagcatcgcagcgagcgctgcgcgtcggcggttagcgagagcgctctcgcccgcgagcgccgccgagcgcgcagcacgggcggcttcggccatgacggcgagtgcggcgggcgtgtcgaggtcgtcggcgagggcagcgtcgaactcctcgagatccgctggttcggccgcacgggcgtcgcctgcgccggcttggctgtcgaggcgggcgagctgcgcggccgcttgctcaagtgtggtggtggtcagctctactgggctgcggtagtgggcgcgaagatacgccagtcggaccacccgtccgccggcgctcgcgatcgcatcgtggaggccgaaggtgttgcccagcgacttcgacatcttctcgccttcgagctccacgaaggcgttgtggacccagtgctgtgcgaaccccatgtcgaggagggaggcctgggcgcgctcgttctcgtggtgcgggaatacaaggtccatgccaccgccgtggaggtcgaacgtcgatccgaggagttcggtcgacatcgcgacgcactcggtgtgccagccggggcggccgtagccgaggctggtcgcgaagccgtaggcgtcgctctccacggtcttccagagcgcgaagtccagcggggagcgcttcgcgtcgtcgacctcgacgcgcgccccagcgcgtagctcctcgagggcttggtgcttcaggaggccatagtcggggacgtgatcgacgctcagatagacgccgttcttcgtcatgtaggcgtggccgcggtcgacgaggcgctcgatgagggcgaccatggcatcgagccattcgctcgcgtgcggtgcgaccgtcggtcgacggacgccgagcgcatcgatcgcgtcccaccagcgggactcgtagcgctcggcgatcgctggcggggtcaccccttcacgagctgcacgatcgacgatcttgtcgtcgatgtcggtgatgttcgagacgaagcgtaccggagccacgagccgctcgagggtccgccggagggtgtcgaacacgacggcgagccgtccgtggccgaggtgcgggtcgtcgtagacggtggggccgcagacgtagacggtgacctgctcaggggtcccaggggtaagctgaatgagctcgcggcgggcagtgtcgtagagcctgagcatccaccgaagtctaggcggggtcccctcgccccttcggaggcgataccgtcggttgcgacccgggacctgcgtccacgaggcacccatggctgatcgggtgacccgtgcggacgagggggtgaggccggggcgaagtccagatgaggaggcgtggtgcggatcccggacaaggtcgagctcgaggggctcgagcgcaagtggggcgcgttctgggaggagcacgggctatatcgcttcgacgacacagctcccgccgcgcaggtctacgccatcgacacaccgcctccgaccgtctccgggacgctgcacatcggtcatgtgttctcctacacccatgccgacatcatcgcccgctaccagcggatgcagggcaaggaggtgttctacccgatcggatgggacgacaacggcgtcccgaccgagcggcgagtgcagaactactatggcgtgcggtgcgacccgtcgttgccctatcgcgggaccgacgaagagctgcctcgggaaggggcacggcaggtcccggtgtcgaggcgacgcttcatcgagttgtgcaccgagctcacggcgaaggacgagcaggcgttcgagcagctgtggcgtgcgatcgggttgtcggtggactggtcgctcgtctacaccacggtcggtgagcgtgcccgtcgcgtgtcacaggcggacttcctcgatctcctcgagcgggaccaggcctacctcgccgaggccccgacgctgtgggacgtcgatttccagaccacggtctcccaagccgagctggaggatcgcaccgtcgagggtcgctaccaccgcatcgtcttcgaccttgagggtggtggcgaactcgagatcatgagttcacggcccgagctgatccccgcctgcgtcgcgatcgtcgtgcatcccgaagacgatcgttaccgcgaggtggtcgggcgccgcgccatcaccccgctgtttcgcgtgccagtaccggtgatcgcgcacccgctcgccgagccggagcgcgggaccggtgcggccatggtctgtacgttcggggacctcaccgacgtcgtgtggtggcgcgaggcatccctgccgacccgggtcgtgatcgaccgggccggccgactggtgccacgcgtggacttcgccgccttcggttccctcgatcccgatggcgcggctgacgcctacggacgcctcgcgggcttgcgtgcgagcgacgcacgtgccgaggtcgcggaggcgctcgcggccgcgggggtgcttcgtgggatcgagcaggtccgtcacgccgtgaagtactacgagaagggggagcatccgctcgaggtccttgcaacccgtcaatggttcatccgcgtcctcccgctgcgcgatcgtctgctcgagcgcgcggccgagctcgactggttgccaccacacatgcaggttcgcctcgaggactggatccgcggactcaaccaggattggaacgtctcgaggcagcgcttcttcggcatcccgattcctctgtggtatccggtgcgcgaggacggctcggtggactacgaccatcccctgcggcctgcgaaggaggacctgccggtcgatccgcagagcgaggctccccgcggctacgccgacgagcagcgaggtgtaccgggtggcttcgtcggcgaccccgacgtgctcgacacctgggccacgtcgtcgttgaccccacagctcgcggggggctggggtgagcgtccagacctctttgccaaggtcttcccgatggaactgcggccccagggccaagagatcatccgaacgtggctgttctacacggtcgtgcgagcggagctggccttcggtcggctcccgtggcggcgggcgttgatctcgggctgggtgctcgaccccgatcgcaagaagatgtcgaagtccaagggcaacgtcgtcacacccatgccgctcgtcgagcgcttcggcgcggacgccgtgcgccactgggcggcgaacggtcggcccgggaccgataccgcggccgacgaggcgcagatgcgcgtcggtcgtcgtctcgccatcaaggtcgccaacgccagtcgcttcgcgctcagccgtgtggcgagccgctccagccacaagcccgcgtgggtgccgatcgacgcagcggaactcgaggccctcgacgccacgatcgcacgggccaccgagttgctcgaggcgcacgactacacgagcgcgctcgcggccatcgaggagcacttctgggccttctgcgatgattacctggaactcgtgaaggtgcgcgcctacggcgacgactcgccggagcacgcctccgcgctggctgcgctcgagatcggcgtcgagctgttcatccgggcgttcgcaccgtacctccccttcgtcaccgaagaggtgtggtcctggttccgcgagggatcggtgcaccgaagtgcctggccgcagccgggcgaggccatgcgccgctacgtcgagctcgtcggtgaaggccatggcgtcgtcgacccggccgttcgggcggcggtgtcgtggtcgctcgcccaggtgcggcgggcgaagacgtcggagcagcgctcgctgcgtacgccggtcgaacgcctcgtcgtgtgggcgccccgggcgtggctggaggcactcgccgctgccgaggatgacctcagggcggccggcggcgtgctcgcgctcgagcgccacgaggccgacgagccccgtgccgtggtcgagctcgctccgccagagcagcactgaatgaggtctgcgacctgaggaccccgtggctcgggtcgcagacggtcgcgcggtccgtaggcttgacggtgtggacagcctcaccccagaggagcttcccggcgaactcgcggtgacacccgaggtcgcgggggggttcgtccgacgccgatggctgttgatggggctgctcgcggtgtgggggcccgggctcgtcgtgatgttggccgacaccgacgtcggcagtctcgtgaccgcagcgcagtcgggtgcgcagttcggctaccgcatggtgctcccgcaggtggtgctgatccccatcctctacatggtgcaagagatcacggttcgcctcgggatcgtgacgggcaagggccacggcgcgctcattcgcgagcgcttcggcccgtggtgggccggcgtctcggcactcaccttgttcgccacggcggtcggggcgttgctgaccgagttcgccggcgtggcaggagtcggtgagctcttcggcgtctcgccggacgtcacggtgccgctcgcaaccgggttcctcgtcgccgtcgccctcacgggcagctaccggcgagccgagcgcgtcggcatcctgctcggtctcgtcgagctcgcgttcgtgccggcgatgatccttgcgcaccccgatgtcggtgcgctcgcgcgcggcgctctcagcctgccactcgccgaccatggcttcgtgatcctgctcgctgcgaacgtgggggccgtgatcatgccgtggatgatcttctaccagcagggcgcggtcatcgacaaaggccttggcggcgccaacttgcgtgcggagcggcgtgacaccgtggtgggagccgtgctgacgcaggcgatcatgctcgtggtcgtgatcgcgttcgcggcaacgatcggcacccatcatcctggggtcgcgctcaacacggtgggccagttgagccgagccttggctccgttcctcggtccggtggcggccaaggtcctcctcgggctcaccatgctcggcgcgggtctggtcgccgcgctcgttgcgtccctcgccggggcgtggggcgtctccgaggtcttcggttggcgccacagtctcaacgatcgaccgtctcgggcgtcggcgcgcttctacgtgacctacaccttggcccacgtgctgggtgcggccatcgtgctcctcagcttcgatctcgtctcgctggtgatcgacgtcgaggtcatgaacgcgctgctgctgcccatcgtcctcggtttcctcctcgcgctggaggccaaggcgctcccggaggcctaccgcatgcgcggggcgtatcgagcggtcgtgacggcgacctcactgctcgtgatcggtttcggcttgctcatggtgccgacgaccctggggtggtggtaaccggcgtcggctgcgctacgacgcggcccagtggtcgggccagccatctggctgaggaatgatcgcgcctttgcgacgaagctcggctcggaagatctctcgcagcacggagagtgcgtcgaggatctccgggtagcgcaaccggtaccacacgttcgacccctcgcgctgggcctcgatgatgccacggtcacgaaggacggcaaggtgctgggacacgttggcttggggcgcgccgatcagactcacgagctcgctcaccgtatgcggagcctcgcccaagatcaacaagatcaggatgcgcttggggtcgttgagcgccttgcacatcatcgggacgaactcctcgagttcggtgatgctcaccccggtcgtggcagcctcggtctcccccatggccccgagcctagctgtcggttcggcgagcggtgtgtgcagctccgagtcggttggtcaggaactcgtcgaggagcacggtgccgagctctccgtcgccggggtagtaggccttgccgtggttgatggcgaccacctgctcgacgaagcgtcgtagcccgcgatcgcgagcgaggacgaagacgctgatctcgatgcgctcgcgggtggcacggactacctcggcgagggtgcgacggagggtctctggggtcgggggataggcaaagtgcaccgagccctcgtcgtcggcgtgggcggtgggttcgccgtcggtgacgaggagaacttggcggcgtccgcgaactcggcgcaggcgctggcgggccagggccagggcgtgctgaatgttggtcccgtagacgtagtcccactgcgcctcaggcagcgcggtgatcgggacctctcgcgcggtctccgagaagaccaccaccgagaagtcgtcggcagggaaccgtgcccgcaccagggaggcgagcgcgagggcgacgcgcttggccggcaagaaggtgtcgttgagcggcatcgagagcgacaggtccagcgcaaggacggtgccttggcgcgcctggtcgtcgacctgttcgatcatgaagtcgtcgggatcgagccggagcggtatccccggcccgttccgagcgagcgaacctcgaagggtgtcagcgagggcgaggcggaacggatcgccaaagcgccactcgcgcacttcgccgttgggctcggtgccgaccccagtgcgtcgcacggcgtgctgcccgaggggcccgagcacgccttgacgcgcgaggtcacgaaggagcaggtcaccgaggcgccacacggcgcgcggtgagagctcgacgcgacccccggtgcgattcatgaggccggctgcctcgagcgcttcggtcgtgcgcgagaggcgctccagcgctgcctgggcgtccgcgccgaggaggtcgcgcacctcgtcgagctcgatcgcaccgaggcgatcgggggtcgtggcttgacggagtgcggcttcgagcgtgtcgaggcgcccgagttcgcgcatcaccgggccgagctcgccgagaccgagcggttcggagcccctgaaccccatcgcgtcggcgtcgaaccccgcgatggtgccgagtgcctccccgaggcgccgcatggcttcggcgatcgcgggggatccagcgagtgcgtcctggaggcgctcgagggcacgtcgcgtgtcgtcgtccacggatgccaggaggcgttcgaggtccatgcgactcgccgcgaggcgggcgaggaagtcttcgaacgattcccccggggcgatgatccctgggtagcgttcctggaacgcctcaaggtcgtcgctgatgtcctcgccacgcgcaaagcgctcgatcagcgacgcgaggtcgctgagcatcgccgcgtacgcatcggcgtcgcccgcctcgatcgccgacgccagctgctcgaacgactgcgccagcagcgaggagcgaaggctcgcgagcaggtcgtcgaagcgctcgtgggctgcctcgtcgaagaagtcgtagtgctcgagcgccgtgaggcgttcggcgatgtcgtaggggagcgcatcgagctccatctgtgcgaggaggtgctcgggcgcttgggtgcgctcgtgtgcagcttcgcggctggctcgctccttcgacacgatggcgtcgagttcctcgcgcacgcgactgagcgtcgcgttggggtcgtagcgcgcgagcagctggtcgcgacgttcgcgtagccgtgtgaggagctcggcaagcccaggcatgtcgtccaagcctcgctgcagcaggtcggcgagtgcgctcgcaaggttgccgtggtaggccaggtcgtcgctgagggcggcgaggacgtcgtcggcctccgggccgaggggctcgggatcgacgcctccatagcgcacggtcgacatggctcagctcccgtagctcactcggttgccaaggacgcgcttgccgagtctgcgtgtcgccacgagtccctcgagacacagttcggcgagtaccaggcgctccgacggcggggcgtggtcgcccatggcagccagcgccggtcgatcggcgaggatctgctcccatgtggccgtggggccatcgagatcgacggcgagcgggcgatcgttggtctcggcgatgacgtccgacgggtcgagatggccgagccgctcggtgaagactcgagcggtcgcttgagcgagcaaggtggccacgatctcgcgctccgaggtgtcgtgggcatcgacctcgatcttgcccgcgaaggccgcgatggtcgcctcggtatcgccaaggcgtgcgcgaggcgggtgctcgccgaggcgaacggcccgaacgagtgccgcggcagcgatcgcctctcgggctgcgatcgaccctcgaacggagacgcctgagtagcgagagaccgcagggtgccgccgtgcgaggtgggccgtgtgggcgacgagttcgtcgaggacctccggtatctcgacggttgggtcgcacagctgagcctcttgtcgcatgatggcgacttcttctgcgatcgtcgacgggtagtgcgttcgtagctgcgtgccgaagcggtccttcagcggtgtgatgaggcgcccacgcgcggtgtagtcctccgggttggccgacgcgaggaacacgatgtccaaggggagccgaatggtgaagccgcggacctggacgtcacgctcctcaagcgcgttcagcagaccgacctggattcgttcgggcaggtcggggagttcgttgatggcgaagaggccgcggttcgcccgtggaacgaggccgaacgtgagtgcttcggggtcctcgagcgtgcgacccgccgcaaccttgatcgggtcgacctctccgatcagatcagcgatggtcgtgtcgggagtcgcgagtttctcgctgtagcgctcgtcgcgggcgatccagcggatgggcgtcgcatcgccttgggcggcgagtcgggccttggtcgaggcgaggacgggcgcgagcgggtcctcgttgagcgccgagccctcgacggcggggacgaaggggtccagcagcgcgacgagggaacgcaggatccgcgtcttgccctggccgcgctcgccaaggagaatcacgtcatgcccgctcaccaaggcgcgcgtcagttctgggagcacggtgtcgtcgtagccgaccatgccctcgacgacggggcggcctgcgcggatgcgctcgaggacgttggcgcgaatctcttcgcgaaccgggcgcgggtgccaaccgatgcgcgcgaggtcgccgagcgtggttgggtggtcgcctgaagcctgggtcacatcgtcgagcctaggtcgaatgtccgtcgtcgattcgtgacgacgccggcgagcgagtaagactatgggggtgaacgttcaccatcacagctacgacgtcgtcatcgtgggcgcaggcggagccggcctgcgcgcggcgatcgagacggccgggaccgtgcgcaccgcggtgatcacgaagctctatccgaccaggtcgcacaccggggcggcccaaggtggcatgtgcgcggcgcttgccaacgtcgaggaggactcgtgggagtggcacgccttcgacacggtgaaggggtctgactacctcggtgaccaagatgccatcgagatcatgtgccgagaggcgatcgacgcggtcatcgatctcgagcacttcgggctgccgttctcgcgcaccccggacggcaagatcgaccagcgccgctttggtggccatacgcgcaaccatggcgaggctccggtacgtcgcgcgtgctacgcggccgatcgcaccggtcacatgatcttgcagacgctgttccaacagtgcgtcgctcgtggtgtccaattcttcaacgagttccaggtgttcgacgtcctcttcgaaggcgaagggaacgatcggcgtgctgcgggcgtcgtggcctacgagctcgcgacgggagatctccacgtcttcgccgcgaaggcggtgatgttcgcgaccgggggattcggccgtgtctttcagatctcctcgaacgcacacacgctcactggagatggtcccgcagtgctcctgcggcgcggggtgccgctcgaggacatggagttctaccagttccacccaaccggcatctacgggatcggcatcttgctcaccgagggtgcccgtggcgagggtggcatcttgcgcaacggactcggcgagcgcttcatggagcgcgtcgcgccgacggtgaaggacctcgccccgcgcgacatggtcgcgcgagcgattcacgccgagatccgtgagggtcgcggggccgggcctgacaaggactatgtctatctcgacctcacgcatctaccgccggagcagatcgacgcgaagctccccgacatctcggggttcgtgcggacctatctcggcctcgagcccaagcgggatccgatccccattcagccgacggcacactacgccatgggcggtatcccgaccaacgtgcatgccgaggtcgtcgtcgacccggcggggacggtgctgccagggctctacgcggccggggagtgtgcctgcgtgtccgtccacggggccaaccggttggggaccaattccctgctcgacatcaacgtcttcgggcgtcgcggtgggcgagcgatggtcgagtacgtcgctggcgtcgatcaccccgacatcgcccgaggcgccgaggagcccgttcgtgagcacattgagcatcttcggagccacaaggggtccgagcgtgtcggcgcgttgcggacgacgctgcaggctgccatgatgcgcgatgcgtcggtcgtgcgcactggggagtcgctcgccgaggcccatcgtgtgatccgcgagctgaaggagcgctaccacgacgtcgccatcgacgacaagggatcggtcttcaacttcgatctcacggaggcgctcgaactcgggaacctgctcgacctcgccgaggtgctcgtgatcggtgcggaggctcgcaccgagagccgtggcgcccactggcgtgacgactaccccactcgtgacgacgtgaactggatgaagcacacgcttgcctaccgcgagccggacggatcgatccggctcgactacaagccagtggtgttgggcaagtacgaacctatggagcgcaagtactgatgacgacgactcagtcaccggcgtcgaccgacgccaccatgcaggaggtggacgttcacctcgtgatccgtcgcttcgatccggaggccgactcgcgcccgcggtgggagagctacacggtgcgacagaagccgacggacaccgttctcgcggcgctccacaccgtgaagtggacgctcgacggatcattgagctttcgtcgctcgtgtgcgcacggggtctgcgggtcggacgccatgctgatcaacggcgagaaccgcttgagctgtgtcaccctcatcaaggatgtcgggaccgagctgcgcatcgagccggtgcggggtctgcccgtcgtcaaggatctcgtcgtcgacatggagccgttcttcgcccagtatcgccaggtcatgccgtggctcgtcaacgacgacgaccctggctttcgagagcgtcgacaatcgcccgaggagcgtgcacgtttcgacgacaccacgaagtgcatcttgtgcggtgcctgctcgacgagttgcccggtgtactgggctgggggcgattacctggggcctgccgcgatcgttgccgcgcaccgcttcatcttcgactcccgcgaccgtgcggccgccgagcggctggacatcttgaaccagcgaggcggcgtttggcgctgccgaacctcgttcaactgtacgcaggcctgtccgcgaggcatcgccgtcacggaggccatcgaagaggtgaagcgtgccatcgtctccgaccgggcgtgacgttctgacgctcgtcgttcgcgagcgtgacggggtgcgacgccagggccttcgcctcgtcgacggggtgctcgagcctgctgcgatcaccgaggaggatgcccaggtcgtcgtcgaggtcgacgactggggtgctgagctcggagcggccctgcgtgcgggtggtgtgcgcatcgtgcgaggtgcgaccgacctcgcccggaacgctaaggtgctgaggggcgcgacgggggtccgctcgagggggtgagccgtgcttcgcagtcgtcgcccgactcgtccgccacagcgaccgggctggtatccagacggctcgggatggttgcgctacttcgacggccacggatggaccgagctcgttcgtgagcggctcgtcctcgctgagttccgaccgcagccgccggtcgcggagcgcccgccgcatcccgcgtcgacgagccgccccaggcagggcgtgcgcatcgccagcatcgtcctcgcgtgcgtgctgctcggaggtgttgtgcttcagctcgtggcgttgacgctgtcgccgcggtcgcagggctcatccgttatctccgaccgcgaagtgctggtgctcgcgagacatgcatgtgaagacagtcccgtcggccaggctgcgatcgtggcgagctccaaggcggctcgatcggcggcggcgtcgcgcgcggcccgcttgacgcagcttgcttccgaggcacacctcgaagccctcgacgacctcgcggccgcgtggtcgaacgtcgcggtcgcgttggtgcaggcggccccgcgatcggcctcgctgcgtgcggccatcgacgcggtgaacaccgcggcgagcggtgcgcacgtggcgtcctgtcgagcgtgagcgtgcgccggtttactcgccctggcgagcgccgtgtgctatcctccaggcatcctgcccaaggaggagtcatgagcgaaccgttcatcgacgatcatctgttggtgcgctatcgcgagctgctcgatgccgaggatcaggcgttctcggagatggagcacgacttcgaggagggcgatgcgcaacgcttcgcactcgaccgcgaggcctggcttgcggcgatccgccaccgcgtgagttttctcgacgcgtgtgggttggtacgcctcgatgtcgtcgtgagctaggtcgcccccggcgccgacccttgacgctggtgatcgttcaggtcgcggcgctacactaagcccagcactgccgggggagtagtgctcggcgcacacggggggaacgatgggcgcgagtcacacagctgtcggggcgtcggaccagtcgtcggcaggcgacgctcggcgtggtccgctgcgagcgtgggacggtcaaggaacggcgccatgtctcagaacgctccgcttcgacgcggacgatgctggactgaggagccgggcgctgtcgggcgaatggcagcgtgaagcgagatgtcgaggcgtcgatccacggacgttcttccccgagcgtggcggatcggcgacgtcggcccggcgcatctgcgctggatgcggcgtgcgcctcgagtgcttggagttcgcactcgtgaccgacgagcgctttggcatctggggtggcctgagcgaacttgaacgacggagtctgcgcgcccggcgcttcgtcgtgtgagcgagacgctgtgtgagcgagacgctgtgtgagccgaagcatcggcgagcgtggctcaggccacgggacggctcgactggagcgcgaaggacgcccttgctaggcttgcccgcgtgcttcgtccctacagagtggttgtcgccaagcccggactcgacggccacgaccgtggagcgaaggtcgtcgctcgagcgctgcgcgacgctggcttcgaggtcatctacaccggtctgcaccaaacggtcgagcagatcgtcgagaccgtgctccaagaggatgcggacgcgctcggcgtgtcgctgctgtccggcgcgcacctgaccctcgtcccacggctcgtcgacgcgctcgctgcgcagggccttggacacgtgctgatcgtcgtcggcggcatcattcccgagcacgatatcgatgccctgctcgggctcggcgtgggccgtgtgttcacgccagggtcgtcgctgaccgagatcacgtcgtggctcgaggcgcaactcgatgagcgggagcgcactggagccgggcagggaggataggcgtggatctgaaggagtaccaaggcaaggacctgttccgccgtttcggggtgccgacctcggagggacgggtctgcgtcacggtcgaggaggcggttgccgcggccgagacgctggggtatccggtcgtcgtgaaggcccaggtgttggtcggcgggcgcggcaaggctggtggcgtccgtgtggccgccaccgaggaggcgctccgcgaggcagcgggtgccatcttgggcatggacctgaagggccatcgggtgaaggaggtctggatcgagccggcttccgacattcgccgcgagtactacgccagcttcacgctcgatcggacggcgcgtcagtacctgctcatgctctcggcgatgggtggcgtggacatcgaggaggtggctcggacgcaccctgaggcgattgcgcgggtgcacatcgatcccatcgacggtctgaccccggccctcgccgaacaggccgttgcgaccgcagggatcgacgagggtcgcgaggagctgccggcgatgttgggtgcgctctatcgcgccttcgtcgaaggcgatgccgacctcgtcgaggtgaacccgttgatcgtccgatccgacggcaagctctgggcgctcgatgccaaggtgacgctcgacgacagtgccgcgttccgccatcccgagtgggaggcgtatcgggccgacgaggagctcgactcgcgcgaggcgatcgctcgtgctcggggcttgaactacatcggtctcgagggatccgtcggcatcatcgccaatggcgccggactcgccatgtccaccttggacgtggtccagcaggtcggtgggcgagcggcgaacttcctcgatctgggaggaggcgccggcgccgacacgatgacggcggcgctcgaggtgatcgcgacggatccgcaggtccgggcgctcctcgtgaacatcttcggcggcatcacccgctgcgacgaggttgctcgaggcatcgtcgccgcgctcgagcgcgtgcgccttccgttccccatggtcgtccggctcgacggcacgaacgccgccgagggcagggccattctctcgtcggttgtgtcggacagcatcatcgtcgagccgacgatgatcaaggcggccgagcgcgccgtcgcggaagcttcgaaggcggtcgcatgagcatctttgtcgacgagcacacgcgggtcatcgtccagggcctgaccggccgccagggcatgttccacggactgcgcaaccgggcctacggcacgcaggtcgtcgctggggtgacgcccggcaagggaggcacggacgtcgaagggatccctgtcttcgatacggtgaaggaggcggcagccgcgaccaacgcgaacgcgtcgttcatcgtcgtgccgccgcgcttcgctcccgaggccatcctcgaggcagctgcggccgggatcccgctcatcgtgtgcatcacggagttcatccccgccaaggatgaggccatggtggctgcggtgttgcgacgtgactaccccggcacgcgtctgatcggaccgaactgcccgggcatcatctcgccggggcgctgcaacatcgggatcaccgcgggggagattgcgcgtccgggtggaccggtcggcatcgtctcacgctcggggacgctcacctaccaggcgctctatgagctcagtcagcaaggtgtcggccagacgacctgcgtcgggatcggaggcgatccggttcccggcacgaccttcatcgactgtctggcggccttcgaggcagatcccgagacacgggcggtgctcatgatcggcgagatcggtggacaggacgaggaactcgccgcagcgttcatcgcagagcacatgaccaagccggtcgttgcctatatcgcgggcgttacggcgccgccggggcggcgcatgggtcatgccggcgcgatcgtgtctggctcgtcgggaaccgcacaggccaagatcgaggccctccgagcggcgggtgccatcgtggcgcagaatcccaccgaggctggcgagcgaatggtggaggtcgtctcgcgtctcgcctagccctgcggccctaggcttggcgggcgtgcgtgtcgcggtgctggcatctggcgtagggacgatcctcgagtcgctcgtcgatcacggggtcgtgccggcgctggtggtcgcggatcggccggcgttggccctcgagcgagcacgtgacgccggcctggtctcgacgctggtggatcgtcgttcgtatggatggcgagactcgttcgaccgcgaggcgttctccgacgccgtcgccgacgtgctcgaggcggccaaggtcgagctcgtggtgctggctggattcatgaccatcctcgccggttccatgctcgcgcgctttccggctcgcgtcgtcaatacgcatccgtcgctgctcccgagctttcctggtcacgacgccgtggcccaagcgctgtcggcgggggtgcgcgtcagcggcaccacggtgcacgtggtcgtggagcaggtcgacgccggcccgatcctcgagcaagagccggttcgggttcggcggggcgactcgatcgagaccttgcacgagcgcatcaagcacgcggagcgtgagctctatccgagggtcgtgcgagcgatcgttcgggcgggggtcggcggcgatcggtggtgggaggatgctcgtgtgcaacgagcgatcgacgaggaggttcgtccgtggcgcgagcgctgatctcgctgtatgacaaggccggtctcgagcgggtcgcgcgaccgctgcacgccgccggctggcggatcgtggcttcgggtggcaccggtgaggccctccgcggcctcggtgtccccttcgagcccgtagaggaactgacgggctttgcgtccatgctcgacgggcgtgtgaagacgctccatcctgcggtgttcggcccgatcctcgccgacctcgagcgtcctcaccatgcgacgacgctcgaagaggccggctgggagccgatcgacctcgtcgtcgtcgggctctacccgttcgcgtcggatccgtcggtcgatctcatcgacatcggtggtccctcgttggtgcgcgctgcagccaagagcgccgaccgcgtgaccgtgctcgtcgaccctgccgacttcgggctcgtcgacgaggtcatcgctggcaacgtcgaccggccgttgcgccggcgactggcggccaaggcctttgcgaccacgagcgcctacgacgctgcggtcgcgacctggctgggcggtggagagggctcgttgcccgatccgctggtcctccctctcgagcgcgtcgccgtgacccgctacggcgagaacccccaccagcgtggcgccctctatgcaccgatcggcacccgccgtggcttcgccgaggcccgttggcacggcggcctcgagcccagctggctcaacatcgctgatgccgacgccgcggcgcgtctcgtcgctcggctgggaccggagcctgctgcggtcgtggtcaagcacgccggaccgtgtggtgcggccgtcgcaccgacgcttgccgaggcctacgagctcgccttcgctggggaccccgtctcggcgttcgggggcgtcgtcgcgctcgggggggtgctcgatgtggcagtcgccgaggcgctcctcgcacaccccaaggcagacgtgatcgtcgccacggcgatcgacgacgatgctgcccaggcgctgctcgcccgccgtccgaagacgcgactcgtcgagctcgcgatcgatcgcgacgagccgtggtgggtgcgcagcgtcgcgggcggggtcctcgtgcaagagcccgatcagctcgaggagccgacggatctcgaactcgtcacgagtcgcgttcccaccgacgaggagcgccgtgacgcctggatcgcgcacgtcgtgtgcgcgtcgacccagtcgaacgccgtggtgatcgcgaggcagggggctgtggtcggtgtcggccagggccagccgtcgcgggtcgatgcggcccggctcgctgtcgggcgagccggtgcgcgcgcccagggtggtgccgccgcgtccgatgcgttcttcccgttcccggacgggctcgagaccctcatcgacgcgggcgtgacgtgcgtcgttgcgccggcgggatccgtgcgtgacgacgagattcgtgcagtggccgagggtcgtggcgtgagcctgctcgtcgctccgagacgccactttcgtcactaggaggtctggtgggagccaagctgctcgatggggagcgcgtcgccgccgaggtgcgcgccgaggtgcgcgatcgggtcgagcgcctgcgtgcggcgggcgtgcgcgtggggctcggggcgatcctcgtcggggacgatccggcgagtgcgcggtacgtcgagatgaaggcgcgcgactgcgcgagcgtggagatcgcgtctcgcgtggtgcgcctcggcccggatgcctcacaggcggacgtcctcgcggcggtcgagtcgttgaacgcggacccggaggtgagcgcgttcatcgtccaactcccgctccctcggcacctcgacccagatgccgtgctctgggcgatcgacccggccaaggacgccgacggattgcatccggtgaacctgggcgagctcgcgctcggacgcccgcgcgtcgtggcgtgcaccccggcgggcatcgtggagctgctccaccgtcacgggatcgtcctcgacggtgcgcatctcgtcgtggtgggccggggcctgacgatcgggcgtccgctctcgatcctcgcgtcgctgccccgagcgggtctcaacgcagccgtcaccgtcgttcactcgcgggtgcgcgacctcgccagcatcgttcgcagtgccgacatcgtcgtggcagccgctggcagccccggcctcgtgaccggcgccatggtgcgccctggcgccgtggtggtcggtgccggcaccagcttcgaaggacggcgcctgctctcggacctcgccgacgacgttgcggacgtcgctgcgtgggtgacgccacgcatcggtggggtcggaccgatgacgagggccatgctcctcgtcaacaccgtcgaggcggccgagcggcgagccggtcggagcgagccgtgagcgacgtgctcgatcgctacggcgagcgagtctgttcggtcgagctgtggccagcgcgcacgagcgatcaggagcaccgtctcacggccacgttggacgtgcttcgttccctgccgccagcattcgtgtcggtgacctacggcgctttcggctcgagccgccacgagagcctcgcgctcatcgaacgggtgctcgccgatggccatcgggtgctggcgcacctcgcggtggccggtcacagcccagaacaactcgtcgcgctcctcacgcacgtcgagcgtctcggcgctgacggcgtgctcgccctgcggggcgacccgccgctcgacgaccccgacgatcgtgcgcgcttcgtcggtcgtcacgcactcgagctggtcgaactcgctcggcagcacacccagctcagcgtcggcgtcgcgctgcacccctcgggccaccccgaggcgcgctccctcgaggacgacctcgatcaccaggctgccaagctcgcgcgtgccgacttcggcatcacgcagttctacttcgaggccgccgcgctcacccgactgcgaggcgcgcttcgcggtcggggggtgacccgaccggtgatccccgggctcctcgtgccacgctcgccccgccagctcctgcgcatgggggagatggccgcggttcgcgtcccgcgggagttggtcgaggcactcgagggtcccgacgggccggctcgagcgaggacggtcgtcggcgagctcgccagcgccgccctcgaggaggggagtcccggggtgcacctgttctcgatgaaccaacccgagacgacggcgtggctgctggagcgccttgatcggcgccatcgtcgcgtcagttgaggtgtttgccgaacgttcaccgtctggtcagcgtgaggcaaactcagcgcaaccgacccgtcgccgaactccgcaagactgaacccgtcagcgaatggcgctggtatcgcgagtcactcgaggaaggagtgatccatgagtgatcgatccgtcgacgcggccctcgacgaggcgccgctgagtcggttccacacgaggtcgatcttcgtcgcaggcatggggttcttcaccgatgcctacgacttgttcatcatcggcacggcgacgaccttgatcgcgaagcagtgggggctctcgtcgaccgagaccggcctcatcaattcgatcacgttgctctcggccttcttcggagcggtgatcctcgggcggctcgcggatgtcctcggccgcaagcgcacctacggtctcgaggccgggctcatggtgctcggagcggtcgcctcggcgttctccccgagcctcatttggctgctcgtcttccggttcatcctcggtctcggcgtcgggggcgactacccgatgtcggccgtgctcatgaccgagtacgccaacgtgcgctcgcgcggtcggctcgtcgggctcgtcttctcgatgcaggcactcggtaccgtcgctgggtacgtggtcgcgctcgcgctcttgtcggcgggcgtcaatcatgacctcgcttggcgcctgatgctcggcctcggtgcggttcccgcggcggcggtcatctacctgcgccgcaagatgcctgagtcgcctcgctaccgcgctcgcgtggagggcgacgctgcgaccgcagcgcgcgacctcaaggcgtactcgggcggtgtcgtggatgcggccgcggtcgccgagccgaccttgcgcctgcgcctcggtcagttcctctcgaaccgcacctacctcctgtatctgctgggtacggcgggcagctggttcgtgttcgactacgcctactacggcaactcggtctcggctcctctgatcgtcaagagcgtgctcggtaagcacggggcgcacgtgctcacggaggcgatcgcgctgcagctcatcgtcttcacggtggcggcggttccgggctactacctcgcctcgttcttcatggatcggatcggtcacaagcgcctgcagctgatcggcttcacgttcatgggcctcgcttttctcctcatcggggtgatccccggggtgacccacgacgtgctgccgttcctggtgctcttcggcgtgagctacttcttcgcggagttcggtccgaacctcacgacgttcgtgctcgctgctgaggtgtacccgacgagcgcccgctcgactggccacggtctctcggcggggatcgcgaagttcggtgcgttcctcggtgtcttcatcttcccgatcgtcaagagcgcgttcggcgtgggtggagccctggagttctccttcggcatggcggtcctcggcctcctcgtgaccctggtgcttcctgagcctgcgcagcgttccctcgacgacgtcaccggcgagctcaagctcgcagaggcggcccaggagtacctgcgccgggcttcgaaccagcagcggatggccggacaagactgagcgacctcctcatcggaggtgatcgacgaaccccgaccggaaggtcggggttcgtcggctttgctcgcgggtggtgccgtgcggctcgtgtgaacgtcgaggccgccgccgtgaccggagatccgcggtggtgccgtcaccgtcgtcggggagccgcaaagctcgcgtgggcgcggtcggcgccggcctgcgtcctgcgacggctccctctgggcgaggtggctcgagccgtgcgccgcgagacgccgacggtgtgtccgcgtggctgacgtgggtcggatgcgcgtgctactgtgcgaggaacggactcggtgcgatcgcagacggtccgatcgtggtgccgacgagcgtcgtgcgggttggctcaagtctcgggaggctcaggacgatgaggccagtgtgagcgagccgtccttctgggaaacgctggagcgtgtcgccgcgctcgtcgacgggccaccggttgttcgtccccagctcgtgaccctcgtcgggggtgatggtgccgtggacgatgtggcctcggcggcgtcgcgaggagggctcgtcccttcgcccgtagagcatggcgacgccaccgtgccgagcgatgacggcgcgccgaggggagctggcgaggcagacgtcgccgatgccgtggctgcatcggcggtggcgccgccgtcacctgccgaggatcaggctggcgcacggccaggcacaccggtcgctcgcgctgacgccgtcttccaggttctcgagcagacccagcgtgcagaggtcgtcgccgagttcggccgacgggacgctggggcggctccggccgagctcaccacggcgtctacgacgcccgccacctgggacgacgtcgacgagggcgtcgtcgccgcgccgagcggtttcctcgctggcctcgcggccaagcatcgcatcttcgccgagaccggtgagatcgacgtggatctcgaccgcgtggatcggcgcaagcgtcgtcgacgcggtcgatctgcctagcgcaccagagcggtgcgtgctggcagcggcgaggagccggcgccggtcggcgtgaccgtacgaccacgacggtgggctctgtgcgccgacgacatcgtggacgccgggtcgctccacgtgcagcgacggtcccgcacgagctgtgtcggcgatgccggtggctgggtcagcgactaaggagcttcgtcgccgaggtcccacgtgagggcgatgccctcacgttcggcgtcgcgttcgacccgcgcttggttgcggcggaactgtgggtcgtgcgctgggagcatgaggagccgcgcgttcgtcctctgcgcgaactcttcgcccactcggcgatcgccgctcgtcgtcacgatctcccagtgaggagcgaccgggcccaggtagcggatgcgtgcatgcgccctgatgggtaccggtgcttcgtcctcgggcatcgcccctcctctgctcggtgcgccagcctatcgtgactgaggctcgagagggtgcgtccgcttgcgcagaaagttactctatggtagcttctcgcatcgcagagccacgtgggccgtcacctgcagagggagggagcatggcgacagagcgaggttcagcgcccgaggcaggtgcgctcgtgagcgagccctggatggcgtttggatcgtgccgtggtatggatcccgagttcttcttcccgaccgacggtgctggtgtcgtccaggctcgccgggtgtgcgctcagtgcaacgtccgcgagcagtgcctgcagttcgccctcgatcatcggatcgatcacggcgtgtggggtggcgcctccgaacgtgcgcgtcgtcgcctcctctcacagcagctctcgtcggtgcgagcgcctcttcgcgacgtctagcctcgccgtgtgctcgagtgcgtgatcaatctcgccgaagggcgagagacacgtgcggttgaggcgatcgtccaggcagcagcccccgcgctcctcgacgtccacgtcgacgccgaccacaatcgcagcgtgttcaccctcgctggtcccatggtcgaggatgcggcgtggtcgatagcggaggccgccgctcacctcctcgacattcggcaccacgtcggtgtccacccctggctcggtgcgatcgacgtcgttccgttcgtcccgctcggtaccgcgtcgttggatgcggcgatcgaggctcgcaatcgaatgggtgcgcggcttgcgagcgaactctcggtaccggtcttcttctatggtccggagcgcggcctgccggaggtgcgccgtcgagcgtttcgcgatctcgcccccgatctccggccgactcggccgaatccgcgcctcggtgcctcctgcgtcggtgcccggggcccgctcgtcgcctacaacgtcgtggtcgatgcgagcctcgaggtggctcgcgaggtcgctcgggagcttcggggacctgcggtgcgtgcgctcgcgttccaggccggtcgtcgagtgcaggtgtcgatgaacctgatcgaccctcgggtcgtggggcctgcccaagtcgtggatcgcatcgcttcccgagtgtccgtgcgcgtgtgcgagctcgtcgggttggtgcctcgctgggtgctcgacgacatccctgccgagcgttgggcggagctcgatcttggaccagaccgaactatcgaggtgagactcctggctcggggcctgccgctcccagcgtgagcggtgccgacgactcggtggtggcgacatcgctgcgaccgaggtgtcgcaaccccgcccacgccagagcggcggtgcgctcggcgtagcgcgccgccagtgaggcctcgaacggccgattcggctcgtcgtcgtcgacgtcgtcgatgtaggcggcggccgcgccgttggcgaggccgatgagtgcccgtgcggtcagcagccgatcggactcgctgggtgctcctgtgatcgactcggcaacgagatcggcgatcgccagctcgataccaacgacgatcgactgaaactcgacgtcgcggtagacacctggcccgaagagcacgaggtaggccgcgcggtgcgcgtgcacgaaggcgaagaacgcgcggatgccagaccacagccgcacgcgggggctctcgacgccgcgcgtcgcctcggcgatcgcgcgcgccagctcggccccggcaccgtcgatgacctcacgaaagagggcgcgcttcgaggcaaagtgctggtagatgacgggcttcgtcacccgcgcatggcgtgctacctcgtccatcgacgccgactcgaacccacgctgcgcaaagaccgttcgcgccgcgtccaggatgagcgctcgccgacgctcggctgggagtcggtgagcccgtgtgtcggcctgcatgtgctcccctctgcgaacgcaacgcctcctcggtggccctcgacactagccaggttggcacgccgcgtctcgtcgtgcgcgtgcgctgtcgtccttctgccgcgccctgagcccagagtgcccggacctctgcgcgcctaggctcggggtccgtgaagacagcactcgtcaccgggatcactggacaggacggctcgtacctcgccgagctcttgctcgccgaaggctatcgcgtcgtcggtatgcaccggcgttcgtcgacgctgaacttcgagcgcatcgcgcacatccaagacgacgtcatcctcgagcccggggacttgctcgacgaggcgagcctgctcgccgtcttgcgtcgctacgagccagaggaggtctacaacctcgctgcgcagtcgttcgtgcagacgtcgttcggtcagcctgtgctgaccggcgagaccactgcccttggtgtcacgaggctgctcgacgcgatccgggtggtcaaccccgagatcaggttctaccaggcgtcgacgtcggagatgttcggcaaggtcgtcgagacgccccagcgcgagaccacgcccttctatccgcgcagtccgtacggtgtcgccaaggtctatggccactggatcaccgtcaactaccgcgagagctacggcatgcacgcgagctctgggatcttgttcaaccatgagtctccacgccgcggcctcgagttcgtgacgcgaaaggtgacgttcggggtcgcacggatcgcccatggcctggcccacgagctgcgactcggcaacctcgacgcgcagcgcgactggggttttgcgggcgactatgtccgtgcgatgtggttgatgctccagcagcccgagccagacgactacgtcatcgcgacgggatcgacccattcggttcgagaactctgcgagcgcgcgttcgccgtcgccgatctcgattgggagcgctacgtcacggtggacgagcggttcatgcgtccggccgaggtcgatctgttggtcggcgatgcgagccacgcgcgacgccggttgggttgggagcccaccgtgagtttcgacgcgctgatcgagatgatggtccgggcggacctcgagctcgtcggctcgacgctgaagtaggcgccatggcccgcagggtcgttcggctgcggggtgtgaccgtcctgctcggtcggttccctgcactggctcgtgccgacttcgacgccttcgaaggcgaagtcgtcgtgctcgaagggccgaacggatccggcaagacgacgctgctgcggctcctcgtggggctggttggcgcgtccgagggcgaggtggccgtgttcggcctcgaccctgccaaggacgtcgcgagcgtgcgtcgcgcggcgacctacctcgggcaccaggccatgctgtacgaggatctgagcgccgaggagaacatcgctttcctcggacggctcggcgtcatcgatgccgaacgcgcccggggcctctgcgaccagcttgcggtcggccgacgcgagcgagggcggcgcatgcgacagctctcggccggccagcggcgcaaggtcgcgctcgccgcgacgctggctcgacctgctgagttgctcctgctcgacgagccgcacgctgccctcgatcccgagggcaaggaactgctcgatgcgctcctcgcagacgctggcgcccaaggtcgcaccgtgatcctcgcgagccacgaggcggagcgggttcgttcggtcgcgacgcgtcgctaccgcttgagcgggggtcatcccaaggagctaccctcgtgctgaaggtcgcggtcgcggtgtggcgcaaggaccttgggatcgagtggcgaactcgcgtcctgctcaaccaggtggtgccggtcacgctggtcatcgtggtgctttttgggttcgggctcggcgccgacgacccgctccttcgagccgccctccccgggctgtactgggtcagcgtcttcttcggtatgaccctcgccgttgcgcgcggtgcggcgatcgaggcagaggcgggtgcgggcgagctgtggcgtctcatggatgtgccccgcgctggcgtgtacctcggcaaggtgcttgccgtcgcgacctggggcgtcgtgatcgaggtcgtcaccgccgccgcggccgccattctcttcagcgccccgctcggtcaccctctcctgcttgcggcggctgcgctgctcgccgatctcggggtcgcggcggtcggggtcgtgctcgcccagctcgcgaccggggagcgtgcagccgagagcctgctgccgctgctcacgctgccggtggtgagccccgtgctgctggctgctgcgaccgtgtggagcgagggactcgctcaccacgcttccctggcaactccctgggtcgaggtcctcgtcgcgttttcatgtatctacctgatcgttggcatgcttgtatacggtgtcgtcctggaggggtgagtcgtgagacaacgcgcatcgatggtgcgacgagtggtgggtcttggcgcgctggctggtgtggcgctcaccgcctggctcggcctcgtggccacgccgcccgcggagttcttcggcaacctggttcggttgctctacgtgcacccgtcgatggcgtgggtcgccttcttggcctttggcgtgacgacgctcgcgagtgcgctctatctgtggccgaggacccgtcggcctgagtgggacctgctcgccgctgcctcggccgaggccggcgtcgtcttcaccgggctcacgctcgtgaccggctccatctggggtcgaccgacctggggcgtgtggtggacgtgggatgccctgttgaccgcgaccgccgtgctgttcctgctgtatctcgggtatctcgcgctgcgtcgaattccgatggacgaagagcgtcgtgcgaagcgctcggcgatctgggcgttgatcgccttcatcgacgtgcccatcgtgaaccagtcggtgtactggtggcacacgctccatcagcgtcccaccttgaccgttggaccgacgaacgcagtcgaggtccacgggatcatggccgtggcgctggccgtaagtttcgtgtcgttcacgttggtatggatctggatggtgtgggcacggttcgacctcgcgcggcgccagcgcgtgctcgaggaggccgaggtcgagcaggccctcgccgagcgcctcgaggccgtggaggcgggctcgtgaacggctacgtggaggccgggtatctcgcggtcgcgctcggtctgggtggctacgcggtgtggatcgccgccttgacgacgcgcgtacggcgtcgtgaacgcgaactctccgtgacgaggcaacgccgtggctagtgcgccgagcacgctcgacggtcgcgacgagtggaagacggtcccgagcgctcgtcggacgcgtcggcggatgctccagtcgttggtcctgttcgcagcgatcctcgtcgcgctcgtggtcgtgctggccatgggcgccaagagcgcgctcgagtactacctcacggtcccgcaggcgctcgccaagcgcgccacgctggccggccagaccttccgcatggagggcatcgttgtgcccggctccatccagtcgacacccgagggggtcgattttgccctccgctacgaccgtgcggtcgctcgggtcgtcgagatcgggaacccgccccagctgttccagccctccatcccggtggtggtccaaggtcacttcgagggttcgacgttcgtctcgaacctgatcatggtcaagcacacctcgtcgtacgtggccgcgcaccccaaccgcatcgctgatgccggagggacctacaagccgtgacgcaggcggtccttggtacggcgggactcgtcgttgccttcgtgttcgaggtcgcagggacggttgcgctcgccgttgcactctggcggcggaggcgactctggcgcgacgtgggccttcggctgctcgtggtcggggtggcggctgtggtggcatcggtcgcggcgctcgaagatgccctggtcacacacgactttgcgctgagttacgtggtccagaacaactcgagggagacccccctcatcttctcgatctcggggatgtggtcggcgctccaaggttcgctgttgctctgggctctggtcgggggggtgtatctcctcgggctcgcctgggtgctccgtcatgaggacgactgggtggtcggcgcgaccgcgctggcgatcctgggtgtgatcgaagcgttcttcgtcggggtgatcctgttcgccgcgagtccgttcgcactcgtgagcggggtcattccggtcgatgggcagggcccgaacccactgttgcagcagtatccgctcgtgctcatccacccaccgatgctctacgcgggtctcgtgggcatgagcgtcccgttcgcgctcgcgacggcttcgctctggcatcgccacctggacgacgcgtggctccggcgcatccgcaactggtcgttgatctcctgggtcgcgctcggcatcggcattaccttgggggcgtggtggtcctaccaggtgctcgggtggggcgggtactgggcgtgggatcccgtcgagaacgctgcgctcttgccctggctgatcatggccgcctacctccacgtcgccgtcggcgaacggcgtcgtcgccgcttgagtgctgctgggtatggtctcgtcgccgccgccgccgcgatgacgatcttcaccacctacatcacgcgttcgggcgtcctcgagagtgtgcacgccttctcggactcgagcctcgggacggtactgctcgtgttctttggcctcgtggtcgtcggcgcggtggtggtcgcgctcgcgcgcgccgatgtgctcacgcagccaggagcgcgaccgaacggggcacgcgggacgctgctcggcatcaacgcggcgctccttgcgctggtcgcggtggtggtcctcgcgggcaccatcttcccgctcatcgactaccaggtgagccatgcgagcgtgaacgtcggtgcgcctttcttcgatcgcttcgtggtgcccttgtcgctcgtcgcgttggccctgatggcgctcgccccctggtcgaggtggcagggcgcccatctcgacgaactcggttcgcgcaccctcgccccggctgccctcgcggtggtggtgctggtcgtcgccgtcgcagccggggttcgatcgctcgcaacgcttggcgcgtggtcgctcgccgccttcgtgctcgtcagcaccgttgccgcagtggcacgacagttggcggcgcgcccccgcggtcgtcggcttcgcgcggtcgcgtctcggcaggtggccgggatgatcgtccacatcggcgtcgcgatcgtcgcggtcggcatggcatcggcgacgaccttcggccaccagggcgaggtgcgcatcgcacgcggccacaccgtgagcgtctacggccagcgtctgacctacgagggcgtgcgcacggtggtgaccccgcagaagacttcgttcgaggccgaggtcgtcgtcgacggccaggggcgctactacccggctatcacgcagttcgggacctacacgacaccggtgggaacgcccgccgtcgcggtctctccgctgcgcgacgtctatctgaccatcgacgcgcccccgagcacctcgtcctcaccgatcacgctcggcgtcgtggtccagccgctcatcttctggctgtggctcggggctgcgaccatcgcgttcggtggtgtgctcgcggtggtggggatccggctcgaaccgtccggacgacgtccttcggagcgcccggaggcgccggtgccgagtgtggtgggtgcggatgcgtaggcgtcggccagtggtcgcgttcgggatcggggccctcgcgctcgtcggcggcttcacctggctcgctgcccgcgcggctccggccagcgagatccaggcaccctccccgctgctctacaagccggctccccgattggcaggcccctcgctgtggggctcggggtcggtgtcgctcgctgcgatgcgcggtcgctacgtcctcgtgaactacttcgcgagctggtgctccacctgtgccaccgaagagcgccagctcgtcgacctcgctcggggctcgggagtacgtgtgctcggcgtggacttcgacgacacgaacggttcggcccgttcgttcctcgcgcacttcgacgcgcacttcccggtcatcgtggacgcgagcgggcagcgcgcactgcgatggggagtgtcggcgccaccggagagcttcctcgtctcaccgagtggcgaggtcatcgctcgcatcgtcgggccgctcaaggcgatcgaagtggaggcgctcgtgcgcctcgccgaggcgaaggggtacggggcgtgacgcggacccgtcgcatcgcggtggcctggttcctgctcgccgcggtggccctcggggccgtgctcgtcgcgctcgtcgagcagccgtcggcggcgtcgcctgctgctcggatcgcctccttggagcgggaggtccggtgcctgagctgcggagagctcgacgttgcccagtcgaagagcgccgaggcctactccatggcggcattcattcgccacgaggttgcggccggcgcatcgaaccagcagattctcgatcaactcgtcgcgacctacggtgacgcggtgctgatggcgccaccggccaacgggctcggcctctacttgtggttgctgcccgtggcggtcggggctggcatcgcatgggagctggtgcgcggggcgcgccgtcatcgcgatccggaggagctctctggcggccgtctcggcaccgacgcggacgagccggcaccgcagccatcgaggcgtaccggcggcggggtcgggttggcgctctcgccgacggccgtggccgcggctccgtccggtgaggatgagcgccgcgctcggccgcgtcggttggcggtgccgaagtgggcggccctcgtcgggggcggactcatgctggtcgcagccggggttggtgtcggggtcgccatcggcgggtcgggcggcacggctcacacgacagcgaccctcggtgaggatctgcgcctcggggagacgttggcggccgtgggggcatctgctcaggccgagcgagccttcgaggctgcgctcgagctcgcgccgacgaatccgacggcgctcgcctacgagggctggctgcgcttcaacacggcgcactcgagtagggcgcgtgcggcggcgctcgcgatgctcgatgaggcggcgcagctcgggccgcacgtcgccgtcgcgcagctgttcgatgggttcggactgttctacggccgtcacgagaccgccggagcccttgcgcgtcttcgtgcgtacctggcggatgcaccgagctcgaagctctcgctcgaggcctcgccgctcgcggtgccgatctactcggcggcgcacctcgccgtaccggcgccgttccgaagccgaggttgatcgccgcatctgcgtgcgggccgatgtggtggtcgggctggctcgccggggctccgcttcctccctgggaagcccggtggccgcctcgtggttgctacggtacggctgctgtcaggaggttcgagtggggttcttcgatcgcaagcgcaccgagctcatcgagcggggcatcgacccgagtcgtctgccgccagggcagtacatgaccgaccgcttcccggtcctgcacgcaggcgaggttccggtctatcacgaccttggtgcgtggaacctgcgagtgttcggccgcgttgggacccctgtgacgctgtcgtacgatgagctcctcgcgctcggtaccgaggacgtcacgaccgacatccactgcgtcacgaagtggtcgaagttcgacacgcggtggcgcggtgtgccgttctcgcgcatcgtcgagctcgtacgaccgagcgaggacgctgcctacctcatcgtgcacgcggagcacggcttcacgaccaatcttcccctggccgatctcctcggggatcacgttgccatgctcgcgacccactacgacggcgtgccactcgagccggagcacggcttcccggtgcgcttcctcgtcccgcacctctacttctggaagtctgcgaagtgggttcgcggactcgagttcaccgagtccgaccgacccggcttctgggagcgcaacggctaccacaactatggtgacccgtggcgcgaacagcgctactgggacgagtagttcggaccatcgcacagagccgagcgctcgcatcgcgccgtgaggccggcacacgagggtcgaggccgcgtgattcctcaccgctctctggcgcgtgcgccccgcgagatcgtgccgtgaccgcgtactagggtgctgccatggcgggtgcggcgtcgtcgcctggtccgctggacgaccccggcgacgaggtgggtttgacgactcttgctccgggcgtcgcggtgcatccggatcatgcgagcctcctgcgcgaactcgatacggcaccgctcggtctcgagcacgtcgtctcgtggtggatcgcctcgggcgggacgctcgccgatggcttgtccgtggccatcatcggcatggcgctgccactcgccgaacatcagctgcacctcggtaccgtagaggtcgcgctgctcggagctggcctggtcgctggcgctgcggtgggggcgagcgtcggtggacatctcgccgatcgtgtggggcgaaccgcggtgatgctcgccgacatgctgctcctcatcgtggcggccgtggcgagctcggtcgcgtggagcgcgccgttgctggtcgtcgctcagtgtggggtcggtatcgccgtgggtatcgattttcccgccgggtcgagctacgtcgcagagacgatgcctcaggcttcgcgtgcgcacttcctggtggcgacgatcgcgaaccaggcggtcgggatggtgctcggtgctgcactcgtcctcggactcgtccacgaggtgcagaccccgagcgtgtggcgcttcttcttcggcgtcgaggcgctcgtggcagccttctttctgctcgcgcgcctgcacctcgtcgagagcccacgctggctgatggcccgcggtcgcaaccgggaggcgttgcgcgcgatggaggtcttcgtgccgagtcgagcacgcgcgttcgaggggatcgctgcgcggctcggcgatcggccgctgcacgtcgcacggatcccgcacgatgacaaggcggcgcggtttcgctccatcttcgcccccgcctatcgtcgtcgtacgctcctgacgaccgtgccgtggctcttgatggacatcgcgacctacggtgtcggactcttcacgccggtcctcctcgatacgctgggggtgcgatcccactcgtcgaacctgccagcgcgcacggcgagcctcgccctcgggacgggcttcgtcgacctcttcctcctcgcgggctttgccgtgggcgtcgtcgtcgtcgcccgcttcgggcgtcttcgcatgcagatcctcggcttcgtcgggatggcgatcggcatgggtgtgcttctggcgagcacgcaggtgacgatctcggttctccgggtcgcgttcgtgctcgtcggtttcgtggctttcaacttcctcatgaatgtggggccgaacagcacgacctacgtcctgcccgcggaactgttcccgacgcagctgcgcagcaccgggtcgggcttcgccgcgtcgatggccaaggtcggagcgacgatcggcgtgttcctcgtccccgtcgtgtcggctcattgggggaccgccgcggtcgtcggtgcgatggtcgtcgtcagccttctcggtgcgaccaccacggtgctctggcgagtcgacgatcgtgagcagacgctcgaggagcatcaggcgtcagagcccgtcgatacgctgtgacctcgtgggcggcgagatcgacacatcgggcgggacgctgcgcgggcgtgtgctgatgcgcgtctcgaatcagacgtcgccgagtcacgtgcgtcgtggacggcgtctggccggctgcggtggctgcgagagcaccgtcgtccctcgccagtgcttcgccgcgcgcgtgaccatcactcgatccagccacgctcgcgtgcgaccgcgacggcttcgtggcgattggcgacgccgagcgtgtggatgatcccagacaggatgttgcgcgtggtgccgggggcaaagtggacgcggagggctacctggccgatcggagcaccgtcgctcgcggcgcggagcacgcggagttcccgttcgctgagcgggccgtggccccgccgcaaatcgggggcgatgtggggatcgatgacgcagctgcctgcccacgctgcggcgagtgaggctgcgagcgcgtcgatcggcatgctcttcgagaggactccgcggacgccagcggcaaggagctcgagggtcagtgtgctcgttgcaaaggcgctcagcacgaccacgcgagagccggcttgggtgagttcgcgaatggcctcgactcctccgccgggaacgtcgaggtcaaccacccagagcgctgcggtcgtcaccgtgtcgtcgtgagggccaggcatggtgaccgaggtcgtgacaatggtgaactggccagtgccctcgaggagcgacgcgagtgcgctggtgagcagttcgtggtcgtcgatgaggatcagagggatcgtgggactatctcctcgctcgactgcgtccgctccaggcgaagccatgtaccgggcggttctgaaccgaggctccagcgtgctccgatggcggctgcgtgcgcctcgacggcgcgcaggcccgcaccaggcgcaccgtgcagccccacgccgtcgtcgtgcacggagagggtgagtcgagtgctctcggggtcgtagcggatcgagatcgccgcggtcgtggcgccggagtggcggatcacgttggcaaccgcctctcggaggatccatgcgagatgctcgtcggtggccgggtcgagggcatggatgccgtgggtgtcgaaggtcgtcgcgatcgacgccgtcgcgagccgctcgcgggctcgtgcaagctcgtcgaggaggcggctgggaggtggcggttcgtcgatccgtcgcagcgattcgagcgcatcggcgagttctcggtggacggaggtgagctggtgctgtgggtcggagtactcgagggaccgaagagcgatggcgacgtgctgtgcggcggtctcgtgcagctcgcgggcgaggcgcagccgctcgtcggctctcgcccgggcgacatcggcgtcgcggagacgctcgacggtgtgcagtgctccgaccaggtccgtcatggccgttgcgcccacaccggcgagcaggacgttcacggccaggttgatgccaaggccaggactgtgcgtccagccgatcgcgagcgtcacggcggcgagcaagccagcggcgagatagctgcgccatcggcctcggagcgtgatcgccgtggcgatcacgacgatcatcagggacgtctgtgctgcggggtcggacgcgacgcccatgagcgaagccgcactcgccacggtgagagttgtccacacgagcgtcgggcgagcggcccgaagcgtcgcgacgagcagcccgatcagggccgcgacgaggatccacgcgacggccgatgctcgtgtgcggttcagcatcgccatcgcaaaggcgaggttcgcgccctcgagaaggagccaggtgagggtgaggttccgcgttgcccgtggtgctggactggtcatcctgctcgttctcctcgagcgcgatggtagccgatgaaggtcgcgatcgcgaaggcgagctcccacgcgccaaggacgacgacagcatggccgatggccttcgcgccgtagaacggggtgagagccatcgagacgatggcggcggcaggggtgtcgacgccgatctggcgtaccagctccggcaatgtggaaagcgggacgaacactccacctgcgaactcgaggacgaaagccgcgacgctcgccagctgcgacgccgtggtcgggctcccgatcgcaccgatcgcgagcgcgccctgggcaaacacggcaccgccgagcagggcgaccccatccacgcagagccagtccgcgagcgggagctgagctccgagccagagcgcgatgccgtcgaggacgagcaggccagcggcgccaagcacgagagcgccgagggcgcgagcgagaaagtaccagcgactcggcgcgacgccaaccgtgctgagggtccggagccatccacggtggcgatcctccgcgaccgcgatcccggcgccggtcatcgcggtgatgccgacgtaggctgcgaggtgagccgtgacgagggcgacgatgttgcccgagccgacgacggtgtggcggtatgcagcgtggtcggcgaagaccacgagcagcaccacggggaccacggcgatgagcagagcactccgccgcgccagcgtctggtgccgaacgacgagttcgatggtggctcgcgcccgagcgagactcgggcgaggggagcggtggccgattgcggtcatgggtgttcctccgtcgtcggatcgcgctgtaggttcagcagtcggcggatcgcctcgtcgagtccgacgggggcgatctcgagcgcagtcgcgccgaggtggagcagttcgtgcgccagcccatcggcatccgtagctgtgaaggtggttcggtcgcgctcgatctcgagcacggcggctccgtagcgatcgagggtgtcggcatcgggttgctcccggagcgtggcgctgacccgcgcgaacccggagcgccctcggatctcgcgaggcgtggcgtcggcgatgagacgtccgtgcgagagcacgatcactcgatcggcgagtgtgctcgcctcggcaaggtcgtgcgtcgcgaggaggagcgcgccgccacggctgcgatgatcctcgaggacggtcgccagggtcgcgcgggcctcgaggtcgagtgccgtcgatggctcgtcggcgatgatcagctcgggcgtgcccgcgagcgcgatcgcgaggcgtacgcgctggcgctgtccgagtgacagcgtctcgaagcgagtgcgagcgagctgcgtgaggccgaatcgtcgtgccatcggggcggtgtcgacgccgcgcatacgtccgagcgcgtcgaggagtgcaccgaccggtgcagatggggggaaacctgcatcggcgaggaggacgccgacggcgtgcgcttggcgagtgagtcgagggggctcgccgaagaggcgcaccgatcccgcttgtggcgtggcaaggccgagcaggcactcgatcgtcgtcgtcttgcctgcgccgttcgggccgacgagcgcgaccgactcctccgactcgatgctgaaggtcacgccgtcgagtgcggtgaagctgccgtatcggcggacgacgttgtggagctcgaccgcggccgttcgggacgtcatgctgggcaacgtaggtcctgggggccgagtgtcggtgacgacggacgtcacgagatcgcgtgacaccggtcacgcgccgcgacccgctcgacctcactgatggccgacgatccgcactctctgagctcggtcgatgcgtcgtcgatcgagcggcgcctcgctggttgggtgggcctccgcctccgcgcagtcgcgcaggccacacgtcctctcacggaccaggttcgaggagtggcccggcgtcgttcgatctcgcgggagccgtgccctctggcgagagctcgaagcgcctcacagagaacgacaaccgaccgtgctccatcgagcgagccttcgttgacccactgaggacaacccaccccgggtgggtgggtcgccgtcgttgcgctgctcggcgatccatgcaagctcgctcccgccacgcggtcgtcacggtgcgagtggtctcggtgtcaggggctagccagcctgggctcgtaccgagggagcacgtggtaagaggtcgatccattgcaagaaggcgctcgcggcaggcagaggggcgctctcggcccgaggctcacttggaccgacggtccgtcgcgaggccctcaggcggtctgggcgcgctcgccgtcggccgtcacggtgcccctgctcgcgcgatggggaggggccatcatccgtacctcgcacgagcccgccgtgccgcggatcgggcgggcgtcgagtgtgccatcacccagcccatcgaggaggccgtcgaggatgcctcgctcggtcgcacagagggcggggtagtgctcggtgaggaggccgaacgggcagccgtgctggcggatcgtctccgtgccgtcggcttcggcggcgaaaccacttcggcgaagcgcggtcgcgacggcccgcatgaccccagaggcgctctcactgacggccgtcgacgcgagcgccgcgccgtgggcgcgtcccacctcgtaggcgatcctcgccgctcggtcggctgggacctcggcaagcaggcctccgacgagagcggcgaggagttcgacctggctctcgaggccctcgaacggtgctcgcgatccctccgcccgatagcgcttggatggtcgaccaacctggtggcgagcaccctggctgacgacggcgaggtagccggcctcgacgagacgatcgaggtggtgtcgtgcgacgttcggatggaggttgaagtgtgccgccactgacgacgcggtcacgtcgtgctgctcgcgcgcccagaggtagatcgcgcgtcgcgtgccgtcaccgagggctcgcgtgaggtcatcgagcgtctgggtgagccacacgcccgttccgcgctccacgacgcctcctcgcactcgctggccgagacggctgttctcgtaccgagggccaacggcgactagtttatcgctgagcgacgtggtgggagggactgtggcacgtgtgacgaccgaggaggtgctcgagcgactcggggagctcgccgacccggacctcgaccagccactcgtcgaccttggactcgtcgatgtcgacatcatcgcacgaaccccgcgcgtcaccgtgcgctacgtgccgggctcggagcaggtgacggaccagctgcgcagcagtgcaaggcagcgtctcgaaccgctcggcgtccagctgatgctcgaacctctcgatgaggagggcctgagctccctcgcggctcgtctcgagtcgacgagtgctcgcgaagcacgtgaggcgcgcaaggcgccgttcgcgagtcccgagagccccacgcgcgtgctcggcatctcgtcgggcaagggtggcgtcggcaagtcgtcggtgtcggtcaatctcgccctggcgctcagtgccttgggccaccgcactgcgatcttggacgcggacgtctacggcttctcggtgccgaagatgctcggcgaagagcgtccgccgcgggtggtggggcagctgatcgtgccgccgaggatccgtggcgtgcgagtcatctcgctcggtttcttcgtcgacgatgcgacgcccgtgatctggcgtggtccgatgctgcactcgacgttgcagcagttcctcgtcgatgtgtactggggcgagctcgactatctcgtggtggacatgccgccagggaccggcgatgtagcgctgagcctgcaggagttcttgccgagggccgagatctacgtggtgacgactccccagcccgccgcccagcgcgtggcacagcgctcggcgatcgccgcccgcaagctgaagctccccgtgcgcggcgtcgtcgagaacatgacggacttcgtggccgacgacggcacgcactacccgatcttcgggtccggcggtggtgacgcgctggcggcggccctcgaggtccccgtccttggacggatcccgttgacgatgggtctgcgtgccggtggcgacgaggggatgccggtggtcgcggtgcgtcctgatgaccccgcggcggcagccattaccgagcttgcggcgcgtatcgtgtcgctcggtgctgctcggcgctaccgcgccgatctgcgcgtgcagacgcgctgaggaagagtggccggtcggccacgatgcgaggaggatacgtgcaggtacggatcgggatcgctcagagtccgcgtgagctcgagctggagttggccgaggagagcgaccaggctgcggtggcccaggccgtcgatgccgccatcgaggccggaacgggagttctctggctcgaggatcggcggggtcgacgtatcggagtgcctgtagaacggatcgccttcgtcgagctcggaccggatcggaaccagcggtcggttggattccgggcctagccgatcatccgcatgggctttgacctgctccgccgccggctgctgatcatcgccggcaaggggggagtgggcaagacgacgctggccgcctcgctcggcctgcttgcggcgtcgcgtggtcagcgcacgctgctcgtcgaggtggatgcgaagggagatctcgcggcccaggtcggcgtcgcgaacgcggggttcgagcccgtcgaggcccggcgcaacctgttcgtcatggagatggacacgcaggctgctctcgaggagtacctgcgtatctgggtgaagctcccgttcatgggtcgactccctggactcgggcgcatcttcgacttcgtcgccacggcggcaccgggtgttcgcgagctgctcgtcgtcgggaagatctgctacgagattcgtgaggaccactacgacctcgtcatcgtcgatcctccggccagcgggcatgtggtgtcgcagctcggggtgacgaccggggtcggcgagctgatcgggcggggactggtgcaggggcagacgtcctggatgctcgagatcctctcggacccggcgcgctcgctggcggtcctcgtggccacgcccgaggagacgccggtcgaggaggccctcgagctcgccgatcgcctgcgcgacgagacgccggtgcacctcggcggagccttcctcaaccgcgtcgtgccggtgacgctcagcgaggaggagctcgaggcgctcgagcgcaccgcgggccgcggtccttcggcactcggcgcggtgctcggtgccgctcgtctctcccagggcattgctcggcagcatgctcgcaaccgcgcagtgttcgccgatgcgctcggccccgacgttccgcttcgggagctcccagagctttttgcgacggtgccaccatcgcgcctcgccgacgaactcgctgaggcgctcgaggtgctcacgtggtgagcgaggccgttcgtgcggtgacggcgttcgagcgcttgttcgtcgtcggggctggtggcgtgggcaagaccacggttggcgcgggccttgcgatcgcgaccgctgtcgagctcgacgtgagcgtcctcgtcatcaccgtggatccggccaagcgtcttcagagcgcactcggtctcgaccatctcgatttgcgtcccgtgcgggtgccgctcgagggactcggcgccaaggggcggctcgaagcggcgagcatcgacatgaagcggacgtgggatgggatcatccggcgctgggccccgactgacgaagtgcgcgatcgcctgctcgcgagccccatctacgaacacctgtcgtcgcgcttcatcgggtcctacgattacgcggcggtcgaggtcctcgccgaggtcctggagggcggttcctgggatctcgtcatcgtcgacaccccgccgtcgcgcaacgcgctcgacatcctcgatgcgcctcgccggctgatcgagttctttcgctcggcgctcctgaagctcctgacgttgccgcggcgtgcgcgagcgttctcgctcgcggcacgcccgttcttcgtggtcgccgaggcggtgctcggctcggccttcctcgaggacgtgacggagttcttcgccgattttgcgacccttgccgagccgctcaccgagcgctctcggcgactcgaacaggtcctcgtcgctcccgagaccggcttcgctatcgtgtcgacgccgctcggtccctccacgagagaggcagaccggctcgaggccgccctgctcgatcgcggactgcgtgtcgccgttcggatcgtgaatcggtgctggccgcccgaggacttctccccggcggccgagcaagccctcgggtggttgcgcagccccgagggcatcgaggtgctgggccgcgaactcggagacgacggggcggccgcacgcgtcgctgccgagctcgccggcctctatgcggagctcgagggtgcctgggctgcccgggctcccgagggagcgggcagcctcgagttgccgctgaccgatgcagcgttgacctctccagaggccctgtggtcgctcatcgcaaccgcgaggatccgaggggtcacctccgagcacgagtagcatgggcggcggtgatcgactaccacctgcacctgtggccccatggtgagcgcgatcgcgacgtcgtcatcgaggagcttgctgcgttctgtgaacgcgcacagggtcgcggtgtcgacgagatcgcgatcacggagcacttctaccgatttcgccaggctggctcggcggtcggtggcttcttccggcgctacccggattcgccggtgcgcgccgagatggagcgctactgggaggagaactcccgggcggatctcgacgcctacgtcgagacggtgcttgcggccaagcgcgagggcttgccggtcgtccttggtctggaggtcgactactacgagggcgccatggaccgtgtcgcggcgctccttgccggctaccccttcgacgtgctgctggggtcggtgcactgggtcggtgcctgggccttcgaccacctctccgaccccatcatgatggccgagtgggagcgcgtcggcgtcgagcccgcctgggcggcctacacccgaagcctcgaggagctggctgcgagcggcgcggtcgacgtgctcgctcacccggacctcatcaaggtcgccggtcaccgaccggaggtgcccgacgagtacgaggcgcgtatggccgaggcggcgcgtgcgtccggcatggttgccgaggtgtcctcggccggtgcgcgcaagcccgtcggcgagatctacccgtcgccgtcgctcctcgctcggttcgtggcggcgggcgtgccattgacgacggcgtcggatgcccatgggctcggagacgtggccgatcgatcgagccagctgcgagccacgctcgaggcggcaggcgtgagcgagctcgcagccttccgggcgcggcggcgtcagtcggcactcctctaggctcgatgaccgaactcaccgccgtgggtcggctcgaccaggccgagcggacggcgctgcgtgagatcttgcggttctggggattcctggccgacctcgcgttctcggacctgttcatcgccctgcccgacggggacgacttcgtcgtcgtggcccaggtccgtccggcgaccacccagaccattcacccgggcgacctgatcgagactcgcctcggtcccgacgaggcgcgacacctcgccgaggcgatggaggcgagggtcatggcgaccgtggatcgctccgacgggactcgcctcatccgctccgccgcgttgccgctcgccatcgaggggcatctgccctacggggtgctggtgcgagagcgcctcgtcgagcactatcgcaccaccggcgaactcgaggcaacctacaaggcgctctacgagcgcttcagccggatgatggtccagggccgttttccgtatccccagagcgacgtcgaagaggcgccgcgcgtcggcgacggtgtgctcgtgctcgatcgcgctggccgcatcacgttcttgtcgccgaacgcgacgagtgcgctccatcgcctcggcgccacggaggtgacctcgggggcggcgctcgccgacgtcggcatcgacgtgctcgcaccggcccgggctgcggcgctcggcgcgcccgtgctcgaggaggtggagcatgcgggcggtgccacggtgaccttctactgcctgccgctttacgacgcgggcgagctcaccgggcacctcgtgctcgtgcgcgacgtcaccgacattcgccagcgcgagcgggtcatcgcctcgaaggacgccacgatccgcgaggtgcaccaccgggtcaagaacaacctccagaccatctcgtcgctgctgcggctccaggcgaggcgcctcgccgaccaggaggcggtcgcggcgctcgccgaggcggagcgacgcatccgctcgatcgcactcgtccacgagttcctctcgcgggacgtgtcggaacaggtggaggtggatgaggtgctggcggccatcggtcgcttggccgaggagtccaagctgccaggacgcacgctcgagctggcgatcgagggctcggcgggcaaggtcgaggcgacctgcgtgacgccgcttgccatcgccctcgcagagctgatccagaactccctcgagcacggctacggcactgagagaacgcacctgcgcgtcgaggtggctctcgagcgacacggtcccgagctctgggtggtcgtggcggacgacggcgtcgggtacccgagcgacctggatgcgcggagcgctcgctccctggggcttgcgatcgttcgagatctcgtggcctcgcagctcggcggcactattcagcttgcgcgaacgcccggcggcggcgcgctcacgcggcttcgagtccccgtcgagcgtcacgagcgctgacgtggacggccccgagggctctggtacgctgggcccgaagcccgctgacggtggcggcatgcggaggaggcgtctcgcgtgaagatcgcggtgtgcacgaagcagatccccgaccctcaaggtcctcagcgtctcggcgacgacctgcggctcgatcgctccggcaaggtgcttctcgacgacgcggactcctacggcgtcgagctcggactccagctcgccgaggcgagcggtggcgaggtggtggtcgtgtcgatggtgcccgaccacgagaccgctggggtccgccaggcgctcgcgatgggcgcggccagcgcggtcgtcgtctctgacgatgcgctccgtggggcagatgccctcaccacggcgacggtgctcgcctcggtggctcgacgggtcggggccgacatggtgctcacagcgacggagtccacggacggctacacgggcaccgtggccgcccagatcgcgggtcttctgggatggcccgccgtgaccttcgccaagggcgtcacgctcgagggaacgcacgttcgggccaaccgtcaggccgaagacggcgtgtgggtcgtcgagtcggagcttccgtgcgtggtgagcgtgaccgcaggtgtcgtcgagccacgctacccctcgttcaagggcatcatgagcgcgaagtcgaagccggtcgagcagctttcgctcgccgatctcgggctcgaggcgcgcgcgacgcagcgcgtcgtcgcggtccaggaggcggcccagcgtgaagcgggaaccgtcatcgaggacgacggatccgccgaagcggctgtcgtcgcgttcctcgagtcgatcaaggtcttgtgaaggaggcgacgtggcaactgcttgggtgatcgcagagcagcgtgatggtgcgctggcgccggtgacggctgagctggtgaccgtcgcgcgcgacgtcgccgatgaggtgcgcgtggtggtcgcgggtgacggtgccggagcggcgtcgtcgctggctgcctacggcgtctcggagatcatcgatctcgggcccctcgacagcgtgctccctgggccggtgcttggggcaagcgttgcacggctggtgggggaggagccctcggtcgtcatcggcgcgcagacctacaccgggcgcgacgcactcgggcgtgcatcggccctgctcggcgctccggtcctgaccaacgccgtcgccgtgcggcgcgagggagaccaggtcctcacggagcaccagatcttcggcggcaccatggtggcgaccgccgcagcggagctgcgcggacacgtgctggtgggcgtgcgacccaagagcgtcgccgccgtggccgcggctgcgccgacggctccctccgtgcgggttgtcgagccggcactcgatgtgcctggggtcgtcgtcacggtggtcgatcgccagcgcgaggagcgcgaggggccgagtctcgacgaggcggccatcgtggtctccggcgggcgcgggcttggcaagcctgaggcctaccagatgatcgaggagctcgccgcactgctcggcggtgcaccgggtgcatcgcgggccatcgtggatgcgggatgggtgccctacgcctaccaggtcggccagaccggtacgacggtcaagccggacctctacatcgccgtcggcatctcgggggcgacgcagcacctcgtgggcatgaagggtgccaagcacatcgtggccatcaacaaggacaaggatgcgccgatcttccaggtcgccgatcttgggatcgtcgcggatgccagctcactgctgccgcgagtcatcgaggctgttcgcgcccgacaagccgcctcctgaccggtcatcgccggccaggtgcgaggcgcgccagtagccgcaccgggccgtgcctgtgctctgtgcgaccacgcacgatgaaagccgccaccaggaggtggcggctttcgcagcggacagtggaggactacgccttcttggtctcccagaagatgtcggcgatctcgttgatcttcgccagcagctggtcggcgatcgccacgtcgttggcacgcttggcctggctggtcagcttcttcgtcgaccagaagagctcgtggagctgcgggtacttctcgaggtgcgctggctggaagtactgataccagagcacatcgaggtgatggttgcactcctcggcgcgctgctccttgatgagcgtcgcgcgatcgcggaaataggggtcgtcggaggcgttgaacttctccatgatggccttgatcgattcggcttcaacgcgggcctgcgcgggatcgtacacaccacacggcaggtcacagtgtgccgagaccgggcgcggtgcgcggaggcgatcgagggcgttgaacatgcgtgcaagcagcatggccttcctttctcctgttggcgacggtgccaaggcacacgccgtagtgcagtccatggccgccgagcccatgatgggacgagaacgcgtgccacgctcagcttagcgagagccatgctcgtgtgtccgtcgaggcctcgggcgtgcacgatgttgggtcctcatcgagccgaggcgggcggggcgtgcgtgttgacgcgtcgtccgcccatcggcgacccaagggcatcgcacagggagtgaggccgagcaccgcgctcccaagctcctgctcgcgggtgggccagtcgggatcgcgggtcaagggaatgctgctctctgactgatgcaccacgacgaggctcatgctccggccgtggcaccgtcgcccggtcgaggtcgagcgcgatacgctgctcgccgagcagccgactgcgcgaccagcgacttcaatgcggagtactggcaatcaccgcacgctcgactgtcggtgaggagacctgcgcctgcggttggacgtactgggtcgtccgaggccagagtcgcgccagcggcggcgttcgatagctccttcaccacttgaagagaggtacacgagcgctagaggtggtgacctgtcgccgcgaggtcgacgaggatgccgacgatggcgccggccaggacgagggccacgaccacctcgacgatgcagccgagcgttcgaagaggatggaggaccacgtgggcaaccaggatcaccgccagcacgatcacgacgatctccacggcgcctcccttcggcagcgacgctagccgttcgacgtcggcaacgagccgagttctcgagcgcgagctgcggtgcgcgacagtgcttcggcgatggcgctccgtaccttcgcgtcctcgagtgcacggatgccctgggctgtcgtgcctccaggagaggtgaccgcgagacgcaacgaccgaggctccgtgccgcgcgcctccgcgagcgcgatcgtgccggcgacggtcttgagggcgaggtcgagcgcgagctgcgcggggatgccgagggcgatcgccgcctcctggagagcctcgacgacgagcaggacgaacgccggtccggagcccgacagcgccgtgcccgcatcgaggagggactcgtcgaggcgataggccgctccgagtctgctgaacagcgcgaccgcttcctccgcgagggcggcgtccgcctgtggcgacgtggcgacgagtgtcacgccgcggcgcaccgcgagcggtaggttgggcatcactctcacgacagctgcggcacgagggaggagctcgcgtaggcgagcggtcggcacgccggctgcgatggagatgaccctcgatccgggagcgaggctctcggcgacgcccgcgatggccccgggcttgacggcgaggatcgtggtcgttgcctccgccgaggcagatgcggcctcgatgcgcccgtcggagcttgtgagggcggcgatgcggtcgcggtcgacgtcggcgacgccgatgcgtgggggctcgccacgcatcgtggcctcggtgccgtcatcgaaggaggcgagcaagccctggacgatggacgaacccatcgctccagcgccaacgacgaggatatcgagcacggctggagcttaggcgcagctcgcgcaggcgtcgagaggtgtggccgacagatcggcgagcgaggtgaggaagtcgttcgcggtgtgggcccaggtgcgtccgcgcgcgcgtcgcgcgccacgctcgcccatgcgcctcgccacgaccgggtcacggagcacgagggccatgcgatcggcgaaggcgcgaggcgtacgttcgtcgaccaaggctccggtacgaccgtcatcgacgatctcggcaagtccgccggtccgcgtcgcgacgaccggcgtcgcgcacgcaagcgactcgagcgcgacgagcccgaacgtctcgctctcggaagggacgagcgtgaggttggcggcgcggtagtaggtgcccagctcgatctgggggcgtggtccgacgaggtgaagccggtcagacgcacccgcgtcctcggcgagcctacgaacctccgcgaactcgcggtctccgtcgtccccggatgggccgccaacgacgacgaggtggctccgcgggtcgtcgagttcgagccacgacgcgaccgcaagggctgtgcccttgagcgactggatgcgcccgacccacaagatgaccgatgcatcgggggggaccccgatggcacgcctcgcaggccctcgtgagagggtcggggagaagacggcaggatcgatccccggttccacgacgacgagctggccgcgaggcggaccatagagcgttcgcagccacgtcgcctcggcccggctcgaactcacgatgagatcggcgcagccgagcacgcgttgctcttgatagacgcgggcctcggtgaggtgactcggaggttggccgagacggagcttggcacgctcgagggtgtggaacgtgacggcaagcgggagcccgagctcgtgcttggcgctgtgggccacgacggctgagagccaatagttcgcgtgcaccgcgtcgatgctcgtactgcggtcgagcgcctcgagcacacgttcggcgaagtggtcgacacggcgggtgaggtcgcgctcgcggtcatcgtcgctgagtgcatgcagccagagccctggttcgatgcgatgccgaccgggcacgtcgtgtgcgccggtgaagatgtccacctcgtggccggagcgagcgagctgggtcgcgaggttgcgaacgtacacgctcatgccgccgttcgctcccgctcccggtgtggcaaacggggaggcgtgataggcgatcatggcgatgtgcaccagatggctccctcctgcggccagcgtaccgagccaacccgccgatgcggcgtcctattcctcctcgctgcctggcggcggcggaagctcgaccccttcgatgctgccaactgcgatcggttcgccgtcggcgacgattcggtcgatgagtgcggcgctcaccgcatcgagggcgctgtggaggcgccggcgaagctcggagagggtctgctctgcctggcgctgacgagcttcccaggcagggcgctcggtggcactcacttcggtcgcgacgcgtgggccggcgaggtcgttgatggcctcctcggcgagcgcgatgtcctcttctgacagcgagagctcgacgtgacgacgggcgagtggcggcgagggcaggttggagagcgcgagctgacgggcgaactcctctccgcgggctgggccgagcgcaagcgcatcgagtcgcgtctgaagctcgcgtcgcgcgaacgagacgacgttctcgagacgcaaaccacgaccacggagcgcgacgagggacgctcgatcgcgtccgtcaaggtgtgcggacgcctcgatgacctcctcgaccgcgcgttcaagctcggtcactgccaccccccttcgatgggcagcgtcagcctagctcgggcccgccggcgcggcgcgggttgtgcggggaggtgcatgtggctcgctcgcgaactcgaccacgagaccggaagagcccgtcgcctcgatcgtggtctcgcccctgcgacgctccaccgtcacggtcgtcgtgtggtcgccgatctgaagattggtgagcgtgatcctgtccagccaggcgggcagcgctgggcgaacggtgagggtgcctgccgccgcgttcggtgcgagcccgagcagcgcagcaacgatcagcgcgaaagctccggcggcccatgcctggggggcgttggcgagtcgatagggacgagggtaggcgccagcgtcgcggtcgacgccggtgaacagctcggggaggcgaccgcccgcaaagagggtgccggcatcgagcagtgccgtcgcgagcgcgtgggcatggtcggcgagcccgtaggccgcgagtcctgcgatggcgatggcgttgtcgtggggccacaccgagccgcgctggtagctcagggggttgtaggcaggatggtttgaggagagcgtcctcagcccccagcccgagaagaggtcgggtgcgaggaggcgatccgccacggcgcgagcccgctccgggctcggcacctgcgcccagaggaggtgcgaggggttcgacgccaccgagtcgatgggtcgcttggcgccgtcgagtccgagatagtaggtcgactcctcgggccaccagaagcgttcctcgatggcctcgaccagtcgactcgcctcctcgcgcaacgtcgcggcgcgctcgaggtcgccgaatgcctcctcgagtacgttggcccaggctcgcttggcggcaacgacgtaaccctgcagctcgaccagggcgatcggtccatcgacgacgctgccgtccccctggaggatgccgtcttcggcgtctcgccatccctggtgccgatacccagtcgccgagcggggcgcatactcctgcaggccatcgccatcgcgatcgccatagcggtcgatccacgcgatcgcagcctcgacgctcgggccgagccgcgcgaggagcgctcgatcgcccgtccagcgccagagctcgccggccgcgatgacgaacagcgaggtggcgtcgtgcgtcccgtagtacggagtgtgcgggatgagctggagttcggcgagttcgccttggcgcagctcgtgcgggatcttgcctggttcggcgtcgcgtgtcgggtcgtccgtggtcgcctgaacgctggcgagggcaaagagcgctgcctggaggaactgcgtcccgagcatgacggtctcgagtcccgtccagatcgagtcgcgtccgaacagcgcgacgaaccatggcaccccggccgcagggatccagggcaagatgtccgggtgcgcgccgaggccagcgccctcggcactcatgcggagcgcgagcaggtcgtcgaccgagcggcgcatgatccgctcgagcctggtgttggaggtcgtgacggtggtgaggagccgacggtcctggtggagcttctcgagcggcgcgaccagctgctcgcacgcgtaggtcgggctcctcagcgtcgtgaggcgcgcgtgcaggcgcaggcagatggacgtctcggctcgcggctcgagggcgatgcgtacgatcagccgaccgttcgcgtactcgggctgtgcgggagcctcggcgacctcgacgacgagcgcacgtgcgaacgcgccgttgcgataggtcgtctcgaggcggcgggtcccaggatcccacgtggtctggacggagccacggcgcgcacgccgaccgctgcgcacgtcgaagatgtccgcgaagtcgctctcgatgccgagctcgaggtcgacgctgatcggcgagagcgaaaagttctcgatgagcaggtcgtcgtggatgcccggaccgatgacacggtcgaggcgaatgcggagatctccttcgtcgagccggtggttcaccagggtgagggttgggttcgtgaactcgaggcgagctgcgcgaggtccgagcgctgcgccctcgacgaggatgagcggtgcggtgccgagcgtcagactccaaccggagagcaggcgggtgtccttgacgaagtagccgcgctcgcgttcacgatcgatggatccattgcgtgcggtgaccaggatctcgtcgtcgtcggcgagcgtgatggtttccgagccgagccagtcgacggtgggaaggagctctctcacgcgccggctcccgtgacgcgcacaggtgcgatcgggcgctcggcgatgatcgatcgatagagccggaggtgggcctgcaccattgcctcggccgagaagtgttcggcgacccagcgtcgaacggccctgcgatccaaggtggcggcgcgctggagccggtccgcaaggtcctcgacgcccgtcgccagaaagccggcgacgccgtccgcgacgacttccggagccgacccgatggccgttgcgacgaccggcgttcccgcagccatcgcctcgatcatgaccatgccgaacggctcgggccaggcgatcggattgaccagcgcgatcgctccgcccagcaacgccagcttgtcgctgccgccgacctcgccgacgtattcgacgtcagcaccgaggagcggtcgaacggcggtctcgaagtaggcatgctcatcgggttcgcgcatcttggctgcgatgcgcagggggatcccggcacgtcgtgcgatctcgactgctgcgacgacgcccttgtcgggactcatgcgaccgaggaacagggcgtagccaccgtcaccgcgtcccatcggtaccgcatcgatctcgatgccgtggtggatgacggcggcgatccgcacgccgagggcgagttgggcctgtgcatgggaaatggcgatgacggggacggtggcgctcacgtgccggtagtaggtcgccatggcaccgaggaacggtgcgtggttggtggtgacgatgggagcgctcgcaaggcgcggcccgacgaggggaccgacgagcgtgtggtcgtggatgatgtcgacctcgcccagctgggagtaggcctcgaggacgtggaccgactcgttgatcggcgttgcctggtcggtcccgagcgcccatggcgtggcgcgtaccgtcggcacggggcaggtggcatccccggtcgtcgcaagcacgacgtcgtgtcccgctgcgtggaggccgcgcgcgagcacgtcgagcaccgcctcggtgccgccgtagcgcggtggtgggaccggcacccaacatggggcgacgatcgcgatgcgaaggcgtctcgggacgtcgtcaggtgccggccgagcggcgagggcgctcgcgtcgtcgggcgacacggtcacgcggtgcccggcgtgactctcaggagtgatccccacgggactcgcgttcctcctcggttcatgctgcacgcacgtggaccgacggacgactacgtcggcacagcgctgtgaccgactctgtggtgtccagcctactggcgcgcggaagctgacacgagcgacggcgtgctggtcgagcggccgagggcggtgcggacgcggctgccgaggtcgccggcgcgccgcaggctcgtctcgaccgagggtgggagcagattggccatgaccgagacgaccggggccatagtggcccggttgcgcatcgcgagccagacgcccggtgccatgacgcgagggtcgctgatgaggcggacgaaccgtcggccgagggcgtagtaggtgccgtagtggccaccgagcagcgccgggtagcgcgtgagtggatggtcactgtcggtgcggcgagcctcggcgatgagggttgcggcgaggcgcccggtctcgagagcgtaggagatgccttcgccgttgaaggggttgatcgtcgcggcagtatcaccgacgaggaggtagttcgacccctggactggcttgatcgtggtgcccatcgggagcttgccgccgacgggcttggcaaggagcgggtgctcgacgtcgagcccccaacgatcgcgcacgcgatcgacgaagcgtgcgagctccgtcgtggtgttgacgtggcgccacgcaccttggttggtgagcagtccgaagccgatgttgacgctgccatctcccatggggaacacccacccatagccgggcatcacgcgaccgctctcgtcgcgcacgtcgagcgctgactcgatccacggttcgtcggatcgcgacgaggggagataggtgcggatcgcgagcccgaggggctggctggtgtcgcggatcgcgccgagcgaccgagcgaggcgcgcattggacccttcggcgagcaccacccagcgcgcacgcacgcggacgacggcgccatcgttcgtccgacgtgcgaggaccgcgctgatgccgttgccacgtcgttcgagttcgatgccctcgtggccgaagagcacggtcgcgccccgatcggccgcggcgccgacgacaagcgcatcgagctcgcgccgacgcgcgacgaagccgtaggacggcaggagcgggtggttcggccacgggatgtcgagcgttcggccgaacgcgacggctcggagcccctcgtatcgatggaagcgggcttcgagctccgctccgaggcccagcgcttcgagctgcacgaccgagcgaggggtcaggccgtcgccacagaccttgtcgcgggggaactgcttgcgctcgaggacgacgacgtcgatgccgcgcatcgcgagccaatgggcacagctcgcaccggaaggtccgccgccgacgacgacgacggtggtggagacctcttcgtcaactgcctggaccacgatctcaccctagtggcggcccaacgggttctccggggtgacgccgatcaccctgacgctcccccacgtgcgcatgggtcggggccgtatactgcccacgaagaggccggatttgcagcatgcgtcctccgtgtccatcatggaggcgcagctgcgtgagcgatatcgagttggagcgaggtgcgatggcccagtacctgccgatcgggatcttgctgatcatcggcgtgctctttggagcaggatcgtttctcgcctccgggttgcttggaccacggcgtccgcaccgagccaaggcagcgccgtacgagtgcgggatcgtgccccgtgtcgaccctcccgaacgcttcccggtgcggttctacctggttgcgatgatcttcatcatcttcgacatcgagatcgtcttcctctatccgtatgcggcagcagcgggctcgctcggcaccttcggcgtgatcgaggttgccggcttcgcggtcgtggtgttcgtcgcctttgcctacctggtctccaacggcgcgctcgactgggtgcctcggcgtcgggtgcgggcccatccgccagaagtccagcgatcgctggaggcaccggctcgcgcggggagtcggtgagatggcgctcgacgacctgagctacaacttcctgacggcgcgcctcgaggacctcgtcaactgggctcgcaagtcgagcgtgtggccggccaccttcgggcttgcctgctgcgctatcgagatgatggcggcaggggctgccgacttcgacctggctcgattcggaatggaggtctttcgtgcctcgccgcgccaggcagacctcatgatcgtcgcggggagggtgtcgcagaagatggccccagtgctccgccaggtctatgaccagatgcccgagccgaaatgggtgatctccatgggcgtgtgtgcctcctcgggtgggatgttcaacaactacgcgatcgtccagggcgtcgatgagatcgtccccgtggatgtctacgcgccgggttgtccgcctggccccgagacgctgatccgtgcgatcttgaccctgcacgagaagatccgccacacccccatcctgcggcggcgtggccaggacgagcccgtcgcggagttgctcgcccggccccgtttcggcacgggggaggcgttcgcgtgagcggcgtcgtccggcacgtcgcacgtgaggactggctcgagacggcggaaggcttgcgtgcggacgggttcgtgatgctcgccgatctgacgtgcgtcgactatctcgagggggttcgagaggacctccccgaggaggtcgtgcgggagcgtttcgaagtcgtcgccgtgctgcggcggatggacccacctgccatggtgcgccttcgggcacaggttcccgacgacgatcccgtgatcgactcgctgtggtcggtctatcccggggtcgaggcgttcgagcgcgaggtcttcgacttgttcgggatccactttcgcgggcatcccgacctgagtcggatcctgatgcccgaggactgggaaggtcatcccctgcgcaaggactatggcgtcggccgcgtggcggtgcagttcaaggaggtgcgtcgacaccgatgacgtcgtccatctacaccgtggtgcggcccgacgaggaggcagaggccctcggcttggtcgcggagacgtacgaaggctcccaggagctgacccttcgcggtgccacgtcggccgcggagctcgagcgagagcagggcgcggtgctccgggttcccgagagcgaggtcgatctcgaggggtttcgaagccgacgaccggatgatcatcaacatgggcccccagcacccgtcgacccatggggtgctgcgcatcatgctcgagatcgagggcgagacggtgctgcgttcgaagcctgtcatcggctatctccacaccgggatggagaagacggcagagacgctgacctacctccagggcacgaccaacgtgacccgtatggactatctgtcaccgctcaacaacgagctggtgtactgcctcgcggtggaggacctgctcggtctcgagctgccggagcgggcgatctggatccgcatgctaatgtccgagctcaatcgcatcgcctcgcacgtcatgtggatggcgaccaacggcatggacctcgggtcgacgtcgatgatgatcttcgggttccgtgaccgcgagatggtgctcgccttcttcgagaaggtgaccggcctgcggatgaacaacaactacatgcgacccggtggggtcgcggccgaccttcccgacgggtgggaagacgacgtctcggcgatcgttgacaccatcgagcggcgcgtggaggagtaccacgagctgttgaccggtcagccgatctttcgcaagcgcgtggtcggggtcgggatcatcaagcccgaggaggcgatcgcgctctcggctaccggtccgatcctgcgctcgactggagtcgcgtgggatctgcgtcggtcgatgccgtatctcgcctacgaccaggtggacttcgacgtggtcgtcggcacggtgggcgacacctgggatcgctacatggtgcgcatcaacgagatcttgcagtcgatccggatcgtgcgccaagtcgtcgagcgcatgccatcgggaccgtatcgagcgcaagatccgaaggtcacgccgccgccgcgtgcgcgtatcgatgagtcgatggaggcgttgatccaccacttcaagctctacacggagggcattcgggtccccgcaggcgagacgtacgcggcgatcgagtctcctcgtggagagatcggttgctatctcgtctcggacgggtcggcgcgtccctatcggatgcacatccgagggccgtcgttcgcgaacctccagagtcttccggtcatgctgcgtggcgcactgatcgccgacgcgatcgcgatcacgagttctgtcgacccggtcatgggggaggtagaccgctaagtgggacggttcgagggcgagttcgcggcacgtgccgaggaactcgtcgggttgtatcctgagcgtcgctccgcggtgctgccgctgtgtcatctggcgcaagagcaggacggttggttgacgcccgaggcgattcgtcacatcgccgagctggtcgggcagaccccggccgaagtgcaaggtgcggcgtcgttctacgacatgttgcacctcgagccggtcggtcgttacgtggtcgggatctgcaccaacatcgcgtgtctgctgcgcgatggggaccgcctgctcgaggccgccgaggagctgctcggcgtgggcgtgggcggcacaacacccgacgggctgatcacgctcgaagaggtcgagtgcgtcgcgcactgcgacaaggcgccggccgtgcaggtgaactaccgctacttcggtccggtgacgccgacgagcttcgaggagctcgtcgggcagctgcgccgtggtgaactcgatggggaggtgcccccgcacggggtcctctcgcgagtgcgccgtgcggccccgccgccgatcccactggatgagatcgacgccgagcgggcccgccaagacgcggagcgcgccgaacgcgctcggcaggcggagagcggatcatgagcgcgccgtcgatcgtgggcgcgaggctcggctacgaggactcgtacaccctcgagcgctttctggcaaccgacggcgacgccgggttgcgcagggcgctgctcgagctgactccggagcaggtgcacgccgaggtcctcgaggccaacctgctcggccgagggggcgctggattcgaagcgggccgcaagtggtccatgctgcgaaaggccccgcgtcgctacctcgtggtcaacggtgatgaatccgagccggcaaccttcaaggatcacctgctggtcgagcgtgatccacaccagctcgtcgagggggcgaccatcgccgcctatgccatcggggcctcggtcgccttcatctatctccgaggggagttcgcactcggtctcgagcgggttcagcaggccatcaacgatgcctacgcacgcggagcgctcgggcgcaacatcttcgggtcggggttctcgctcgacattgtgctccagcctggtgcgggcgcctacatctgcggcgaggagacggcgctcctcgagtcgctcgagggcaagcgaggattcccgcgcatcaagccgccgtacttcccggcggtgatcgggctctacggagcgccgaccatcgtgaacaacgtcgagacggtgtcgaacctcccgtggatcgtgcggcacggaggagccgccttccgcgccctcggtgcgggccgctcgacggggaccaggatctttgcgttgtcgggaagcgtgcgccgtccgggtgccttcgaggtcgagatgacgagcgtcacgtttcgagaactcatctacggtgacgcctacggacagggtctcgagccggatcgcgagcttcgagccttcatccctggtggggtgtcgtcgccatggctcttccccgaacacctggacctgccgctcggtcaggacgaggtggccaaggccggctcgatgctcgggtcggggtcgatcatcgtcatggacgacggcgattgcccggtgagggcggcgtggcgaatcgcacgcttcttcgcacgcgagtcctgcggtcagtgcactccctgtcgcgagggtggcacctggatcgagcaggtgctgcgtcgcctcgagctgggctacggacgcgaggaagatctcgacctgctgctggatgcgtgcgacaacatctcccctggcgttacctggccgccggcccagacgaccatctgcgtgctcggcccctccatccctccgtccgtggtcgcggcgatccgtcggttccgcgacgtcttcttgacgcatatcaaggaggagcgctgcccctatgactgagcaggccagcaccgtcaccataaccctcgacgggaagtccgtcaccgttccagctggcgtcaagctcatcgaggcactcgaggccgtcggtacctacgtgccgcggttctgctaccaccctcggatgcgtcccgtgggcgtgtgccggatgtgtctcgtcgaggtgtcgggccctcgcgggttctcgctgcaacccagctgcttcatcgacgtcgccgaccagatggaggtgcgcaccacgagcgagccggtgcgcaaggcccagcatggcgtcctcgagtttctgctcctcaaccatccactggactgcccggtctgcgacaaaggtggcgagtgccccctccaggaccaggcctttgcgcatggttcgggtgagactcgtttcatcgaggagaagcgccactatcccaaaccgataccggtgtcgccgctcatcctcctcgaccgtgaacgatgcatccagtgcgatcgctgcacccgctttgccgacgaggtggccggtgacgcgaggttggatttcgccggacggggcaacggattgcgcgtcgcgacgttcgagggcgagggcttcgagtcggtgtttgccggcaacgtcgtgcagatctgtccggtcggggcgctcacggccacgccatatcggttcaaggctcgtccgtgggacctcgccgaggcagcctcgacgtgcacgtcctgctcgatggggtgccaggtcgtgctgcagtcgtcacagaacgagttgacccgggtcctcggggtggacgcggaggcgatcaaccagggttggctctgtgatcgtggtcgcttccaggttgcggcggtgaacaatcgcgaggagcgtctgcttgctccgcgcatcggggccgatcgcgcgagttgggctgcagcgctcgatgcggtcgcaagcgcgatccaagaggccgtcagccggcagggcccggccgccgtcggcgtgatcggtggcgatcgactcagcctcgaaggccagttcgcctgggctcgcctggcccgcagttcgatcgccacgccgcgtgtggacggggtcgccggttcgttggtcgaccccaatctgtggctggatcgcctggccaccgtggacgcgatcgacgacgccgaggtcgtggtgaccattggtgtcgatcttcgcgaagagcttccggttgcctggctccgccttcgacagcgggcgctcgccggtggtgcggtcgtcgacgtggcccctggaccgacgagtcagggcgagatcgccacggcgcggatcgtcctggatcctcgtgatcccgaggcggccatccgggaggttgcacaggtcgtcggcgatcgccgtgcgctggtcatcgtcgggcagtccaatccgctgctcgactcgcggacgcgcgtggggctgtatgccgcactcctaggccggctccccgcgtcgacggtgctgccggtccatcggtccggcaacgcggccggggcactcgtggcggggctgtcgcctggctggtggcctggtctcgtggccgggccggtcgctgggtgggctgagagcgcgggccacgacgtcaccgatatcctccaggcggcgcgtgtcggcgctctgggcgtgctcatcgtgctcgaccgagacctcggcgaactcggcctctcggacgcagagatcgagacgctcgctcgcagcgtgaccctcgtcgtggcctcgagcttcgagacggcgacgacgaggcgcgctgcggtcgccctcccgatcgccgcctggggcgaggagcgaggcgtgaccatctcggccgagctgcgccttggtcgcctcgcggctcaagtggagccgatggaacaggcgtggcccgcctggtcggtggcggaggagctgcgcgcacggctcgaggtgggtccggtcgccgttgccgtcggtgaggtgttgtcggcgctgtgccatgtcggtggcgtggtgacgactcacgacgtgcatctgctcggccagcgcgccgacggtccgctgttgccgtcggcagagcgtggcgacggatcgccgccgcggctgctcgaccccatggggacgcccggcatcgcctcggtgcgtcgtcaggccccagacgtccggttgggcaacgccctcgacccggcgctcccggcaccctcagccggggtgcggcgcgcgtcgctcgccaccgctgccgccctttcgaacgacctggttggcgcgacaggctcggggttcgtgccttggatcgcgagtgcgctctatggggacacccccgacgtcgtcgcaaacccgttcctcgctccgctccggcgccaggcgcgcgcgcggctggcgccatcggatgcgtcgcgtctcgggctcgagctcgacggtgcgacggtgcagatcggcggccgcgtgagcctaccggtcgcactcgacgacgacgtcgccgaaggggtggtcgtgatcgagggcatgccgagcggttggggtgagctcgctggccccggttggagtctcgtagaggtggaggcgctgcatgggagctgacccgctcctcgtcggccacatcgggtggatcgacgtcctcatcgtcgtcatcaaggtcgtcgtggccttcgcggccatgatggtgtcggtcttgctcgcgatctgggtcgagcgcaaggtgatctccgacatgcagaaccggataggtccgaatcgtgcgggaccgttcggcctgctgcagagtctcgccgatggcatcaagctcttcttcaaggaggatctgatccccgagcggtcggatcgtttcatcttcaagcttgcgccgtacctgtcgttggtgccggccttcttgacgttcacgatcgtgccgatcggtggcgtggtcgatctgttcggtcaccggaccgaactccaggtcgccgatccgccgatcgggatcttgctccttctcgcgatgtcgtcgatctcggtctacggcgtgatgctcgcgggttggtcgtccggctcgaagtatcccctgatcggttcggtgcgtgcctcggcgcagatgatctcgtacgaggcggcgatggggctctccatcgccgcggtggtcctcgtgacgggctcgctctccacgcgcgacatggtgacgggccagctcggcacctacctcggcttcatcccgcactggaatctgatacggctcggggtgatcccgttcgtcatcttcatcgtggcgatcactgcggaggtgaaccggccaccgttcgacctcgtcgaggccgaacaggagctcgtgggtggattccacaccgagtactcctccatccgcttcgcgctcttctacttggccgagtacttgaacaccatcaccatgagtgccatcatggtgaccctgttcttcggaggcccagacggccccgatccgcacgtgttgcactggctctggccgatcgtgtggttcctcgtcaaaacgtcgatcttcttcgtgatctacgtgtggttccgtgccgcgctcccgcgcctccgctacgaccagctgatggatcttgggtggaaggtcctgatccccgtctcactgctgtggctgctcgtcgtggcgggtatgcgggcctcgcgggtgctcggtttcgtgctgctcgtgctcgggctgatcgctgcgggagtcttgctccgcgcgatcgatgtcggccgacgccgccgtggccagagcgcgcccgtgcttcccgatctcatggacgcatcgatgctggggccgagcccgatcccggccatggtcgaggaagggtcgaccacagcggaggaaggggatgacgatgggcgtgcttgacgcactcgggggcttccgcctcaccctccgacaagtgttcgagccgcgggtcaccttgcagtacccagaggagaagcgcccgaagccgccgcggttccacggacggcacgtgttgaaccggtatccggacgggatggagaagtgcatcgggtgcgagctctgtgcgggcgcctgcccggcgcgctgcatctacgtgcgcggcgccaacaacgacccggagaggccgacctcgccaggggagcgcttcggcttcgtctacgagatcaactacctgcgctgcatccactgcgacctgtgcgtcgaggcctgtccgaccgaggcgatcacagagtcgaagatgttcgagttcgccttcaccaaccgtgaggacgcgatctacaccaaggcggagctcgtcgtcgacgacgagggtcatccaaggcgccagccatgggaggactggcgcgacgaggatgaacgctggacttcggcctgggttcgggcgacggctccgggaggcgatccggccttcgagggcgtcgtcggttggtcgccagaactcggtgtcgggacgcgaccgccggagcgtggccagtccgaccttccggaagacgaggcgacgcccgtgttctcgttgcgagcgattctggcgtcgcggatcttccgtcaacacggggggagggcttggtgatcctcggtgtcgtcggggtggtgaacctcgttgtgttcgtggtcgcggtggccgtggtggccatcggtggcgttgggctggtgagcgcacgccagcccgtgcacgcggccttgttcctcgtgttgacgctcttcggcgttgcaatcctgttcattcaggagggagcgcagttcctcgcggccgtgcaggtggtcgtctatgccggcgcggtcgtcgtgctgtttctcttcgtcatcatgctgctcggtgtcgaccgtgtcgaggtgagcagcatcgtcggcagcggttggcgggtctgggcagccggcatcggcgtcgcagccgtcctcgtcgagctgggtctgctcgccatcggccatgaggtcaccggcgcctccagcctggcgggcaagctctcggcgggatcgaacctcggtgtcctcgctcggagtgtctttacgacctacgtgctgccctttgaactcacgagcgtgctgctcgtgatcgcggtgatcggcgccgtggtgctggcgcgaaggctccgccagcgatcggacgcgacgacggtgagccgaagcgaggaggtgcacccgtgattccggtgagctggtacctcatcgtcggggcgctcctgttcgggctcggggccttcggcgtcttgattcgacgcaacgtcctcgtgatgttcatgtcgatcgagctcatgttgaacgccgtcaacctcacgttcgtgtcgtatgccagggcactcaacgacgtcggcggcgaagtcgcggtgttcttcgtcctggtcgtcgccgcagccgaggtggtcgtcggcctcggcatcatcgtggcattgttccggcgacgtgcctcggtcaccatcgacgacatcgcgcggttgaagggttaggtcggcatggatctcatcaccgctgtcatcgggtttccgctccttggcttcctcgtgctccttgcgttcggcaagcgcatcggcgagccgcgcgctggttgggtcggtaccatcgcgaccacgctgtcgttcgtcgccgcgctcgcgctctggggcgtcgtgctggcacgaccggccgacgagcgggtcgcggtcgtccgcctgttcacgtggtttcgcgctggccccttggtggcgcacatctccttccgcgtcgatgaactcaccgtgttcatggtgctcttcgtgaccggtgtctcgtcactgatccacctctactcgatcggctacatgcatcgagaccccaggttccaccagttcttcgtctatctgaacctgttcgtcttctccatgaccgtgctggtgagctcgaacaacttgccactgaccttcctcgggtgggagggcgtcggcgcgtgctcctactggttgatcagcttctggttcgagcgcccctcggctgcgagcgccggcaagaaggcgttcatcgtcaatcggatcggcgatgcaggcttcatcctcggcacggcgctcatcgtggaccatctgcactcggtgagctactcggtgatcctgcccgaagcccatcggctctcgagcggcacgctcgaggcggtcgcgctgctgttcttcctggcagcggtcggcaagtctgcccagctgccgctgttcgtgtggctactggacgccatggagggcccgacaccggtgtcggcactgatccatgcggcgaccatggtgaccgcaggtgtcttcttgatggcgcgtctgtcggcgttcgtgactcccgcccatgacgccgccacggtcatcgcgtggatcggcgcgatcacggccttcgtcgcggcgatggccgcgacctcgcagcacgacatcaagaagatcgtcgcgtactcgaccgtctcgcagctcggctacatgatgctcggcatcgggaccggtgcctacgtcgcggcgctgtttctgatggtgacgcacgcgttctacaaggcgttgatcttccttgcctccggttcggtcatccactcgctcgatggcgagcaggacgtgcgtcgtatgggtgcgctccgtcgcttcatgccgatcacggccgtcaccatgatcctcgcgtggctctcgatcgcgggggtacctccgttctccggcttcttctcgaaggggtcggtcctcgaggcagcctttgcccaccagccggtgctgtgggcgatcggtgtcgtgaccgccgtgctcaccgcgtactacatgggtcgactcgtctacgtcgtgttctacaacgagccgcgctaccaggaggtcctcggcgagcggagcccacacgagtcgccccgagtcatgacggtgccactggtggtcctggcggtggccgcagtgctcggagggctcatcaacctgcccttcgggagcttggacttcctcgatcgattcctggcgccggtcttcggcccttcgctcgttgccgtgcatctgtcgggcgtcgctcgggcggcgctgcttgcgaccgatgcggtcgccggcctcctcggcgtcgggttggcgtggcagctctggggccatcggtggcgtcggcccgagctcgagccgatggtgctccagcgcggttggtacgtggatgcaacctacgaccgcgtcatcgcgcgtccgatgaccgagctcgcgctcgaggcggacgaggtcgtcgatccgaaggtgatcgatggcgcggtgatgagcgtcgcgtgggcagctcggcgaatcggtggcctgggccgacgggtacagaccgggctcgtgcgcagctacctgttgctgatggtggccgggatcgtcgtggtgatgggctacgtgctcgcagtggcgacacgttagagaggcggaagaggcatgacgctgctcgactggttggtcgctgtccccgtgatcggggcgctgatcgtaccgatgatggcgttgccgcgggagcaggcctggttggtccgtgccttcgggatcgccatgtcgatcgtggagctcggcatcgccgtcctgctcgcggtgcggttccacatcggtgctccaggcttccaagacacccaggacctgcgctggatgggtgcgctcggcgtgcactggtatctcggcgctgacggcatctcgttggtgctcgtcatcatgacggcggtgctcttcgtcatcgcgatggcggcgatcaagggcgtcaccgacgttcgggcctacgtcgggtggatgctcctgctcgaggcggcgtgcatgggctcgttcgtctcgctcgacctcctgctcttcttcgtgttcttcgaactgtcgttggtaccggcctacttcctcatcgcggacttcggcttcctcgggtcggggcgtgcggccatcaagttcttcgtctacacgttcgcggggagcgcgctgctgctcgtcgggatcattgcgctcgtcgtcatccatgaccaccagacggggaacctgacgttcgcgttgcccgccctcgagcacacgcggctggctgcgagcacgtcgctgctcctcttcttggccttcacggcagcctttgccgtgaagaccccgatctttccgttccatacctggtcaccggacacctacgcgaaggctccgatccctgccgtggtgatcgtcgctggcgtcatggccaagctcggcagctacggcatcgtgcgtttcgacctcgggttgttccccggcacgtcgagacagctcgcgtggctcatgctcaccctggcggtcgcgggcatcctctggggcgcgatcgtggcggcgggcgagcgacacctgggtcggctggtggggtactcgtcgctctcgcacatggggttcatcgtcctcgggatctttgcgttctcgaccgagggtctcgcaggttcggtcctgcagatggtcaaccacgggatctacaccgcggcgatgttcctcctactcggcatgatctacgaccgctccggcacgctcgatgcctcgcggctcggcggactccagcggcacgcgccggtgctcgcgggagccttcaccgtggtggtcatggcgcaagccggcttgcctggcctgaacggcttcgtcggcgagttcctcatcttggtcggtacgttcgtgacccatcgctggtgggcggtggtggcggtggccggcgtcgtcggttcggcggcctatctcctctgggcctaccagcgggtcttccaccgcgcaccgtccgaggaccgggtcgtacacgacctgcagtggcgcgaggtcgccctcatcgcgccgctcctggcgatcatcgtgttcctcggggtctacccgaggccggtgctgtcggccattgacccagcgacctcggcgatcgtggcacgcgcgaatcgggcgccactgccggtggcatcctccacgccgaccgctgtggtttcgacgctcaccccgggggtgcggccatgaacgtcctgttggcgagcatcgtgtcccagacgccgatcgtgctgcctcgcatcagctacctcaccatcggtccagcgctcgtgctctttggcggagctctcgtggtcctgctggtgtcggcgctcctggtgcgcgcacggcggcccgagctctatcgttggctggcgctcgtcgcggtcgcgggcgagatcgtggtggccacggcaggcctgctccacgtcgacgcacacggcgcctccctcgcggtggcgggtgcgttggcctccgatggcttcgggttcgtcgtcgccatcatcgtcggtgcagcgaccctggtcgcgctgctcatcgggccgagtttcgtgcagcgcgagcacggcggcccggagtacgctgcactcagcctgatcgcggcgagcggtgccgtggtgatgggacaggcgaacgatctgctcgtcgtcttcctcgggctcgagatcctctcgatctcgctgtacgttctcgtcggcttccgtgtgggtgacggggtggcgcgcgaggcggcgctcaagtacttcctcatgggcggctttgcctccgcggtgctgctctacggcatcgccttgatctatggtgcgacgggatcgacgaatctcgtccgcatcgaagggttcttggccgccgaccacctgatccacaacggcgtgctgctggggggcatcgcactcgtgctcgtcgggctgggcttcaaggtggccgctgcgccgttccacgcctggagccctgacgtctatcaaggggcgccgacctcggtgaccgggttcatggcagcactggccaagatcggcgcgttcgccgcgttggtgcgcgtgttcgatggcgcgctggcctcccaggcctcgctctggggcccactcgtggcggcgttggcagtggcctcactggcggtcggcgccttcttcgccctgcgccagcgcgacgtcaagcggatgttggcgtactcgtcgatcaaccatgccggcttcatcctcctcggtgtctatgccgcgagcgcggtggggattcgcgcggcgctcctctacgtgggcacctatggcatcctcgtcgtcgggagcttcggcgcgctctcgttggcgcagtgggttcgaggcctcgacgaggggctgtgctcgctcgatgatctccgtggccttgcgcgtgagcatcctgcgatcgcggtgacgctcgccatcacgctcgtggcgcaagccggagcgcccttcacgaccggcttcttggcgaagttcgccgtcgtggaggcggtgatcgctgccggggagacctggatcgcgatcgtcgccatgttgagtgccgcggtcgctgcagcgttctacctgcgtgtcgtcctcgccctctacggcagggacagggagtcgagcgtcgtaccggcgatcgccggggcgcaggtcgaggacgggcgatctgccgtgacgcagcgcccgagcccgagcgagcgcgtcgccgtggcgacggcctggggcggtgtggtgctctcggtgggcgccaccatcgtgcttggcgtggtgccgaccctcgtcctcagcctcgtcgggagagcacacatcctgtgagactcagtcggtgaggttcagtcgggttggggccagcgtcggtcctccatcacgctgttcgcaccatcgacgacgatgaccgaacccgagacgtagctcgctgctggtaggcagaggaaggcgacgacgtcggcaacctctgtcggaaggccggatcgcccgagcgggctggcgagaccggcagctcgttcgtcgggcgtctgtgaccccgtggcgatccagcctggcgcgacgacgttgatggtggctggggcgaggtcgagcgcgagtgagcgcgcgagaccgacgaggccggccttggcggcagcgtacagggcgctgtgcacggtggcgttgacgtggccagtcgtagagccgacgaggaccacccgtccgcgcgcgccgtgggtgagcagtgtcggtgcgaaggctcggacggtgagcacggcgctgaggaggttgcgatcgagttcgtgcgtgatggtgtcctctggcaggctccacagggcgccttggcgctccgggtccccgacggcggtcatgccggcgttggcgacgacgatcgcgggaggaccgaggcgcgcggtgatggagtgggcagcctctgcgacctcggccgcgacggtgaggtcggcggtggatgcgaccgcgtcgatccctcgttcgatgagttcgtcgcgtcgagtgaagatcctcggtgagcgactgatcaggccgaggcgagcaccgagctcgccgagcgtggtggcgatcgcaaacccgatgcccgttggagacccggccccggtcacgaccgcgaccgatccgtcgagtcgccagcgctcatgcatgggggtccgccaggaagcgtccgacgagcggcaggtcccagagtgactcggcgcgtgctgcggcgatcgcgatcgcggcgaggtgctcgtaggcgtcgacgacgaggtagcggggttcccagcggggctcgaacttcgcgttgaagcgccagagcgactcgatctgcatgctcgacgagagccgatcgagcacccagcgctcgactcgggcgctcaggagttcgccgccgcgttcaccggcgagcacgccccgcattgcagcgaagttgaggctgatcgccttgacgtggcgggcttggagctgcgtcatggtctcgacgatgagcaggtcgaacatgccgttcggatggttgccgaggtcgcgacgcatcaggtcgagcgagtagccctcgatgctcggcgcggggacccactgcacgaacccgacgatccggccgtcgggtcctgtgcacacgctcatgaggacgtcggtgtcgcgggggtcgaagacgcgccccagcgtcatcgagaacccgcgttctcggccgccgcggcgtgactcgctcatgacgcgaagcacgtcgcgccgctcctcttcggtgagctcgagcggagcgacgacccgcacgcggtagccgtaacggcgcatccgattgactgcctggcgcagactcttgtggcgcttgccggcaaggtcgagttgaccgagcgtgacgatcgcctcgtcaccgaggtagaggggatgcaagccgacctcgcggtaccactcgctccaggtctcgctcgccccgaggacgcacagtgccttcccggcgcgagacgtggcctcgaagagctcgaggaaggcgaggcgtgccgaggcggtcgctccgatggggtctggggagacgatgacgacggagccgaactcgccgtaggccacgaggccgccatgacgcacgaggtgctccttgtcggagcgcagcgcgaagtagtccagtgtgctctgtgggtgggctcgcaggatctgtgcgggattgcggggcgctctgagggaggcgagctgcgcgctgaggcgatcgcgcacgggtgccacgaggcgccacacgatgaggacgaggagtgcgacgccgaccagcgtgagtgcgtcttgcaactcaccgaccgcgaatggcggcggtgcttgaaccggaagaccgagcacggtgccgatgatccctccgagggccgcgaggggacggagaggtgcatggtgtacgagggcatcgccgatcgcgacgacttcggcgacgaggacgaccaagacgccggcgcccacgaccgagagtgccctccacactcgtcggcccctgggggcgggttgtcgaaaggcgcttcgccagatggccagcgcgacgagcgcgaggctgaggaggccggtcgtgatgaggtcgctgcggcggaccaggttggaggcgaccgctgctgcgaggaccaccatggcgatccgccacgcccgtcgttgaccggctcggagcccttgggcgatgccgagcagcagcgtgccggcggccgccgagatcgcgtcggcgtagcgagggatcggtccgagggtagggaagagtgtggtgacgatcgacaggtgtcgtgccaatgggggtgcgaacgccgagatcacctccacgagaccggcgacgctgaccgcaagtcccccgacacggcgcaccgtgagcgaggtctcggaggcgagcctgggcgcggggggccacgaaccgccgtcaggggcgcccgcgagcgtcacctgatgatcgaggagggcctgatcgggccagagcaggcgcgagagcgcgttcggcgggcgaacgcgacggcgcgtccggcgcaggtaggcgcgcacgaccgcgccgacctcgagctcgatccacgtcgtgtggtacatgggctcgtagcgggtggggagcagacctctgccggcaacgggcgtgagcacggccgtggtcggtcctggcgaggcgaggaaggcgtcgtcgtcgtgttggagttcggcgagctcggcctgggcggcgatgagcgaggtgtgcggtgggaggctctcgaacagatcacgcgcggcttggttggtggccagtgcgctcaccatcgactccatcggctcctcgatgaggtgggtcaccgaccgcgaagcgaggacgctggcaaggagcacgatgagggcatcgaggacgaggaaactcgcgacgagggcgatgtggcgcgatgcctggtggtggaggtgtgcgacgagcggtgcggccctgagcacgaacggcagccgggccagctcgagcaggacgagcgggacgaagacccacaacgcgagcatgcgtgcacgccgtgcgaacgaacgcgccacgacgaagtgggtcacggaggcggccggatcgagccaggcagcgccacggaagcctgggagtcgttcgagcgcttcgagcgtgcgccgtcgtgcgagatccgtgccgaccggcttcatgcggacgcgatggccgcggggccctggcccgaggaggatcagctcggcggtgtgttctacctcggcccccattgccagaggctcgtcgcgcacggaggtgatgcgtacggtgcgtgcgcgggcgctcgtgagcaggtcgacgacgtcgtggtggtgcccgagtgcggagcgtgggtcgagactcggctcgggtgcggtgacgcgcccagcgaggacgagcaggtcatcgggctcgagctccccgatgatgcgtgcgagctcgtcacgatcggggcctgggcgccgatcgtggaggtcgagattgccgaggacgacgacgcgcgcgccgggcgcgaggcgcacctcgaggggcgccgactccacctcagtctcggaagttcgtgaactgtaccgggaagtccgtgatgtgctcgcggaggtgggcgatcacgctctggaggtcgtcacgcttcttcgaggtgactcggacttgctcgccctgtatctgcgcctggacgcccttgatcccagcggccttgatcgcggccgtgacggctcgtgctcgatcttgattcaggcctgcgacgaggcggatcacctggcgctgcgtacctcgcgcggcctcttcgatcgggcctcgatcgagcgccttgagcgagacaccgcgcttgacgagccgctcctcgaggacggtcgcgagtgcccgcagccggtcgggggtctccgagttcagcgtgatggtgagctctcgatcgttgaggttgatcgacgagccggtgttcttgaagtcgaagcgagtcgtcacctcgcgcgacgcctgatcgaccgcattgcgcacctcttgcaggtcgatctccgagacgacgtcaaaggacggcatgtgctcagactactcttgtgaccgtccagggtcggtgcccgagcggccaaagggagcagactgtaaatctgccggcgtacgcctacgggggttcgaatccctcccggcccactggagtccagcgcgcctggttcgatggtgcgcggcgacgtcgtgtcgcttccgaccgctcacgaggcggctaagctggcgccagcgcgaccaacgtggaggaagctgctgtcgtgaagtcctcgctcactcgtcgggctcagctctcggctcctggtgcggtgcgtcaggcacggatcctcggggcgcggatctccgagttcgtcgactcagtggagccagtcgagaccggcttgctcggctccatcttggtcttcctcgggtcgctgcagccgaattcgccgttcacctcgaaggtcccggggtcatggtttctcggtgtctcgtcggtgccgcaccccggttcggtcctcgtcgaggtgctcgcgaaggcagcggtttacctcggcctgatcctgagcggtgtggcctgggtgcggttggtgaggcttgcccgcgccgggtcgctgccgcgcgcctggtgggtcatcttcgcgctgtgggtcgttcccctcatgatcgctggccccttgttctcacgagacgtctactcgtacgctgcccagggccagatggtcacccaagggatcagcccgtaccatggtggccccaatctgctcgggacgagccccttcctcgcgaccgtggacccgctctggggcaacgctccggcgccgtatgggccactgtttctcgcggtcgatgccggtctcgtgaccatcgccgggcattcaccgctcatctcggtggtgctgttgcggctcttggcgctggcatcggtcgcggtgtccggggtcgccgtcagccgtatcgcacgtcggctcggtgcgaacgaggcgctcgccctcgcgctgacggcgctcaatccggtctttctctacacgctggcctccgcgggccacaacgacgcgttcatggtcgcgctcatgctgctcggtattgaccagttcctcgctggccggcgcttcgtgggcatcgtgatcgtcgcgctcggggcggcggtgaagatcccggcgatcatcgccgtgggtttcctcggctatcactggagcagcgaacgtacgtcgatcggggagcgcattcgcacgacgatcgtcgcgctcgtgatcgcggcggcgctgttgtgggcactcggcgtcgtgaccgggctcggcatggggtggctcccggcactgagcacgccgggttccgtctacagcttcgaggatccgatcgtcgccgttggctacggcgtcggttggttggcgcacgccgtcgggctcggcatcggtccttcgggtgtgatcagcgtgttgcgcgatctcggcgacgccgtgttgctggcggtcgctgcgatcgtgttgctcggttcgcgtcgcgagaccctgctgcggggtctggggatcgtgctcctcgcgaccgtcgcgctcggtccggtgatctggccgtggtatctcacgtgggccatcgtcgtgctcgcgatcggtgcgggagagctgacctcgggctttctggtgctcgtcacggtctcggcgctgccgatcgatctgctcggcctaccgaccgtgctggcgtgggtcggctacatcggcctcggggtggtcgtgcgtcgacactggggccatgtgatgggcttctggagcgagaccctggatggcgccaaggctcgggtcgaggagctcgtcgggcggacgccgctggctcgtctgctcccgtggagctgacgagcctcgtcgacgcggcccaccgcctgagcgaacgcgacccgctgatggcgcgcttcctcgaggcctacggcgtaccggtcgtggggcgccggggcttcgatccggggcgtctcgaggcgccgggtgaggttggcctcttcgggttcgtcgtcgaggtcgtgacctatcagcagatcagcgccgctgcggcgaggcgcctcgtggctcggctggaggcgatgggggcgctcgatgccgatgtgatggtcgcgctgaccgatgccgaggtggccgcgaccgggttgtcgggatcgaagcggcggtggctccgagcgctcgcgcgcgacgtggtgacgggcaccatcgacctcgagggactccgggcactctcgccggacgaggcacatcgtgcgctacgcgcgatccgcgggatcggcccgtggagcgccgacatggtggcgatcttcgcgctcggtcacctggatgtgtggccgatcggcgaccttgcgttgcgccgggcgctcgcgcgacgtcatcccggtgccgaggatcggggcgtcgccgagcggctcgccgagccctgggcgccgtggcgctcggtcgctgcgctgtggtggtggcaggatgacgcgtgcggggccgcgtcggtactagagcagccgctgcatgaccgcgaggtcaatccagcgagagaacttgcggccgatctcgcgttggatgccgacgagctcgaaccccgctctcgcatgcaacgaccgtgagacgtggtgatcggccacgatatgggcgatgcaggcgtggaagccgaggtcggcggccgtgtcgacgagtgaggtgaggagccgtgtgccgatgccacgcccctgggccgtggggtcgaggtagatcgagtcctcgaccgtcgaggcgtagcctgcgcgcggtcggtagggcgagatcgaggcgaagccgaccacgtccccgttgagctcggcgaccaagcagacgtagatgccgaggtggtcgtcgacccagcgctcgtgttcgctgggtgtgcgcggctcgatgtcgagggtggcggtcgtggtcaggacggcatggttgtagatgcgacgagtcgcctcggcgtcacttggaacgagaggacgaaggatcagcgcatcgtcgggcacgggtctacggtagaggctgtccggccccgaggctcgctcgctatcatggttggaactcgcccccttagctcagtcggcagagcacagccatggtaaggctggtgtcgtcggttcgattccgacagggggctccgtggcggcgtagctcagttggttagagcacacggctcataatcgtggggtcgtcggttcgagtccgaccgccgctactacggaccgtccagcgctggtaggaggatcgatggcgaagaacgaacggcgggtgcaggtgacgctggcgtgcgaggagtgcaagcgtcgcaactacatcacgtcgaagaacaagcagaacgaccgcgaccggatcgagatgcgcaagtactgccggtgggatcgccgccacacgctccatcgcgagaccaggtaggtcccgcgctgactcgggttcgtgctcgggccgctgagctccgtccgggcctcgaagagtccctcgccaaggtccgtgcgcgggctggggacctacgcccgtcgttcgacgaggtcgtgcatcgcacccttgcgatgagcacccgtgtcgcgtcccgcatcgtcggcgatgccgaggcggtgtcggacgtgctccaggacgcgtacctgaacgtgtaccggtcgctcgagcgctttcgcggcgcctcgcgctacgagacgtgggtctaccggatcgtcgtcaacgcggccaggtcgcacctgcgtcggatgcgacggatgcgggcgcgcgagacggtgctggacgaagcggagatcgtcccggctcgttcgggcgaggttctcgaggccgccgatctcgtggcacagcacatcgacgtcgtggcgctccttgcccgactcggggaggccgatcgcgagttgctcacgttgcgctacctcgctggcctgagtgtggcgcaggtggccgccgagctcggtgcgagcgagaatgcgatcaaggtccgcctccaccgagcacggcgtcgcctgttggcccttctggctgccgatgaggagttcgacgacgagggagccgtcagagcctcggtggggtctcccaagcgcggggactggtaagctcgttcggcggcgaagggtagtagctcaattggtagagcaccggtctccaaaaccggcggttgggggttcgagtccctcctgccctgcacgtgctgggtggtggttcacgcggcgcgagacggatcgttgagggtggagctgtgaatcgggagacgaggcgcctcatggcgcgccagcagggcgccacgcgcgaccgccaggagctggctcgacggatggcgcagggctccggggagccacgcaagggccgtatccggcggtacctgcagggggtgcggacggagcttcgtgccgtcgagtggcccactcggcgccaactgcggagctatgcaaccgtggtcttcgtgaccctcgtcctcgtggtagcgctcatcttcttgctgaacgtcgtgttcgccaagggtgtgtcgctgctctacggctagcgcaggtcgcgatcccgtgacgatcgacaacgatggaggcaaggtgagccccgaggagatggaatcgacgcaccagcccgcgctggtccacgatgacgaccgagctgcggagagccgcgaggtcgcatccgctgacgcgccagctgtgcagagccgcgacgatggtgaggcgacggaccccaagggcagcggtgatgacgacgtgagcgctgccgaggattctccgtacgatcgtccgggcgagtggtacgtcgtccactgctactccggctacgagaaccgggttcgccagaacctcgcgacgaggatccgctcgctcggcctcgaggatcgcatcttcgaggtggagatcccgatggaggacgtcaccgagctcaagaacgggcgacgagtgaaggtgcagcgcaaggtctttcctgggtatgtgctcgtacgggccgagatggacgacgaggtctggtccgccatacgcaacacccccggcatcacctcgttcgtcggatcgggatcgaagccggtgccgctgagccgcaaggaagtcgaggcgatgttctcgttcgccacgccggaggagctgcgcccgcagccacaacggcgctcgacgcaagagttcgagatcggcgaaacggtgcgcgtcaaggagggcccgctcgcggacttcgtcggcgaggtggccgaggtgaacgccgatcagctcaagctgaaggtgctcttcaacatcttcggtcgagagacgccggtggaactcgacttcacgcaggtgtcgaaggcctaggcccggtcgagtggcaggggccgactggtagagttgtcggttcgtgtcccgtgtggggcgtcatgggttcgtgacgccaggtgcgcggcggttgtgacgaaacggtagtgacgaaggagtcgttcggtggcgagaaagcgcgtaaccgcggtggtgaagatcaacctgccggccggtgctgcgacgccagcgccgcctgtgggtacggcgctcggcccgcacgggatccagacgatggagttcgtcaagcagtacaacgctgccacggaggcccagcggggacaggtgatcccggtcgaggtgaccatctacgaggatcgctcgttcagcttcgtgctcaagacacccccgaccaccgagctgctcaagcaggctgccggcgtcgacaagggatcaccccagaatcgccgtcaaggtgtcggtacggtgacgcgtgctcaggtcgccgagatcgcgcaggtcaagatgccagacctgaacgcctacgacctcgaggccgcgatgcgccaggtcgagggcacagcgcgatccatggggatcgccgtggtcgagggctagcgagagaagaggacgaggtcgcgagatgaagcactcgaagacgtaccgtgagcaggcagcactgctcgatcgcaatcggctgtactcgcccgtcgaggcgctcgcgctcgtgcgccagctggctcgcgctcgtttcgacgagaccgtcgagctcgccgttcgcctcggcgtcgatccgcgcagggcggaccagatcgtcaggggcaccgtcgccctgccccacggcactgggcgtcgcgtccgcgtcgccgtgttcgcggcgggcgaggccgcccaggaggcgcgtgaggccggagccgacatcgtcggcgccgacgatctcgtcgagcgggttcaaggcggcgcgttggacttcgacgtggccatcgcgacgccggatctcatgggacaggtcggccgtctcggccggatcctcggtccacggggtctgatgccgaacccgaggaccggaaccgtgacccacgacgtggggcgcgcggttcgcgagttcaaggcgggtcgcgtggagttccgcaccgaccgcgtgggcaacgtgcacgtcccgatcggcaaggtgagcttctccaccgtcgcgctgctcgagaacttccgagcggtgatcgacgagctccagcgcgccaagccggcagcggccaaggggcgctacttccgctctgtgcacgtgtcgacgacgatgtcgccgtcggtagcgatcgatccgaatcgactgcgcatcgccgacgaggaactcgaggaactcggagccgcgtaggcggctgcgccaggtaggattgtcccgccatcacctcggtccgctgtagaggtccggtgcccgcaagggctcaaatcccacggtgcgtgggagcctgatgaggcggtctctccggatcgagcaggcactgccaaggagagtgagatcgatggagcatcccaggccgagcaaggtcgccctcgtcgaggcgattcgcgagcggctcgcgacggcagacgcggtgttcgtaaccgagtaccgcggcctgaaggtcgctgagctcgcgtcgctccgacaggagcttcgcgccgtggacgcggagttcaaggttgcgaagaacacgctcgcacgcatcgcggcgcgcgaggcttcgctcgaggcactcgaggcgttcctcgagggccccagcgggctggtgttcgcccgtggtgacgctgcggcgacggccaagcgactgcgcgacttcggccgagcgaatccggcactcatcatcaagggtgggctgctcggtcgcgccgcgatcgacgcagcatcggtgctgcggcttgcggatctcccaagtcgtgaggtgctccttgcgcagttggcaggggcgttcaccgcacccatggcgaacctcgccggggtgctgtcggcgctgcctcgcaacctcgcctacggcctcaaggcactcgccgaccagcgagcggcgtaggcgcgagtcgaccacggagaacaggaggagacagtggcggacatccaggggattttggaccagatctcggagctgacggtcgtcgagctctcggagctggtgaaggcgttcgaggagcgcttcggtgtcacggccgcggcgccggtcgcggtggcggcggtcgccggtgccgctggtggcggcgaggctgcccccgccgaggaggagcagcaggagttcgacgttgtgctcgtctccgcgggtgacaagaagatccaggtcatcaaggaggtgcgcgcactgacgaacctcggcctcaaggaggcgaaggatctcgtcgacgcggcgccgaagccggtgctcgagaaggtctcgaaggaagacgccgagaaggcgaaggctcagctcgagggcgccggcgcgacggtcgagctcaagtagcgagccgtcgacgcaggcggtcgtgcggtctccctgtatgcttaggggagccgtgcgtcgtcccgcaaccacttcgtcttgacgctcacgggcctttgcgcgcccgtgagcgtcttcgtgtctgccgccaccgtgcacgctcggacacgagtggtgcgagcgtcggtcgggcacctgctgtgggtgtgtgcagtccgtcgagtgcaagtcaaccgagtgcatagtcaactgagtgcaaggagtctcccttgatcacgaggcaccgtccgcctgagcgcttcagcttcgcgtccgcgcgcaatgttctgccgctgcccgatctgatcgctgtgcagcgcgactcgttccgctggttcttgaatgaggggctcgcggaggcctttcgagacatctccccgatcgaggactactccggccagctcgcactcgaactcgagtacgaccccagcgatcctgatctcgcgccggtcccgaagttctcggcggaggagtgtcgcgagaaggacatgacctatgccggcccgatcttcgtgcgggctcggttcttgaaccgccagacctacgagatcaagcagcagatcgtgttcatgggcgacttcccgctcatgaccgaccgaggtacgttcatcatcaacgggaccgagcgtgtcgtggtgagccagctcgtccgctcgcccggcgtcttgttccagcccggtcgcgatcagcacaccgtcgtgacggccaccatcaacccctaccgaggggagtggctcgagttcgacgtcgaggcccggccgggtcgcgatatcaatgcggggggccgcgtcgcgcgtaagcgccggctgagcctgttcacggtcctgcgggcggctgggcttgacgaccctgccgatcttgagcgcctggtcgcacacttcgacttcctcgaacctcagtgggccaaggaggaccactcccagacccgcgacgacgccctgatggaggtgttccgtcgggtacgcccgggcgagccgatcaacgtcgaggcggcccgcctctacttcgagaccgcgttcttccagagccggcgctatgacctcacccgcgtgggtcgctacaagatcgacaagcgactcagcgcggagatcgagcgcgtcgaggagatcctcggtcacccgctggatcgaacctcggagtcgccgctcgtgctcagccgtgcggacatcatcgcgaccgcgagctacatgctgcacctggtcgctggcgagcccgggtatcgcttcgacgatcaggaccacttctccaaccggcgggtccgcagcgtcggcgagctgatccagaaccagctcaagatcgggctctcccgcctcgagcgcctcgtccgtgagcgcatgacgacccaggacgtcgaggcgatcacgccgcagagcctcatcaacatccgtccggtggtcgctgcgatcaaggaattcttctccaccagccagctgagccagttcatggaccagaacaacccgctctctggccttgcccacaagcgccgcctgtcggcacttggtccaggtggtctgtcgagggagcgagcgggtttcgaagtacgcgacgtccactcgtcgcactacggacgcatgtgcccgatcgagacaccggaggggccgaacatcggtctcatcggggcgctcgcgagctatgcccgcctgaatcgatacgggttcatcgagaccccatatcggcgtgtggtggacggcaaggtcaccgatgaggtggtctacctgaccgccgacgaggaagaagactacgtcatcgcgcaggcgaacgcgaagctcgacgccgagggtcgcttcgtcgagccgaaggtcctggtgaggcgcggcccgcagggcgcggtcgtgcgggtcggtgccatggcggtctcctacggcgccaccagtgaggtcgagctcgccaccccggacgaggtggacctcatggacgtgagtccggcgcaggtggtctcggtgtcgacgtcgctcatcccgttcgtggagcacgacgacgccaatcgtgcgctcatgggtgccaacatgcagaagcaggcggtgccgctgctcgtccctgaagcgcccttcgtcggtaccggtgtggaagcccgagccggactggacgctggcgacgttcttgtcgccgagggcccaggtgtcgtgtcagaggtgaccggcgcctcgatcgcggtgacctacgacgattccgtgaccgacgatgccggtcggccactcggaacacgtcgctactggctgacgaagttccagcgatccaaccagaacacctgctggaaccagcgtccgacggtggccaccggggaccgggtcgagctcggtgacgtgctcgccgacggtcccgccaccatgcacggtgagctcgcgctggggaagaacctcctcgtggccttcatgccgtgggagggctacaacttcgaggacgccatcatcatctcggagcgcctcgtgcgagacgacgtgctgtcctcgctgcacatcgaggagttcgagaccgatgcgcgcgacaccaagctcggtgccgaggagatcacccgcgacatcccgaacctgtcggaggaggccctcgccgatctcgacgagcgcggcatcgtccgtatcggagccgaggtcggccccggtgacatcctcgtcggcaaggtgacgccgaagggcgagaccgagctcacgccggaggagcgactgctgcgtgcgatcttcggcgagaagtcccgcgaggtccgcgacacctcgctgcgcgtgccccacggtgagtacggcaaggtgatcgacgtcaaggtgtttacccgcgaggacgcgaccgagctgccgcccggcgtgaacgagctggttcgggtgtacgttgcgcagcaccgcaagattcaggtcggtgacaagctcgccggtcggcacgggaacaagggtgtgatctcgcggatcctccccatcgaggacatgcctcgactggaggacggtacgccggtcgacatcatcttgaacccgctcggcgttccgagccgcatgaacatcggccaggtgctcgaggcgcacctcggctatgccgcccggtgggggtgggagcccatcggcgagggcgcacgggagcatcgcaagacgcgtccggtgacggtcccggcccggtgggtggcgagtcccgccttcgacggcgcgcactgggacgagtcggaagaggccggggacctgccgaccatcaaggaactgctcgagcggctgaacccgcagagccgcgacggcgagcgcctcgtccagcccgacggcaaggcggtgctctacaacgggcgcaccggcgagcgctacgacaaccccgtcatggtgggctacgtctacatgctcaagctggcgcacatggtcgatgacaagatccatgctcgctcgacgggcccgtactcgatgatcacgcagcagcccctcggcggcaaggcccagttcggtgggcagcgcttcggtgagatggaggtgtgggccctcgaggcctacggcgccgcgtacgcgctgcaggagctgttgaccatcaagtccgacgacgtcgtaggccgtgtgaaggtctacgaggccatcgtcaagggtgacaacatcccagaaccggggattccggagagcttcaaggtgctcatcaaggagatgcagtcgctgtgtctgaacgtggaggtgctcgctccgaacggagagcgggtgcagctgcgcgagttcgaggatgaggcgtactcggcggcggaggagctcggtatcaacctgagccgccctgagcgcaacacggactacggcgacgacgagcgacgcgaggagaggggtcagtagtgctcgacctgggtcgattcgaccagatccgcatcgggcttgccacgacggaagccatccgcgcctggtcacacggcgaggtgaagaagccggagacgatcaattaccgtacgttgcgtccggaacgcgatgggctcttctgcgagcgcatcttcggccctacgcgcgactgggagtgccagtgcggcaagtacaagcgcgtgcgctttcgcgggatcgtctgcgagcgctgtggcgtcgaggtcacccgctccaaggtccgacgggagcggatgggccacatcgagctcgcagcaccggtggtgcacatttggtacctgcgcgggacgcgttcgtggctggcctacctgctcatggggacctcccccaaggaggagctcaaggccaagcagctggagaaggtgatctacttcgccgccaacttggtgacctgggtcgacgaggagcgtcggcaccaggacctgccgaacctcgaggtcgaggtgctcgaggaggttcgggcgatcgagtcggagcgtgacgtcgagctcgagcgccggtaccaggcgatggaggcggagctcgccgagctcgaggagcagggtgctcgcgaagccgaggtgcgccagcgccagcgcgcgctcgagcgggagatcacgcagctccgcgagcgctacgcggcgcgcatcgacctcgcgcgtaggaccttcgacgagttccgcgagctctacccgcgccagatcatcgaggacgagctgctgtggcgcgagctgcggtcgcggtatggctcctacttcgacggcggcatgggggccgaggcgatcgccgacctcatccgtcgtatcgacttcgatgccgagctggccaagctccgcgagctcatcgaccccgccgagggtcgccgcccgttgtcggcacagcgtcgccagaaagccatccgacgcctgcgcatcctcgccgcgttcaaccagcgcgacgaggagggtcgtcgtatcaacgacccgatggcgatgatcctcgaggtcgtcccggtgatccccccggacctgcgtccgatggtgcagctcgacggcgggcggttcgcgacgtcggacctcaacgatctgtatcggcgcgtgatcaatcgcaacaaccggctcaagcgtttgttggatctcggcgcgccggagatcatcgtcaacaacgagaagcgcatgctccaggaggcggtcgacgccctcttcgacaacggtcgccgtgggcggccggtggtcggcccgggcaaccgtcctctgaagagcctctccgacatgctcaagggcaagcagggtcgcttccgccagaacctgctcggcaagcgcgtggactactccggccggtccgtcatcgtcggcggcccgacgctgcagctccatcagtgtgggctcccgaagatcatggcgctcgagctgttcaagccgttcgtcatgcgtcgcctggtggagttgggctatgcccagaacatcaagtcggccaagcgcatggtcgagcgtcggcgtccccaagtgtgggaagtgctcgagacggtgatcaaggagcatccggtgctcctgaaccgtgcaccgaccctgcaccgactcggcatccaggcgttcgagccggtgctggtcgagggtaaggcgatccagatccatcctctggtgacgaccgcgttcaacgccgacttcgacggcgaccagatggcggtgcatctgcctctgtcgcctgaggcgcaggccgaagcccgcgtgctcatgctctcggcgaacaacacggtgtcgccagcgaccggacggccgatcacggtccccgggctcgacatggtgttcggtctcttctatctcaccatcgtgcgcgaagaggagccaggtgccggcaaggtgttccgccacgactatgaagtggtccgggcctgggaaaccggcaatctcggcttgcacgcgccgatcaccctccgtcgtcgcgatggcgatggcaacgtcgaagagctgcggacgacagccgggcgtgtgatgttcaaccaggcgctgccggccgacttccccttcgtcaacgaggtcgtcgggaagaaggcgcttcccatcggctcgatcgtcgagcgggtggtgacccagtacccccgcaacgtcatcgaggagacgctcgatcgcatcaagtcggttgggttcaccttcgcgacgcgcgctgggctcaccatctcgaccgacgacgtcacaaccccggccgccaaggccgagatcctcgatcgctacgagcgcgaggcggacaaggccgaggcgcagtaccggcgaggcatcatcaccgacgacgagcgcaagcagaaggagatcgagatctggacggcggcgaccgcggagatcggtcgggccatcgacgagatgctcgcctccaacccgctcaatccgctcgcgatgatggtcgagtcgggagcgcgaggcaaccctcagcagatccgccagatctccggcctcaagggcctcgtcgccaatccgcgcggtgagatgattccgcgcccgatcaagtcgtcgttccgtgagggcctcgaggtgctcgagtacttcttgtcgacgcacggtgcgcgcaagggcctcgccgacacggcgctgcgcaccgccgactctgggtatctcacccgtcgcctcgtcgacgtcgcccaggagctgatcgtgcgcgaagaagattgtggcacgtcgcgggggatttggatcgacgacgtcgccgaggactcggcccagcgtcgcagctacctcgagacgcgggcgttcggacgggtcctcgcagaggcggtcgatcttggcgacgggtcgcagctcccggccgggacgttgctcaccgacgagctcgtcaagcagctggcagccgatccggcagtcgagcggatccgtgtgcgcaccccgctcacctgcgagacgccccacggcgtgtgtgcgacctgttacggccaaggttttggggggagggggctcatcgagctcggcgaggccgtcggcgtcgtcgcggcccagtccatcggcgagcctgggacgcagctcaccatgcgaaccttccaccagggcggcgtcgcgggcgccgacatcacgcacggcttgccgcgcgtggtggagctgttcgaggcgcgttcgcctcgtggagccgcggtgctggcgcatgcgtccggtgtcgtgcacatcgaggaggaagagaacggtcggcgggtcaccatcacccacgacgacggctccgacgaggtctacgtgctcccgctcagggcccatctcgaggtggccgagggcgaagtgatcgaggccggcgaggccatcgtgagcggtccgaaggaccccaagcagctcctcgagatcaagggcattcgcgagacccagcgttacctggtcgaggaggtccagaaggtctatcgcgaccagggtgtgtccatccacgacaagcacatcgagctcatcgtccgtcagatgctgcgccgagtgctcgtggccgagcctggcgattcccccttcttgccgggagaacgcgtggacacccagcgctttgccgaggtgaaccgcgaactgttcgccgaggggaagcgccctgccgagggtcggccggagctcatgggtatcaccaaggcgtcgctcgcgacggagtcgtggctctcggcggcctccttccaagagaccactcgggtgctcaccgaggccgcgatcgaggggcgttcggatcacctgctcggcctcaaggagaacatcatcctcggcaagctgatcccggcaggtacgggtgcgccgcgttaccggtcggtcgcggtcaaggctccccactatcgccgactcgcgtactggtcgagcgaggaagacctcggtgggttcgacggggggcctggctatgaggcgcatggcggccctgtagactgagccatacgcgggtggtgcgtgtcgcgtgccaccactgcgaatcgggccggacgcggaggttctcggcgagccggcagaggaaccaggaatgttggagaccggcccgccccgtgtgggcgggccggtccaccgagagcggcgcgcctgcgtcgcaagaaggagtgcaaaccgtgccgacgatcgcgcagctcgtgcgcaagggccgcgaggccaagcgcacgaagaccaagaccccggcgctcaagggatcgccgcagcgccgcggggtgtgcacccgcgtgtacaccaccacaccgaagaagccgaactccgcgttgcgcaaggtcgcgcgcgtccggctcacgagtggcgtcgaggtcactgcctacatccccggtatcggtcacaacctccaggagcactcgatcgtgctcgtgcgtggcggccgcgtcaaggacctccctggtgttcgttacaagatcgtgcgcgggacgctcgatgcggcgggcgtgaagaaccgcaagcaggcgcgcagccgctacggcgcgaagagggagaagtagccgatgccacgcaagggtccagcccaggttcgtccgatcgctcctgaccaggtctaccactcggtgctggtgtcgcagctgaccaacaaggtcctgcgtaacggcaagaaggcgctcgccgagcgtaccgtctacggcgcgctcgaccagatcgctgccaaggtgaacggtgacccggtcgccgtcttggagcgtgcgatctcgaacgtacgccccatgaccgaggtgcggtcacggcgcgtcggcggtgcgacctatcaggtacccgtcgtcgtccgtgatcggcggtcgtactcgctcgccatccgctgggtcgtgaattcggcgcgcgcgcgccgtgagaagaccatggccgagcggctcgccaacgagctgctggatgcgtccaacgggctcggcacgtcggtcaagcggcgggacgacacccacaagatggccgaatccaaccgcgcgttcatgcactatcgctggtaagcaaggagctttccacatgccccccacccgtcaggtcccgctcgagcgcttgcgcaacatcggcatcatggcccacatcgatgccggcaagaccaccacgaccgagcgcattctctactacaccggcaagaactacaagatcggcgaggtccacgagggcgcggcgacgatggactggatgccgcaggagcaagagcgcggcatcaccatcacctcggctgcgacgacggcgttctggcgggatcaccgcatcaacatcatcgacacgcccggtcacgtggacttcacggtcgaggtcgagcggagcctgcgggtgctcgacggggcggtggcggtgttcgacgccgtcgctggtgtcgagccgcagaccgagacggtgtggcgccaagggaacaagtacggcgtgccgcggatctgcttcgtcaacaagatggaccgtgtcggggccaacttcgatcgctgcgtccagatgatccgggatcgcctcgacgccgtcccggcggtgatccagctcccgctcggtgtcgagagctccttccgtggtgtcatcgacgtcgtcggcaagcgcgcgatcgtgtgggacgagggcctcggggagacgttccacgacgagcccatccctgccgagctcgtcgacgctgcagagcaggcgcaccacgatctcatcgacgtgctcgccaatcacgacgaagagctgatggaacgctacctctccgacgaggagatctcggaggagatgctgcgggcctccatccgcgaggcgaccatcaacaatcacgtcgtcccggtgctctgtggctcggcgttcaagaacaagggcgtccagccgctgctcgatgcggtggtggactacctcccgagcccgttggacatcccggccgcgaccgggacgtcgccgaacggcatggacatcatcacacgcgagccgtccgacgatgcgccgtttgcggccctcgcgttcaagatcatgaccgacccttacgtcggcaagctgacgtacttccggatctactcgggcgtcttggagaagggatcgacggtcctcaactccaccaaggacaagcgcgagcggatcggtcgactgctgctcatgcacgccaaccatcgcgaggacatcgaggtcgcccacgctggtgacatcgtcgcggccgtcggcctcaagtcgacgagcaccggcgacacgctgtgcgatccccaggcgcccgtcgtcctcgagagcctcgagttccccgatccggtcattcacgtggcggtggagcccaagaccaagtcggatcaggagaagatgagtcgggcgctctacgcgctcgccgaggaagatccgacgttccgcgttcgctccgaccaggagaccggtcagacggtcatctcggggatgggcgagctgcatctcgaggtcatcgtcgatcggctgctgcgcgagttcaaggtcgaggcgaacgtcggcaagccgcaggtcgcctatcgggaggcgatccgcaagccggtgtcgaaggtcgaggagcgctacgtgcgccagaccggcggccgtggccagtacggtcacgtcgtcatcgacgtcgagccgctcgggcgcggcgaggggtacgagttcgtcgacaagatcaccggtggcgtcatccccaaggagtacatcccagcggtggacgccgggatccaagacgcgctctcgtcggggatcctcgcgggcttcccggtcgtggatctgcgcgtcacgctggtcttcgggtcgtaccacgaggtcgactcctcggagatggcgttccgtatcgccggctcactcgccatcaagaaggcggtgcgcatggcgagtccgtgcctcctcgaaccgatcatggcggtggaggtcgtcacgcccgaggagtacctcggtgacgtgatcggcgatctctcggccaggcgaggcaaggtcgagggcatggagcaggtcggcgtgaaccaggtggtgcgtgcgctcgtgccactcgcggagatgttcggctacgctactgacctgcgttcgcgtacgcaggggcgtgcgagctactcgatggtgttccgggcctaccaagaggttccggattccatcgcgcaggagatcgtcaagcggatcaagggcgagtagacttcagcactcggttatccgtcggcgggttgcgtcatccgggcgcagagggacaacaacggagcaggacaggccatgggcaagcaaaagttcgagcggacgaagccccacatcaacattgggacgatggggcacatcgaccacgggaagaccacgctcaccgcagcgatcacgaaggtcctctcggagaagaaccccaacgtcaagttcaagcccttcgatcagatcgacaatgcgccggaggagaaggctcgcggcatcaccatctcgatctcgcacgtcgagtacgagacggagaagcggcactatgcgcacgtcgacatgccggggcacgctgactacatcaagaacatgatcacgggcgctgcccaggtcgatggtgcgatcctggtggtcgccgcgaccgacggtccgatgccccagacgcgcgagcacgtgctgctcgcccggcaggtgggggtgccctacatcgtggtggcgctcaacaaggcggacatggtcgacgacgaggagctcctcgatctcgtcgagctcgaggtccgagagctgctgaaccagtacgagttcccgggtgacgacaccccgatcgtgcgggtctcggcgctcaaggcgctcgagggcgatccggtctgggaggagaagatcgtcgagctgatgaacgcggtcgacgagtacatcccagagccacagcgtccggtggatcgtccgttcctcatgccgatcgaggacgtgttcacgatctccggccggggtacggtcgtcacgggcaaggtcgagacgggcaaggtccacgtcggcgacgaggtcgagatcgtcggcctgcggcccacgcagaagacggtcgccacgggcgtcgagatgttcaacaagctgctcgacgagggccaggcaggcgacaacatcggtgtcctgctgcgcggcacgaagaagaccgacgtcgagcgcggccaggtgctctgcaagccgggctcgatcaccccgcacacgaccttcgaggccaatgtgtacgtcctgacgaaggacgaaggcggccggcacaagccgttcttcaacaactatcggccgcagttctacttccgtacgaccgacgtcacggggaccatcaccctgccggaaggtacggagatggtgatgcccggcgacaacatcgtcatgaccgtcgagctgctcaagccggtggccatggacgagggtcttcgcttcgccattcgcgagggcggccgtacggtcggcgcgggtcgcgtcgtcaagatcatcaagtagcacgtcagtgcgtcgacgagggccccggcacgtccggggcccttcggcgtcgacggacgaccggagcaccaaggagagccatgagcgacagcagtaagcagcgcatcagggtgcgtttgaagggtttcgaccacgagatcctcgaggcgtcgacccggcgcatcgtcgatacggtgacgaggacccaaggcaaggtggtcgggccggtgcccttgccgaccgacatccaccgctacaccgtcattcgctcgccccataagtacaaggattcgcgcgagcacttcgagatgcgcgtccacaagcggctgctcgacatcgtcgatcactcggccaagaccgtcgacgcgttgaagcggttggagctgccggccggcgtcgatatcgaaatcaagatccagaacgcatagcgagagatcgcagcatgatcggcccgcgcccgagtgcgcgggcagtatgctgcaagagttgtcttgcgtccggtcgtgcctcctctggagggaccttccggcggtttgagcggcgctacccgctcgtacgaggtcagctgcggcgtcgggtggacgctgcgtgaggcgaaggaaccatggcgaggaagacgtttgtcggtgagaaggtcggtatgacccaggtctggaccgagggtgaccgtgccgtcccggtgacggtgatcaaggtcgtcccgacgtgggtcgtgcggacgaagacgccggagcgagatgggtacgaagcggtgcaggtcgcggtgggtcgcgtcaagccgcagcggctgagtcgtccggttgcgggtcagttcgaggcccgaggtgtcgaggccggcgcccgcatcatggagctgcggctcgatggggcgtcgtcgttcgagcccggcgatcagatcgggatcgaggggatcgagccggggatgcgtctcgacgtcgtcggcgtgtcgaagggccacgggttctccggcggtatgaagcgccacaacttccgtgggcagggagcggcccacggtaaccacaagaagcatcgtgctccgggctcgatcggggcgtgcgccacgcccgcacgcgtgttcaaggggacgcgtatggcgggtcagtacggtaccgagcgggtcaccatccataacctcgaggtcgtgcgggctgagcccgagcgccagctcgtgctggtgaagggctcgatccctggtccgcggggcgccatcgtcgtggttcgtgattcggtgaaggggcggaagtagatggcgagcgccaaggtcatcgacgccacgggtcgtacgctgcgcgaagaggaactgccgggcgaggtcttcgcgcacgctcccaacatcgcgctgttgcatcaggttgtcgttgcggagcaggccggtgcgcgccggggaacgcattcgacgaagacgcgggcagaggtcgccggaggcggcgcgaagccctatcgccagaaggggaccggcaacgctcgccagggttcgatccgggcccctcagtacaagggtggcggtatcgttcacggccccaagccgcgcgactactcccagcgcaccccccgcaagatgctgcgcgcggcgctggcacaggcgttgtccgatcgggccagcgccggcgtgatctacgtgctcgaggacgacgtcatcacggcgccgtcgaccaaggcggcgcttgcctgtctgcgcggggctggtctcgaggatcgcaaggtgctcgcgctggtggccggtgcaaccgacgaggccgtcttcaagagcgtgcgcaacctccccacggttcgtgtccatcgggcgggcttggtgctggtaagtgcggttctcgcttccgacgccgtgctgttcacgcgcgcagcgctggcagagctcctcgggcgcgtgggagtggaggttgccaagtgagcggtcgggatccctacgcaaccgtcgtggcccccatcatttcggagaagagctacgggctccgcgaggagggcgtctacgtcttcgaggtggcgcctcgagcgaccaaggtggacgtgcgcgccgcggtcgagcggctcttcggggtgcacgtggtcaaggtcaacacgctcaaccgcaagggcaaggcccgtcggagccgccgaaccggtcgagtcagcgtggagcccacccgcaagctggcctacgtcaccttgcgcgagggcgagcgcatcgagctgttggagagctgagccatggggattcgtaagcgcaagcccacgagtgcgggtcgacggttccagtcgagttcggacttcgcggagatcacgaagcagcgtcccgagcgatcgctggttcgaccgctgtcgggctcgggaggacgcaacgccgacggtcacaagaccgcgcgccatcggggtggcggacacaagcggcagtatcgggtcgtcgacttccgtcgcaagaaggacggtgtgccggcgacggtcgcagcgatcgagtacgaccccaaccgcaatgcgcgcatcgcgctcttgcactatcacgacggcgagaagcgctacatcctcgcgcccaaggggctcacggtggggatgaaggtgagttccgggccggacgccgacatcacggtggggtcggccctcccgctgcgcaacatccccgtcggcaccaccgtccacaacgtggagctccgtcccgggcaaggcggcaagctcgccaggagcgccggtatgggcatccagctcgtcggcaaggacgaggtctacgcgacgctccggctgccctcgaccgagatgcgccgcgtcccgatcgattgtcgtgcgaccgtcggcgaggtcgggaacgccgaggccgagctgatctcgatcggcaaggcgggtcggaaccgctggcgtggcgttcggccgcagacgcgaggcgtcgcgatgaacccggtcgaccacccgctcggtggtggcgaaggcaagacgtcgggtggtcgccatccggtgtctccgtggggcaagccggagggccgcaccaggcggcgtcacctcccgagcgacaagctcatcatccgccgtcgtcgagcccgtggggcgaggaggtagtacgtgccacgcagcgtcagcaagggtccgttcgtcgatgcgcatctgttgaagaaggtcgacgagctcaacgcgtcgggtgacaagcgcgtgatcaagacctggtcgcgtcgttccaccatcattcctgacatggtgggccacaccatcgccgtgcacgacgggcgcaagcacgtgccgatctacgtcacggagtccatggtcggccacaagctcggggagttcgcgccgacgcggacgttccggttccatgccgggcaagagaagacggcgaggaggcggtagtggcagtcacagtgaccgagcgcccgcgctcgcgagcggtgctccggaactacggcgcgtctgcgtcgaaggtgcgagaggttcttggcatcattcgaggcaagccggtcgagcaggccattcgcgaactgtcgctcgtgagccgtggtccggctgaggcggtcggcaagctcctcgcgagtgccgtggccaacgcgacggtccagcacgggctgggcgtgtccgacatggtggtgcggctggcctatgcggacgaagggacgacgctgaagcggtttcggccgcgtgcgcgcggtcgtgcgacgcgcatccgcaagcggacgtgtcacatcacggttgtggtcgaggagatgacgctcgaggagcgccagcgcgccgtggcgcagaccggccgtcgtgccgtgagccgccagcggcgcgtgcagtcctctcgtcgcggacgccagcaggcgcaggcgacctcggcagaggcgacctcggcagaggtggccacttcgcagcccgagatcacgagcgaggcggcagcgtcggagcagacggtcgaggtcacggctgccgaggagcaggttgcagctctcgttgccaccggcgaggagaccggggccgagacgccgagcgccgcctcggaagaggccgccgagggcggggaggagtaggtcgtgggccagaaggtgcatccgtacggcttccgtctcggagtcacgacggactggaagtccaggtggtacgccgataaggactaccagcgttggctgatcgaggacgagcagattcgccagtggctccagcgcgagctgcgcacggcgtcggtgtctcgggtcgacatcgagcgcacccgtgaccgggtgcgcgtggacatccacacggcacgtccgggcatcgtgatcggcaagaagggtgtcgaggtcgagcggttgcggcgggagctggagcggcgctgcgcgccggctcgtgtgcagctgaacgtcgaggagatccgccaaccggatctcgacgcgaccatcgtcgcccagagcatcgccgaccagatcagccggcgcgtgagctttcgccgagcgatgaagcgtgcgatccaggtggcgatgaaggaaggcgcgcgtggcatcactgcccagtgctctggtcggctcggtggcgcggagatggctcgccgagagacccatcgcgagggtcgggtgccgcgtcacacgttgcgtgccgacatcgattttggcctgcgtgaggcgcgaacgacctacgggcagatcggcgtgaaggtctggatctacaagggtgacgtcgtcccctaccagacgctgacctcccagccgcagcggccgccggtcgcgggtggtcgtccgaccggaccgatccgcgcccagactggatcgcggcgtcggcccgtggccgaggcaccgaagccggccgcggtgggtgcggagagtcaggacgagttcgagcgcttgctcgccgaagaggaggagatcgagcgacgtacccgtgaggagggtcgcgaggctccacacttcaagaaggaggtggactagcgatgctcatgccacgcaaggtgaagcaccgcaaagtccagcggggacggctcggcggagaggccaagggtggtaccgagatcaccttcggtcgctacggtatccaggccctcgagccagcgtgggtgacggctcgccagatcgaggccgcgcgtatcgcgatgacgcggcacgtgcgtcgcggtggcaaggtctggattcgcatcttcccggacaagcccatcaccaagaagccggctgagactcggatgggttcgggcaagggcaacccggagttctgggtcgcggtggtcaagcctgggcgcattctcttcgagctcgacggcgtgggcgaggagctcgcccgtgccgccatggagcgcgcgatccagaagctgccgatgaaggcacgcttcgtggtgcgcgaggacgtggaagcgttggcgggaggcgccagatgacgagggcacgagagctgcgcgacctgagcccggaggcgctcgaggagcgactcggttcgctcaagcgagagctgctcgagttgcggttcgcgatcgcgaccggccagggaacccagacggcgcggttggggcagctccgcagagagattgcccgtgtggagacggtgcgacgcgaggcggcgtcggcgaccgagacgacccgagtgacgcgggcgaggagcaggagacggtgagcgaggagcagcagcaagagcgaccccggcgcaaggtccgcgaagggatcgtggcaagcgccaagatggacaagaccatcgtggtggagatccatcagcgggttcgtcacccgcgctaccagcgcacgatcgcgcgtcggcgtcggctgtacgcgcacgacccggcgaacgaggctcgcgagggcgaccgtgtcgagatcgccgagacgcggccgctgtcgcggctgaagcgctggcgtctcgttcgaatcgtggagcgtgcacggtgatccagcaggagactcgactgaaggtggcggacaactcgggcgcgcgcgaagtgctctgcatccgcgtgctcggtggttcgcgtcgtcgctacgcgagcattggtgacgtgttcgtcgcgacggtcaaggacgcactccccggcgcggccgtcaagaagggcgacgtggtcaagtgcgtcgtcgtgcgtactcgcaaggaggtacgtcggccggatgggtcctacatccgcttcgacgacaacgctgcagtgctgatcaacgaccagctgcagccccgtgggacgcgcatcttcgggccggtcgggcgcgagctgcgtgacaagcggttcatgcgcatcgtgtcgttggcaccggaggtgatctgagtgcgcattcgtaagggagatcgggtccgcgtgatcgcggggaagtggcgcggggccgagggcgaggtgcttcgggcgcttccggcgcgccatcgcgtggtcgtcgacggggtggcggtcgccaagcgccacaccaaggcgcgcgatgcgtcgagcccgagcgggatcctcgagaagaccctgccgatcgacgtctcgaacgtgatgatcatctgccgcgcatgtgggccgacgcgcatcgcgatgaaggtcgacgacgccggccgtcgccagcgggtctgtcgacgctgtggaggagcgctgtgatggttcagaccgatacggcccccaggccgcggctacgggtgcgcttcgacgaggaagtgcgccccgcattgttccgagatctcggtctcgagaacgtcaaccaggtgcccaggctcgccaagatcgtggtcaacatgggcgtagggcgggccagcgcacagccgagtctgctcgagggagcggtccgcgacctggagacgatcacgggccagcgcccgtcgatccgcagggctcgcaagtccatcgcgggcttcaagctgcgcgagggcatggcgatcggggcgacggtgaccctgcgcggcgaccgcatgtgggagttctacgatcggctggtcgcggtcgcgattccccgcatccgtgacttccgcgggctcaatccccggtcgttcgacgggcacggcaactacacctttggcgtcacggagcagctgatctttccggagatcgactacgactcggtcgacaccacgcgtggtatggacatcaccatcgtcacgaccgcaacgacggacgcgcatgggcgtgctctgctcgaagcgctcggttttccgtttcggagggaagggtaatggcgacgaaggcgctgatcgcgaaggcgaaccgcgtgccaaagttccgtgtgcgggcctacacccgctgcaagcggtgcgggcggccgcacgcggtctaccgcaagttcgggctgtgccgtatctgcctgcgcgagatggcgcacctcggcgaggtgcccggcgtgaccaaggccagctggtaagggggtaggcgaatggcaatgaccgaccctatcgccgacatgctcacgcggatccgcaatgcgtcccgcgcgcgccacgcctcggtgacgatgccgagctccaagctcaaggtggagatcgcgcgcatcctcaagcgcgagggtttcatccaggactatgcggagcgcgagagcgccgtggggccgcgcaaggatctcgtgatcgagctgcgctacgtcggtgatcgacgtgcgtcgtcggcgatccacggcatcgagcgcatctcgaagcccgggctgcgcgtctatcgacaggccgggtcgctcgagcgggtgctcggaggcatggggatcgcggtggtgtccacctcgcacgggctcatgacggaccgtgaggcccgagcccgacgcgttggtggcgaagtgatctgtcacgtctggtaggaggaacgatgtcgcggattgggaggcaacccatcgcggtgcctggcggcgtcgaggtggcggtggatggccagcacgtgtcggtgcgcgggccgaggggttcgctcgctcgcgacctgccgccggaggtcacggtgagcgtggtcgacagcgtggtgcacgtcgaacggagcgatgactcgaggcgcgctcgggccatgcacgggctctcacggacgctggtcgcgaacatggtgcgcggtgtggccgagggctacgagaagacactggagatcatcggaacgggctatcgcgcccaggcgcgtggcaccggcgaactcgagctcgcgctcggcttctcgcacccagtcgtggtcgaggcgcccgatggcatcgcgtttgcgacgccgacgccccagcgcgtcgtggtctcgggcatcgacaaggaactcgttggacaggtggcggccaatatccgccgcatccgcaagccagagccctacaagggcaagggtgtgcgctacctcggcgagcgggttgtccgtaaggccggcaaggccgggaagtaggtaggagacgatggcaacgctgtcacgggaggatcgtcggcgccgtcggcacgcgcgtgtgcgccgcagggtcgtcggtacgagcgaacggccccggctggcggtcttccgatcgaatcggcatatcttcgctcagatcatcgacgacacggctgggcgtacggtggccgctgcctcgacggtcgagccagagctgcgcgatgggcgcaccggctcgacggagggtgcggcgtcggtcgggcggctcgtcgcgagtcgtgcgttggcgctcggggttcgccgcgtcgtgttcgatcgaggtgggttccagtaccacggtcggatcgcggcgttggccgacgcggctcgcgaagcgggattggagttctaggtggcgacaaacgagttcgaagaccgcaccatcaaggtcaatcgggtatcgaaggtcgtcaagggcggtcgtcgattctccttcacggcgctcatggtcgtcggtgatcacgcgggccaggtggggctcggctacggcaaggccaaggaggcgagcctcgccgtgcagaagggggtcgacgaggccaagcgcaagctggtgcgcgtgccgctcgtccacgggaccatcccgcacgcggtggtcggcgtcgcgggagcggggagggtcttgctcaagcctgccgcacccggtacgggtgtgatcgccggcggtgctgcgcgcgcgatcttggagcttgccggcgtcaccgacgtgctggcgaagtccctcggttcctcgaacggcattaacgtggcctatgccacactcgcaggactcgaggcgttgctctcgccgcagcgcatcgccgaggctcgtggtcgttacgtggatcaagtcgctcctcgatggctcatcgaggagagtccggcgcgtgtcgatggagaagtcgtggaggttggggccgatggctaggcagctgcgcatcgtgcaggtccgctcggcgatcggtgccaagcccgagcaccggggcacgctgcgcgcgctcgggctcggacgcatcgggcgggagcgtgcgctcccggatcgtcccgagatccgcgggatgctggctcgcgtcgcccatctcgtcgtcgtccgtgaggaggaacaggcatgatttacctccatgatctcaagcccgccgagggttcgcaccatcgcaagcggcgcgtcggtcgtggcatcgcgggcaagggcggcaagaccgccggccgcggcacgaagggtcaaggcgctcgcgatacggttcccgtcggcttcgagggcggccagctgcccttgacgcagcgcacgccgaagctgcggggctttcgcaacccgttccgggttgcctatacggtcgtcaacctcgaccagcttgctcggcttggcgaggagggcatggccgaggtcgatccgacgtcgctggtcgcgcgcggggtggttcgtcgcggcgcgctcgtgaaggtctgtgctcgcggagagctgcatgcacccctcgtcgtgcgcgcccatgggttctcgcaggcggcgaaggcggcgatcgaggctgctggcggccgtgtcgagacggtcgcggtccccttcaagggtcctcggcctcgcgctgccggcagcgcgttgtccaaccgctgagcacgatcggcggggaggcaccgtgatcgagaatttcctgaacatcgtccgggtgagggacctgcgcaacaaggtcctgttcacgttggcgatgatcggcctgtaccagttgggttcgaacatcccggtgcccgggatcagctaccacgcgatccaacaggtcttctcggaggcctcgggccagggtgtcctcggcttcctcgacctcttctctggcggtgcgctgtcgcgcgcggcactgttcgggttgggtgtgatgccctacatcacctcgtcgatcatcatccagctgctcaccggcgtcattccgaagctctatcagtggcgggacgagggatcgtctggcgagcgcaagatcacccagacgacgcgctatctcaccatcgggctcgcgctcgtacaggccactggcctcgtgttcgtgttccactcggggctcggcctgttccttgcgaacggtcagagcgtggacctgatcccgcagttcacggtgttgcgggtgctgttcatcattctgaccctgaccgccggtacggcgctcgtgatgtggatgggcgagctgatcaccgagcgcggggtcggccaagggatgagcatcctcatcttcgccaacgtcgtgagcgtgatcccgaccgcggggcgcctgatctatgaccaggcgggcgcgctcaagctcatcgtgatcgtggtcgtggtggtcgcgctcctcgttgcgatcgtcttcgtggagctcgggcagcggcgtatccccgtcgtgttcgcgaggcgcgtcgtcgggcgtcgcatgtacgagggcgggcggacgtacatcccgctcaaggtgaaccaagctggggtggtgccgatcatcttcgccgcctccatcttgtacttcccggtgctgctctcgaacatcgtgcgctggaagccgctcgtcaccttcgtcaacgatcacctgctcaacgccacgagtggcttctacatcgtgacctacgggctcttgatcttggtcttcacgttcttctacgtgacggtgtcgttcgacccgtaccagcaagccgacatcatccgacagcaaaacggctacatcccgggcgtgcggccgggcgaggagaccaggcggtacctgtctcggatcttgaaccgcatcaccctcccgggcgccgtgttcctcgctgccgtcgccgtgatcccatcgattctgctcgctgcgtggcacgtgacgtcgttcccgtacgcgggtacgaccatcctgatcgccgtcggtgtcggtctcgagaccgtgaagcaggtgaactcacaactcaccatgcgcaactacgagggattcttgcgctagatgggggacgcggcacttcggcttgcgctgctcggtcgacagggcgcgggcaaaggcacgcaggcggtgcggatctcgcaccactttgcgatcgcgcacatcgccactggggacatcttgcgagctgcggtgcgcgccggtacgccgttcggggagaaggccaaggcctacctcgatcggggcgaactggttcccgacgcggtgatcatcggtgtcgtcgccgagcgcctctccgaggccgatgcgacgcgacggggcttcgtcctcgacggctttccacggaccgtcgagcaggcggaggcgctcgagggtctgctcgctccgcatggactcgacgtcgtgatcgatctcgaggtgcctgagtggctcgtgctggagcggctggcgtctcgccgggtgtgttcggtgtgcggtgccaactactccacgtccatgccgcctcgggtggactggacgtgtgacctgtgcggtggtgaggtggtccagcgtgcggacgataccgaggaggccatccgacgccgcctggacgcctacgagcgccagacgaccccactcatcgagtactaccgggagcgggagctcctcgaggtcgtcgacggtgtcgggggcccagaggaggtcatggagcgcatcctcgaggcacttgcccgacacggtgtggtggaggagggtcgatgaggcgttcggcgacagagcttgcgtcgatgcgcaaggcggggcgcgtcaccgcagcgatgctggaggcgacccgtgaggcggtcaagcccggcatctcgaccgcagccctggatgcgatcgcgcgctcggtgctcgagcgcgagggtgcgcggtcgaacttcctcggttacggcgggttcccggccgtgatctgcacctcgcgcaacgaggtcatcgtgcacggtatccctcgagaggacgagatcctcgaggagggggacgtgctgtcgatcgacgccggcgcgatcgtcgacggctaccacggagacgccgccatcacggtgcccgttggcgaggtctcgaaggctgcggcccgcctcatcgaggtgacccgtgaggcactgtgggcgggcatcgagaccatgcggccggggtcacatctccacgagatcggccgagccgtggaacgcgtggcgaagcggcaccactacggcgtgatccgcgactacgtggggcacgggatcggcaccgagatgcacgaagccccgaacgtgcccaactactggcccggtacgcccggccccacgctcctcgccggggaggtgttcgccgtggagcccatgttcacgctcggcacggaacgcacgagggttctgcgcgatggctggagcgtggtcaccgccgacgggacgtgggcggctcacttcgagcacaccatcgcggtgacggaggacggacccgaggtcttcaccctgggcccggatggccgttgaggcgagcgcactatactgcgtaggcaccggttttgcgcccgtcgccacgtcgtggcgtgtccgggcacgaacgatcgagagtaggaggacccactggcaaagggcaaggaggacacgatcgtcctcgagggcacggtggtcgagccgctgccgaacgcgatgttccgtgtcgagctcgagaacgggcacaaggtactcgcgcactcctcgggcaagatgcgcatgcatcgtatccgcattcttcccggagatcgtgtccaggtggagttcaccccctacgacctcacgagggggcggatcacctaccgctacaagtaggtccggagccagcgggtgcaaggtcgacggatcggttccggccagatccgtgtactgacagagaggaagccgacgtgaaggttcgtccgagcgtcaagccgatgtgtgagaagtgcaaggtgattcggcgcgagggtcgcgtgctcgtgatttgcgagaacccgcgccacaagcagaggcaggggtagacgatggcccgtatcgcaggtgtcgacatcccgcgtgagaagcgggtcgaggtcgcgctgacctacatctacggaatcggcccgacgctcgcgcgtcaggtgctcgaggccaccggggtcaatcccgatacgcgcgtgcgcaacctcaccgacgaggaggtcctcgcgctccgcagctggatcgatcagaacctgaaggtcgagggcgatctgcggcgcgaggtcgaccagaacatcaagcgcaagatccagatcgggtgctaccagggtatccgccatcgtcgcgggctgccggtccgcggacagcgaacccacaccaacgctcgtacccgcaaggggccgcgcaagacggtggcgggcaagaagaaggcacgccgctaggcgctcatgcgggcacgcgagcgtgctcgcggtgggcgaacgagtggagccagagtctctggctccgagggatgaacgagggaggttccccgtcggcgtggccggcacgggggaaccgaagaggacgcgagctgagcctcgccgagcaaggagcacacagagcgcatggcacgaccgaaggtaggagggcggcggccccggcggcgcgaacgcaagagcatcgcgcgtggggtcgctcacatccactcgtcgttcaacaacacgatcgtcaccatcaccgacccggctgggaacgtgatcgcgtgggcgagttctggcaacgtcggcttcaagggatcgcgcaagtcgaccccgttcgccgctcaggtcgcgggtgagacctgcgccaagcgagcgatggagcacggtgtgcgcgaggtggatgtctacctgaaggggccgggatcgggccgcgagacggcccacaaggcgctcgctggtgcggggatcgagattcgttcgatccgagacgtgacacccgtgccgcacaacggctgccgtccgaagaagaggagaagggtctagatggcgcgctacaccggaccggtgtgccggctgtgccggcgtgagcggacgaagttgttcctcaaggggccgaagtgcatgagcgcgaagtgccccattacccaaggccgggttcctccaggccagcatggtcgggatcggcagcgtcaaccgtccgagtacgcgatccagctgcgcgagaagcagcgcgcgcgccgaacctatggcgtcatgggcaagcagttccagcgcttctatcgtgacgcggcgcggcggtcggggatcacaggcgagaacttgctcgccttgctcgagcttcggctcgacaatgtggtcttccgtgccctgtggggctcctcacgggcgcaggcgcgtcagctcgtccgccatggccacgtcctcgtcgacggtcagcgggtggatatcccgagctatcgcctccggccggggcaggtcgtgacgctgaatcccaaggcgcgtgacctcgacatcattgcgttcaaccgagagcacctgacccgtgaggtcccggcgtggctcgaggtcaccgacggggggtctggagtacgcgtgctcagcgtgccgctgcgcgaccagatcgacaccgaggtccgcgagcagctcatcgtcgagctcttctccaagtagcacgcttctcgaagtagcgaggcagcaaccatcagtcagaaggaaccaaccatgcttgtcatgcaacgccccacggtcgagtcgctcggtgacgaggtcgacaatcgtcaacggttcgccatcggaccactcgagccagggttcggccactcgatcgggaacgcgctgcggcgtgtgctcatctcgtcggtcccgggcgcggccatcacgcaggtccgtttcgatgatgcgctgcacgagttcacgacgatccccggggtgaaggaagatgtgatcgacatcatcttgaacctcaaggacatcgtgtggcgttcgtggagtgaagagccggtcacggtgaggctcgacgttcgtggccccaaggaggtcacggcgggagacttcatgctcccctccgacgtggaggtcatcaaccgcgatctccatatcgcttcggtgtcggagcacggtcggttgggtctcgatgcggtggtcgagcaggggcgcggctacgtgtcggcggagggcaacaagcgcaccaccaccatcggcatcatcgcgatcgacgcgatcttctcccctgtgcgtcacgtcaactaccgcgtcgagccggttcgtgtcggtcagtcgacggacttcgaccaggtggtgctggaggtcgagaccgatggctccgtgacgccacgggaggccgtcgcctctgcggcccggacgctcaccagcttgttcggcctcgtcgccgagctcgcgaccgacgtcaatgcgctcgaggtcgccgcgaccgccgacgacagcgtgcgaccggccgagtacgacctccccatcgaggaactcgagctcacggagcggccgcggaactgcttgaagcgggcgagcatcaacaccatcggtgatctggtcgagcgcacccctgaggatctgttgtcgatcacgaacttcggccagaagtcgctcgacgaggtcgtcgagcgcttgacccagcgcggacttgagttgaggaagagggactgacgtggttccaggtcgaccgaagaagggtaaccgactgggcaaggacgctgcccaccagcgagccatgctggcgaaccttgcggcgtcgctcatcgaggccgagtccatccagaccaccgaggccaaggcgcgagccctgcgcccggtcgtggagaagctcgtcaccaaggcgaaggcgggcgatctgcaccgtcggcggcaggtgttggcgttcctgcgcgacgaggatgcgaccaccaagctgttctcgaccgtggggccgcgctatcagaatcgacagggtggctacgtgcgcgtcttgaagctcggcccgcgtcgtggcgatggcgcccccatggtggtcgtcgagttcgtctgaccggcgctcctcgcgcgaggcggcccctgcgtggtggtcggtctccgggaggtgtcgacgggtaggagcccaggtgggagcagtggagaccctcctgctcgtcgttggctacgacgggcgggagttcgcgggcgctgccccgcagccgggagtgcggaccgtcgtcggtgcgctgcgctccgcgctcgagctcgtgttgcaacgaccaacgtcgcttgcgatcgcaggtcggacggacgccggtgtccacgcgcgtgcgcagctcgtgagcgtacccctccagcccggggagcgggcgcggctcggggatgtggagcgtctgtgtgggcgactcggtcgactcgccggtcgggggctctgggtcaggagcgcaggcgtgctccctgggtccgtcgacgcacgcagggtcgcccgctggcgacactacctctaccggctcgatctcggccatggggaccgtcggggtcgggtgatactcgagccgacggcctgggcgtgtgggccgctcgagctcgacgtgctcgctggcgcgctcgcgacgttgcgaggcgacctcgatgcgaccggactgtgtcgtgccggcgccgcgggaggctatcgtcgcagggtgctctcgacgcgggtctgggcgcgcgcacgagatcgtgtcgacgtctccgtcatcggggtgtcgttctgccacgagttcgttcgtcgagcagtcgggaacgcggtcgcggtggcgcagggccggctcgacggggagcgctggcgcgagggtgtcgaccgaggcgagcgggcgctgctcgcgacggtggcgccaccgtggggcttgtcgctgtggcgcgtcgggctcgaggacggctgggagtggtcggaggagcgactcgcgcgcctggggtcggatgccgactggcgtacgctcgatccgcgcgaagagcccgcggtgtggggcgcagcacgaggcgcagaccggtagactgtcgcggtgcgctcacgcgggcgtctcgctgtgggccgcgcgtgagtgcggcgctcgaggctgaacgcagtgacgagcgtcgatggcgcgggcaccgacggcatggtcggtcgaggcagtggtcggtcgagcccagcggcgtctcgtggttggcgggcccggagcgggttggcgtggaaaggacttcggcggtgaggacgtacagtcccaaggcggctgagatcagccgcacctggtgggtggtggacgcggaagacgtcgtcctcggacggctcgcaaccgaggtggctcgggtgttgcgcgggaagcacaagccgacgttcacgccgcatctcgacatgggcgatcacgtcatcgtcgtgaacgcggacaagatccgggtcacctccgacaagggtgccacgaagcgctactggcgtcactcgggttatcccggcggcattcgctccgagacgctggcggaacggctcgcacgccaccccgagcgggtcgtggaggccgcggtgcggggcatgctcccgaagaatcgcctcggcagggcgatgtatcgcaagttgaaggtctacgccggccccgagcatccgcaccaggcgcagcagcctcgagtcctgtcgctcggtcagccgagcctcgtcacccaaggggagcacgcatgagccagacgctcgttcaggccacgggccgccggaagacggcggttgctcgagtccgtctcgtgccagggtcgggttctgtcatggtcaacggcaaggagctcgcatcgctcccggtgacgctggcccagcgtgcgttcatcaccgaaccgctgcgactcgccgaactcaccgagacctacgacgtcgtggcgcgcgtggacggtggtggcgtcgccggtcaggtcgcggcgctgcgccacggccttgcgcgagcgatcgcggaactccaccccgagctgcgcgtgcgcttgaagcgcgagggcatgctcacgcgcgatgctcgtgagaaggagtcgaagaagtacgggctcaagaaggctcgcaaggctccgcagtactccaagcgctaatgctgaccttcggcacggatggtatccgcggccgagccaaccaggagctcaccatggaggtgggcctctggatcggggtcgcgatcgccgaggtgctcggtggcaccacggtcgcgatcggtcgggacacccgtgcgtccggtcgctggctgtccgaggccgtgggtctggggctcgccgcttcgggcgtggatgtggtcgatgttggggtggccccgaccggggcgctctcgttcgttgcgcgcaccgagcagctcccgaccgtcgtcgtctcggcgtcgcacaatccgttctacgacaacgggatcaaggtgttcgctcccacgggagccaagatcgagcccgccgtcgaacgtgccatcgaggagcgtctcgcgacgcatcttggtggcgatcggccgacgttcggacctctcggccgctaccggtcgtcgtcgttcctggacgcctacgtcgcttggctcgccggtgccgtgtcgatcgagggtgcgccacgcgtgtgcatcgatgcggccaacggtgccgcggcggtcgtcgcctcgcgtgtgctcgaggccgctggtgccagggtcatcggtgccatcggggtcgagccggacggtgagaacatcaacgcgggcctcggagccctgcaccccgagaggcttggccatctggtgctcgcgacgggcgccgatcttgggctcgccttcgacggtgatgctgatcggctgatcgccgtcgcgccgagcggagcggtggtcgacggtgacgacgtcttggtgatcgtcgccgaggcgctggcggccgatggtcggctcgcgggccctggcgtggtcgcgaccgtcatgagccatctggggctcgagcgcaccctcggaccgcagggcatcgcggtggaacggaccggtgtgggcgatcgcgaggtcgctggagggctcgtcgagaccggctacgggctcgggggtgagcagagcgggcacatcatcttccccgcgctcgccccgaccggtgatgggctcctcacggcgctcatgctgctccaggcgctcggtaggctcggcgtccatgccgacgaggccttggcggcccgcgtgcgctacccacagatccaccgcaaggtccaggcacggcacggccgagccgtgctcgactcggagctggtggtcgaggcgctgcgcaaggccgaggagcggctcggcgaggaaggccgcttcgtcgtgcgacccagcggtaccgagccgatcgttcgcatcatggtcgaggcgacgacggagccggtcgcgatcgaggtcgccgagtcgatcgaggcagcggtgcgcctcgcgacctcgacccttggcgactgagcgcggctacgctcggtcaacgaccaggtccgcgcgtggcgcgggcagaaggaggccggtgtgtgcgggatcgtgggagcagtcggcaccggggatatcgcgggtgcggtcttcgaaggcctgcgacgactcgagtatcggggctatgactctgcgggcctcgccatcgtcgacgacgctgggatcatcgaggtcgccaaggccgcgcacgcgcgcacctcgctcgccgagctgaaggacagcgtggatgcgttcgatggtcggggggcgcgtgtcggtgtcggtcatacgcgctgggcgacccatggtgccccggtgctcgtgaacgcccatccccacctcgattgcacccatcgcgtcgcggtggtccacaacgggatcgtcgagaacttccggagcttgcgtgaggagctcctggagcggggccatcgtctcgtctccgacaccgacacggaggtgatcgcgcacctgctcgaagagcagctcgtcgatgaggcgcccgacgtggcgctcgcgtcggtgttcgcgaggctcgtcggccacatggcgatcgcggttgcgctcgccgaccatccggggctggtactggcgatccggcgaaccagtccgctcatgggtgcgcgcagcgtcgatgccgagttcgttgcgtccgacgtccccggggtcttgcaccgtgccacggagttcttcgaggtgcccgaggacgaggtggtcgccatcggtccggaggcggcgggcctgtcacgggctcggcgcctcgaggaactggtccgaccccagatcagctggacgagccaagacgtggaactcggcgggtacgcgagcttctacgagatggagctcgccgcaggcgccgaagcgctgtcacagacggtcgcgtcgttggtcgacgtggacgggtcggcgatcatggacgccctcgacgtcgatcccttcgagctcaagcgcatccgcaaggtcgtcgtcgtcggggccggcacgagctaccacgcgggcctcgtcggccgtttcgccatcgagcactacgcgcgcgtgccggtcgaggtggacgtcgcgagcgagtaccgctatcgcgatccgatcgtcgacgacgggaccttggtcatcgccgtgtcgcagtcgggggagtcgctcgacaccatcgtcgcggtccgtgaggcgatggctgcgggtgcgcgcgcgatcgccatcacgaacgtggtcggctcgcagctcgctcgggtcgctgacggcgtcctctacacgagggcagggcccgaggtctcggtcgcggcaacgaagacccacctcgcccagctcgccgccctcgagctgctcgcgctctggctcggggagctccgcggcgtcttgttccccgaggaggccatcgagcggcggcgggcactcggcgaggtggcacaggcggtcggatccgtcctcgagcagaccgaagcgctcggagcgacgttccgcgagctcgcatccagccaacggttcttcttcatcggccgcaacgtcgccctcccggtcgcgatggaaggggcgctcaagctgaaggagttgagctaccttcctgccgaggcgtacgcggccggcgaactcaagcatggaccgatcgcgatgctcgatcgggaggcggtggtggtcgccctcgttcccgccgaccgactgcggccgaaggccctcgccaacctcgaggaggtcaaggcgcgcggtgccaccctcgtcgcggtggtcgcgggtgaggacgcgcgcgtcacggagttgtccgacgtcgtggtcgaggtgccggcgacgccgccactgctgttcccgttcgtcggcgtcgtgccgctccaggtcttcgccggcacgatcgcgcgcgaacgcggactcgatctcgaccgccctcggaacctcgccaagacggtgaccgtcgagtagggcacctccccgggtccgcgaccgccgtggaccaccagcgggtggcgcctcgcgaatcggctcgactcgaacgtcggggttgcatgctccacacgacgcagcaccgctcttcggagcggtgctgcgtcgtgtgggaggctgcgtgcgtgcgcgctgcgctcagtcggcgagggcgaggccggtcactgatcggcggcgatcggcgatcgcagcgtgcagggtgcggagcgccaccatcgtccacagggcgaccagtgcgacggcgagcccgaccgcgaggtcgtggatcggggagacgtgggtcgcgatcgcgatctcgccaaccccagtcgtgaggacgccgagcgggaaggtgaagccccaccagccgatcgtgaagggataggtgccgcgccgtaggtactcgagggagagggcgccggcgacgaggagccaccagaggccgtagccagcgaggatgagcgcgccgacgacaccggcaccagcgagcgtggtcgagagcgcggacggcgtgagcacggtgagatcgtgaccgagggcggcgatggcggcggccccggtaccgagcgggccgaggatgagccaggtcgatgtggcgaggtgcggtgcggggaggtgatgggtgacgaggcgaagcgtgatgagggcgatcagcgacaacgcaagaggcaccgagaaggcccagaggagatagccgccccagacggcgtcgaccgcgagtgcgtggtcgaaccggggcgcgacgagcgcgagctgaaaggccgtgacctcggcggggacgatcgggaggagccaggttgcgttgacgtcttcgagcgtggcgagatggtgcgcgaagaggcggtagggcacgtagaggacggagacgagggtcatgacgagcgtgaggacgagccacacgcccagcccttcggtcgtcgcggcgtgggagcccagcacgttgggttcgagcttgtcgatgccgttcgagaccgacgacatcgccatcggcacacatccaaggaacagcacccgtgcagggttgtcgaggagctggcggaggcggaggcggtgccgggcaaaggtgatcacggtgatgagcgcgagtatgaggaggccgatcgcgttggcgacgacgatgatccggccgatggtcgtcagggcgggcgagatcgtcgggagcaggacaccgacgatgccggtgcccatgatgagcgagtagtactcgaagccgagtgagggcaaccgtcgagcggtgggccgagatgcggtgtggttcatcgatgctcctaccgtgggttggaagtggtttcgtgctgtgaactatcatggcggtagcgaaacgaaggtatgctaaaagtaatgaaacttactgattccatcactgagcgaatgattacggtcgacgagcgccggatcgatccgacgtacctcgtgacgctcgccgtggtggccgagacgcacaacctctcggacgcagcgaagatcctcggcatctcgcagcccggcgtttcgcagcagctcaagcacctctccgaagccgtgggccagcgcctccacgtccgctcgggtcacggggtcgagctgacggtcgcgggtctcgatcttgcgcggcgggctcgtgacgtgctgcgctcctggcgaggcgtgctcgactacgtcgagagcgtccgccagggcaacgacggcatgctgctcttggccgcgtccaacaccgtgtctgcctacgtcgtgccccgctggctggttcggttccgccagcgctatcccggcgtcgacctgcggagccgttcgctgaactcggccgaagtcgtcgagcgcgtcatcgacggcgaggccgaggtgggcgtgatcgagtcaccggtcgagtcgttgccccctgagctggtcgagatcgtggtgggcggcgatcgcctcgtctacgtggtcagtccggcagtggtcagcttcgcgaacaaccaggtcgtcggttggggcgaagtggcgaggatcccgctcgtgctgcgggaagtgggttcgggtgttcgacgcgccagtgagcaggcactgcgcgctcgtggactggccccccggctcgagctcgagctcgctggcggtgaggcggtcaaggaggcgatcctccagggggtcggcggtggcttcttgtcgtcgctcgcggtcgcgcgcgagctcgcgaccggtgagctggtcacgctcgtcattcgcgagctcgataccatcgctcgactgtttcgcatcatctgtcggcccaaggacgacctctccctgccggcgcagcgctttctcgagatcgccgaggcggtcggcgttgcggagccggtctagatgcaggtcgtgaccgggatcgacgtggtcgaggtcgaacgcttccggacggtgctgctgcgaacaccgaccctcgccgagcgcgtcttcaccgaggccgagcgcgacagcgcgaagggtcgaccggcccagctcgcggggcgcttcgccgtgaaggaggctgcgttgaaggcgctcggcgtcgggatcggtgcggtccccttgcgcgaactcgaggtggtgtccgatccgtcgggggcgccgcgactcgagctcggccccggggcgcgagccttggccgatcgacgaggctggtcgtcggtgagctgttcgatctcgcacgagcgttcggtcgcggtggcggtggtggtcgccttggtggtctgatcggaccgatgccctaggcttggcgctcggcccggaggaggccgccactgggcgatcactgggccgccactggggaggtgtgcgtgcaaccgatcgtccgacgtgctggcgtccgagccctcgacgagcgactggcccgcgagggcctcgtggacgcgacgatcgaacgggtcggccgcgccgtcgcgcgtgagctgcgtcgatccaggggagggctctacggtacccgcgtcgtcgtgatcgccggtcccggtaacaacggtcgcgacggcgtcgccaccgcgcgagcgctcgcgggctggggagcgagtgtgcgggtggagtcccttcgcgacgtggtggcgggcgcggcgaccagcgccattggcacctgcgacctcgtcgtcgacgccgcactcgggaccggtccggcgcggccgctctcgccgctcggcctcgagggcgtccccgaggtggtcgccatcgacattccgtcgggtatcgatgccgacacgggcgaggtgacgggggcggacctcggaggcgtggccgtcgtcgcccaccgcacgatcaccgtcggggcgctgaagcccggcctcctcgtgggggaggggccggagcacgccggtgccatcgtccgcgtcctcgacgacctcgtgcccgaggacgtggatgcctggctcgtcgagcgcgacgacgtcggccaggtgctgccgaggcccggacgcgatgcgcacaagtggcgcagtggcctcttcgtgctcggtggctcaccgggcatgcgcggcgccccggccttcgtcgcgcgcggggcgcgagccgtcggtgccggcatcgtgcacgtgctcaccaggagtgagcccatggagtccgtggcgctcgagatcgcgcccgaggtcgtcgcgagacgtctggtgaccggccacgtggatctcgcggtcgccgaggctgagcgcttcggcgcggcggtgatcggacctgggctcggtgacaccttggcgagcgcgaacctcgtgcgtcgcgtcgtttccggtctcggggtgcccttcgtgctcgacgccgatggcctcacgtcgctcgcgggcgagggtcgtctggcatcggtgctggcccagcgccgcgcacccggcgtcatcacgccgcacgacggggagctcgcccgggtggccccgcaccttggtggtacccgtatcgagcgcgcgaagggcgcggcggccgagttcggcgtcgtcgtcgtcgccaagggcaacccgaccgtcgtcgccgctcccagcggcgagaccatggtggtcgctgccgggacggcacggctcgcgagcgcgggcaccggcgacgtcctcgcaggcgtgatcggcggtctccttgctcaggggctcgatcccctgcgtgcggcgtgggcgggtgcgtggctccatggcaccgcgggcgcgcagcttgccatgcgcctggccgcaccgacggcgctcgcggatgcgatcggcaggctcgtcgcccagatggtgccgatccccgcccatccgggggcctccgtggaggcgcgcccgtgatcggccatcgaccgacggaggcgcggatcgatctcgagcggctgcgtgcgaatgcgcgtctgctcgccgagcgtgcagctccggctgcgctcagcgccgtcgtcaaggccgatgcgtacgggcacggcgcgagcacggtcgctcgcgccctcggcgatctcgtcgacgccttctgcgtcgccaccgtcgaggagggcctcgcgctgcgtgccgcgggggtcacggggcgcgtgctcgtcttgtccgagcctcccgagtcggccgtgtcggcgtgtgctgcgagttcgctcgagcccttcgtcgagcacgagcgcttcgtggaggcgttggcgggggcggcctcggcgctcggccgcgaagcctcggtccacatcgacgtcgacacgggcatgcatcgaagcggtgtgcacccggcccaggcggccacgctcgccgccagtgctcgtcgccacggcgtgcgcgtcgtcggggtcgcctcgcacctggttcgtgcggacgaagcgcccacgcatccgacgacgctcgaacagctctcgaggttccgcgaggtcgcggctcgtatcggggcgcctgagcgacacctgctcgcgaccgggggactgctcgcactgcccgaggggcgcttcgagcgggtgcgcgtcgggatcggcctgtacggctatggacctcgacgcgacgatgtggcgggactgcgtccggtgctgcggctcgtgagccacgtcgttcgcttggaggcccttggcgccggtgaggcggtgtcctacgggcatcgaaggccactcgacgtgcccgccgaggtggcgacgctgcccattgggtacgccgatggcgtgcctcgcgccgccttcgacgcgggcctcgccttctgggccaagggtgtccgactgccgatcgcaggcacggtgaccatggaccagaccatggtggcagcgccacgggggctgctcgccctcggcgatgaggtctcgctcatcggggacgaggtggatgcctgggagtgggcggacgtgctcggcacgatcccctatgaggtgctcgcgcggctcgggccgcggattccgagggtggtggagcatgggactgcctgagctcgaggcgctcgaggccgaggttcgcgcgtgccacgcctgtcgcttgtccgcgggtcgtcatcaggcggtgcccggcgagggcgccgcgcccgcaccactgctcgtcgtcggcgagggtccgggggcgcgcgaggacgaactcgggcgccccttcgtcgggcgctcggggcagctgctcgatgccctgttggctgatgagaccggcctcgatcggagcggcctctacatcgccaacaccgtcaagtgtcgccccccgggcaatcgcacgccgaggccggacgaggtcgaggcgtgcaggggcttccttgcgcgccagatccacctggtcgatccggtcgtgatcgtcgcgctgggccagagcgcagcggcgtggttcctcggacccggcgcccgcgtcggcgcgctccgtggccaggtgctcgagtgggaaggacgagcgctcgtcgtcacctatcacccatcggcggcgctgcgcggcggtgcggccatcgtcgccgcactgcgcagcgatctcgcccgcgccagcgtggcactcgcggagcgacgtcgatgagcgtgccagggccagcccctcgtcgcgaggagatgctcgtcgacgccgaggcgaccgagcggttgggggagcgcctcggtgtcgagatgccgcccggtgcgatcctcggtctctcgggcccgctcggagccggcaagaccacccttgcccgtggtgcgctgcgagcgctcggcgtgcgagaggcggtggtctcgccgacgttcctcggcttgcggcgctacagcacggccgattcgggcatcgtgtaccacatcgacctctaccgcagcgaggatgcgacctggctctggggcgagggcgtcgacgacgacctcgacgacggcgcgcgtgcggtcgtcgagtggatcgatcgtgaccggcggctcgcggccgacgcatgggccatcgtcgagctggacgtcgtcgagctcgacgatggccagacgggccggcgcgcgcggattcggaggcaccggtgagcgccgacgaggtgacgctgctcgcgctcgatctcgcgacgaggccgagcatcatcgcagctcgggtcgctggagtgacgcaggcggtgcgtggtgtctccacgcacccgctcgccgacctcggcgcccgcgtgcgcgacgtgctcggccaggcgaccccggaggtggtgggcgtggtgaccgggcctggttcggtgctcgggctgcgcgcaggcgccgcgttcgtgcggacctacgcgagcgcgaccggtgccacactcgtcccgttgcacaccggtgaggccgtcgcggccagtgtgcccgacgagccggtgctctgggtggtcgcgcccgtgggtcgtgggcgcgtgagcctggtggcgaccgagcgtggtcaagtcgtatcggaagcgatcgtcggtgtcgaggagctgcggatcccgcgtggcgagccggtcgcggggccgggtcttgctcgcggactgatcggggaggggcgatcgaccggcgtcgtcgagccgaccggcaatggtctcctcgccgccctggtgcggcggtggcgagcgggcgagtcggcagatccccattcgctcgcggtgcgctactcggtggacgcgggggttcgcttgccgcgacgcttcgcagagggcgggggtcggccatgatgacggtgcggccgatgcggcccgaggacctcgacgcggtgctcgcgatcgaggagtccgtgtcgcgcgtgccctggagccgacggtccttcgtggacgagctcggtgccgagggacgcctctggcgcgtcgccgacgagggcggcgtcgtgcgtgggtacgtcggcgcgctcatcgtcgtcgacgaggcacacgtcctcaacgtcgcggtggcgcgagaggcgtggggtcggctcatcgcgacgcggttgctgctcgacgcgctcgatggcctcgatgcgctcggggtgcgtgactgcacgctcgaggtgcgcgtctcgaacgcgcgtgcccaggcgctctatcggcgtctcggtttcgctccggtggggctcagacgggcctactaccccgacaatgacgaagacgccatcgtgatgtggctgcgcgatctcgccgcaccggcatccaaggagcggttggccgcggtccgcctcgacctcgaggggggtgctcgatgacgagtgcacgcagcctggaccggctcgagctcgtcgacgcgggcgtcgtgctcgcgatcgagaccagctgtgacgacaccgcggtggcggtcgtggccggtggtcgggtcgcggccaacgtggtgcgctcccaggccgcgctgcacgctccgttcggcggggtggtgcccgaggtcgcggcccgggctcacgacgccgccatggtcgaggtcgtcgaggaggcgctcgccgagtccggcatcgacgcgcacgaggtggaggccatcgcggtgaccaagggtccggggttgccgggatccctggtcgtcggcgtgggcgccgcgctcggccttgcggtggggctcgatcgaccgctcatcggtgtcgatcacatggagggccatctctacgcagccaccatcgaagggcccgtcgccctgccggcgctgagtctgctcgtctcgggcggacactccgagctcgtcgtcatcgaggcgccgtttcgctatcgcctcctcggccgcactcgcgacgacgccgcgggcgaggccttcgacaaggtcgcgcgcatcctggggctcggctttccgggaggccctgccatcgaggccgcggcgcgcgatgggcgtcccgacgcgattcgctttgcccgggcgcttcgcaaccaggggttcgatctgtcgttctcggggatcaagacggaggtcgctcgctatctcgaaggggctcgggcggccgaggtcgccgacgtggcggcctcgttccaggaggccgtcgtggacgtgctcgtggccaagctcgagcgtgcgctcgagagcgagcgggtcgagaccgtcgtgatcggcggcggggtcgcggcgaacgggccgctgcgcgagcgggtagccgagctcgcgcgagcaaggggtgtcggcgcgcacatcccggccaggagcctctgtgccgacaacgcggccatgatcgccgctgcgggtgcggcacgcctcgtcgccggcgagcacgcggtcgatggtctcgacatcgagccgacacgaagcctcgtcggaggtgacgaccattagcactcggcatgctagagtgctaatggtcgctgacccacatgccagtccactcaccgatcaaggaggcatgagcatgaacctgcagccaatggaggaccggatcgtcgttcgtccggccgagtctgaggagcggaccgcgtccggcctcgtgatccccgacaccgccaaggagaagccgcagcagggcaccgtgctcgcggtcggccccggcaagcgggccgagcagagcggcgagctgatcccgctcgacatcgccgtgggtgacacggtggtctactccaagtacggcggcaccgagatcacggtcgacggtgaggatctcctcatcctctcgagccgtgacgtcctcgccaaggtggtgaagtagcgatgccgaagatcttggagttcgacgagtccgctcgtcgtgcgctcgaggcgggcgtcaacaagctcgccgacaccgtcaaggtgacgctcggcccgaagggccgcaacgtcgtgctcgccaagagcttcggcgcgcccacgatcaccaacgacggcgtctccatcgctcgcgagatcgagctcgaggaccccttcgagaacatgggtgcccagctcgtcaaggaggtcgccaccaagaccaacgacgtggctggtgacggcaccacgaccgcgaccgtcctcgcgcaggcgatgatccgcgaggggcttcgcaacgtcgcggctggtgcgaacccgatggccctcaagcgcggcatcgagcaggcggtcgcggccgccgtcgagtccatcgccgagcaggccaagccggtcgagggccgcagtgacttcgcccaggtcgctgccatctcggcagccgatcaggcggtcggcgaggtcctcgccgaggccatcgacaaggtcggcaaggacggcacggtcaccgtcgaggagtcgaacaccttcgggctcgagctcgagttcaccgagggcatgcagttcgacaagggctacctgtcgccgtacttcgtgaccaaccaggatcgccaagaggcggtgctcgagaacccgtacatcctcttctacgcgacgaagatctcctcgatccacgagctgctgcccgtgctcgagaaggtcatgcaggccggtcggtcgttgctcatcgtcgcagaggacgtcgagggtgaggcgctcgcgacgttggtcgtgaacaagatccgcggcaccttcacctcggtggcggtcaaggcccccggcttcggcgagcgccgcaaggcgatgctgcaggacatggcgatcctcacgggtggccaggtcatctcggaagaggtcggcctcaagctcgagaacgtcacgctggatctgctgggccaggctcggcgcatcgaggtgacgaaggacgagacgaagatcatcggcggcgccggtcagaaggcggacgtcgatggtcggatcgcccagatccgtcgtgagatcgaggagaccgactccgactgggaccgtgagaagctccaggagcgcctcgccaagctcgccggtggtgtcgcggtcgtcaaggtcggcgccgcgaccgaggtcgagctcaaggagaagaagcaccgcatcgaggatgcgctctccgcgactcgtgcagccatcgaggaggggatcgttgccggcggtggcacggcgctcattcgcgctcgggcgcgcgtgaacgacgtggtcgccaagctcgagggtgacgaggcgacgggcgcgaccatcgtggctcgttcgctcgaggagccgctcaagtggatcgcctacaacgcgggcatggaaggcccggtggtggtccagacggtcgagcacgagtcgggcaacgttggcctgaacgctcgtaccggtgtgtacgaggacctcgtgaaggccggcgtgatcgacccggcgaaggtgacgcgctctgcgctgcagaacgcagcgtccatcgcggccctgctgctcacgaccgaggcactcgtggccgacaagcccgaggagccgggtcaggcggcggccggcgctggcgcagccggcggcatgggcggcatgatgtaaggcgagccacgctcgtcgcacgaggggagggtccgcaaggatcctcccctcgctgcgttcgtggcagcgtgcgatggtctcgagggcggagaccaagccgttggggcgcgcacgggcgccgccacgatgggaaccagtcgatctcggtcagccgatcgtggccgaacgatcccgggagtaccagcacgacgacgctcccgaggtggttgtgccctctggagcatgtgccgaccatgaccccaggtcgccgggcgaggtgacgaagacggcagctgcaaggtgccggtcgggcatgccggtcaggagcgcttgccggtgagggcttcttggagctcggcctctgccttcgagtccaggctcgagcgcaagacggtgccgccgtagcggctgagtgcggcgatcaccttgtcgctcggtacgtgctcgaccatcaggaagagcgcggaggtgcccggttggacgaggtcgcgtacccgttcggcgaactctcgattgacgagtgagcggtcgatcagaccggtgagcccgccgagagccgcgccgaacgcgacgccgagcaccgggacgaagaacaggaagccgaacaggagcccccacagcatgccccaggtggtcgcggcgccgacgacgtggtgattcgtctggacgcggaaccgaccgtcgctctcgcgcacgatcaccgccacggcgtccggttggatgaggagctcatcggtgagctcctcgatcgtctgagcggcttgggtggccgtgtcctcgtcggggtagccaatgaccaacagatcggacatcgcgtcctcctcgtgagggtcgttcctgtgaggaccttagccctttggaagccttctggaccattcccgccgagggcaggggtgtgcccgcggtgcggtgcgatgacccgtgcaagctcgcacgggtgcttgcgcgagcgcctctgcctcgagggcagtgacagcagaagatcatcaaagcgtgatgcggtcgggaggctcgccgtctccaagggttgaccgaggggactcaatcctcgcccgactcgagccgatatggctaccacgatccagatcgcacggattgtaacgttgcaaacacactgcgcgagcaaatggtcgctggttactgcggtatggtcaggtggcgttcgggtaggtcgcagcttccgggcattcgtggctgggcccgtcgatcgggctggtggcgggtgcggagatgctgctcagggggtagctgtgaggttgcgcgggcggttcgaggatgcagacgcatggagctggtctccgttggctgtcgtcgagagccgacgagaaggagtgaggtctgtgaggagcgtcgacatgtcgtccgccggcggtggcgacgacgaggcgagaaggagtgaggtctgtgaggagcgttgacatgggcaggagcgtgcagctgggatcggctcgggcgggcgcggtgcgagtcggactcatcgtccttgtgtcgggtgcgatggcggccctcggcggcggcgttgcgctggcgagcggcagctcgacgccgtctgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagtcgtccccgagtgcaccgacgccagcggcgggtttccaaacgactgtgctgtcgcaggtcgtcgcgccgtcgtcgtccacgcagacggtgacggcgacggctgatggcgccaatgtgtcagtggtcgttcccgcaggtgccttcggcaacacgacggtcaatctcgtcgtgaccgagcccacactgtcggatctcacctcgacgctgtctgcgctcggcctcggcggatccaccttggcgaccggtgtcggggtcgaggtggtcgacgctgcgactggccagccgctgaccggtacctttgcgcagccgctgaccgtgacgattacctcgagcggcatcacgagtgcttccaaggtcatcgagttcccgacgagtggttcgcccttcgtcgatagttctgctgaagtggtctcgggcaaggcggtggtccaggtgtcgagtgaccctggcttcgcagtcgcgacgcccacctctgcttcggtgccggcggccacgtctccggtgaccggtaaggacttcttgccggtcggcatcgctggtggcgtcctcgtcgtcggcggtgcggccctgatcgtcgcttcggagcgacgtcggcacgcatgagtggtgtgagaacccctcgggggttcctgcgccccgcggcaggtctggttgtcctcgcgggcgtcctcgcggcctgtgggtccaccgcgtcgtcgtcctctgccccagcgagtggttcgtcgacggcacatcgcgggtcgatcccggtcgcgatcgtgccggtgagcgcgggagcgctctcgctggggccactgcaggcgaatggcgagttctccgtcctggcagggacgccgtcatcgaagggcgtcttcacctaccagctcagcactcggcgcgaggtggccagtttctcggtgtcgaatcaggcaaccgcgatcacccagttgccaaacggcgtcatcgcggtcgggcttggtacggggtctgtgggcgccgtcgatctcgagagcagcagtggccaacaactcgcctcgatccccgtcgctgctccggtgcggggcctcgccctcggaacggacgggtccacgatctacgtgttggagggcaccggatcgacacgggcggttgccgtcctcgacaccgcgacgaggagcgcagcgacgaccctgcccgtcaatgctgacaccgtggcgatcgcatcgtcgccgacccagcaggagctctacggtttggagagtactggtgcactggacgtgtactcgacggcgacaggccaacggatcggtaccttccccgtaggtcactcgggcgtcgccgtcacgccgtctcccgacgggactgccctgttcgtgttgaagggcgtcggcggggtgcgcaacgtcgcggtggtgaatctctcgacggagggggacgtgcgagccatcggcgcgccggctggcggcatcgcgatcgcccccaccctgaccggtgccgatgtcctggtgctcgcggtggggccggcgtccgcgaacgttcaggagttgcccacgtcgtgaggacctctccgctccaggcgacggccgacgatccgacgtcgccacgacacggtgtccgagtggaggctgcgacgggcacctcgacgatggcctggttgttggcgggagcggtgctgatcctgtggggccttcgtttcggggttggggtcgccgagtcggctgggttctcgctcgccgatgtggtcatgatcggggcgggggtcgccatcattgccggctcgccagccatcgcgacgcgccctcgcctgcactgggctgtgctcgcgctcgtggttgcggcgtttctggcatgggcgacacagcaagtcctgatcgcgcccgcctacgcgacggacgagctcgcgttcgaccagtacgccgcccacctcgtactccagggggtcgatccctaccgagtctcgatggcggcggcatttgcgcgctaccaggtctcgccgaatgcgtttaccctgcgcttcagcggacagccggtgacggccctctcgtaccccgcacttgcattcctcgcttacgtgccgctcctggtcgccggcatccacgcccaagccggcacgatcgtcgacgcccttgcgtgggcggtgacgatcgtcgtcacgttcgctgcggtgcctcggagctggcgaccgttggtgctcgcattgctcagcctttctgcgggcgtcgcgtatgccgtcggcggagtcacggacgctctcttcctgccgttccttgtcgcgagtgcagcgttgctgggacgcttcgtccgcggcgattcgtggggctggctcgcacccgtcgcgctcggtctggcgatggcggtcaagcagacgccgtggctcgtggcgccggcactcgcggtggtggtcgtgcggtgggcgcgcagcagtcggtcgacgtcgtgggcgctgggtcgcctcgcgtggttcgtcggcttggcgactctcgcctttctcgtgccgaacgtgccgttcatcctccaggatcctggtgcctggctccgtggggtgctcaccccgctcgatgcgtcggtcgtacctgcgggccaagggctcgtcgcgctctcgacagcctttggtatcggggccgggggcttcgtctggctctcgcttgcatccgtggtgcttctcgcgggcggcacggcactcgtgtggctgggatggccgcgttgtgcgtggtgtgcctggctcgtgccggtggtcgcgctcttcttcgcgacgcggtcgttcggctcctactacgtcaacctcgtgccgcccgcgctcgtggcgcttgcacgttggccgcgcggagccgcgcccctgccacgtgtgtggtatcgctgggcactcgtgacgggtggggtcacggtcgtgtgcgctttggcctgggtgcgaagcgcatcgccgctctccatcgagatcaccggtgtccacacctctggccagctcgcgaccgtcgcgcgcgtcacgctgcgcgtcacgaaccgctcggatgcgacgctcgcgcccgcctacgtctcctaccttgcgggctcgtactcgctcccatggcagctcgaggcaggccctcgggtggtggcgccgcacgcgagtgtcgacgtgacggtgggtgcgccgaacttcccggcccaaccctcggtggccggtgggttccagatggtggcactcgcgggccatgccatcgccccgagcgcactgtacgagcccgggctccttcacgtggcgctggtaccggacgcggtgaacatccccgtcgcgctgggtcagcaggtggtgctccacgcggagctgctcgatcgcttcgatcagccagtgcgcgaggcgggtgtgccgatcttcctcggtcagatcatctatgcgcagcgtggcctgctctactcgagcgcttcgatcaacggtgccgctccgggcgcaactccggtcgaagagctcactggtccgaatggggtcgcgacgttcgtcatcgtcgaccgagctgcagagcccgatccggtgagctttgaggcaaacctggtctcgacgagcgggtactacccctatggctactcgcagatcgtcccgatccggttcgagaggagctgagatggcgaccggggtcggggcgccagatgacgctcgtgtgcaggggcgcgggcgatccatcgcgcgggtgatgggatgcgcgactcggctgctcggctggtggcgtgacgggggtccggcgctttgggtggcctggggattcggactcgcccaattggtcgtggtgatcgtcctcgcggatcgcctcgtccgcgccggggcgctctcgatcgactacgcgatcgaaggcggcgggttctctcagatcgccgctggccacctcgacccgaccgtgtggcttttccagtacgtcaagcccttcatcgacaaccacgaggtcttcctcgactggcccctcgcgctcgtgatcgggctcgtgcacctgccggtggtttggacgctgctcattggactccaggcactcccgatcgctgcaatcggcccgctcgtcgcgtcgtatgccaacctgcgtggacgtgagctcggattctcggctcggacgcgcgcgctcgtcacgctggtgccagctgcactcgcggcactcgatgtctggcagtactggtcgacgacgttcgactaccacggcaaggcgctccaaggtctcgttctcgttgcggcgctgatcgtgctggagcgccgacggcgggcgtggtccattgtgctcgtcgcgacgctcgcactcatgggcgatactgcgtcgtacgtgctcgccgtcgtcgcagtggtgcttctcctcgagcgtcggtggcgcggcggcttggccgtgctggcgacggcggttgccgtgctcaccgtgccctctctgctcgggttccacattttgtcgctaaccgggggtctctatagcccgctgacacccctccaggcgccgacctatgacgtcgtcgttggcgtcctcaagcatccgggcttcgcgctcggccgcctcgggcgccgcctcccagacatgtgggccctcctcggtggggcggggatcctcggcgtggcctccgccatggggatcgcggcaatggccgtcatcgggccggtcgtctggctcggcattgcgcccctcgggtacgcgggcgtcttccaactcgtgccgctcaccgacgtcctgctcctcggcgcagcggtgacgctccttcgtgtcgctcgtcgtcggccgcgccgtgccctcgccatcggcgggttcgccgtggcgtgggcgtttggctggttcgtggtgttcgtcccccatctcgtggcatccatccgcgcgatcgcgcctgccgacgtacgcaccgggagcacgctcgaggcgctcgcgacctcgatcccgccgggccatgaagtggttgctccgatctcgatggtggggctcgttgcccaggaccatccgctcgtgtggagctatcggtgtcggacggggccgatctcgatcccgaccttcggagtcccgctcgacatcgtcgtggctccgggggttggcgtcgacacctgcagccccggaacgctgatggctgagctggctcgggtcgcggcgttgcccagtgcgtccctccgcgtgctgcctggtgatgtctacgtcgtggagtatgatccaggcccgggtcgagggagcctcgtcctgtccgatgcggcgccgatgacaggccgagagctcgctcccacctttaccaagggctcgacccagctgctcccgggcggagcggtcgcgctctcgcctggtccgctcgcgctccacggtgtgaccgcagagctcgccccgggtgctgctggagaggctctcgtgcgcctcgaggccgagggatccgtgagcgtgcaggtgtgggatgacgcgtcgggtcagttgctcgcccgtgaggagctgggcaccacgaccggggccgagacgctcgcgatccccttcgtcgtgccccaccggttcatccccccggctgcgttcagcgacggcgtgtggccgttcgtcacacgcttcctccccccgacgcgctcggacgccgtcgagctccgtgtgagcgtcgggccgggttcgcaggtggcggtcgccgatgcctggatcggccccgcctctcaggcatcgaccgtgttgtccttcccaggtctcgttggtcagccggcactgccgtagggtggacacatgagggggaagggccggggagcgcacagccgacagcgaggtcggggaatcgcgatcgtaggggtcgtggcgatgctcgctggtctcggcctcatcggctcgatcgtcgccttctacgtgcgctcctcccttgtgggtggcggactcatccagcaagcgcagaaggcccggacggtcgcggcgtggccgcgatcgctgctcgcgatcgtgcgtatcccctcgatcgggctcgtcgcgccggtggagcagggcaccggccagtcggtgctcgctgtggcggtgggtcatctcacgacgagcgcgctccctgggaaaccaggcacgtcggtgctcgcggcgcacaacgtcagctggttctcgggcctcggtggtctcggctcgggatctctcattgaggtcgatacaccgtacgggcagcaggtctatcgtgtggcctggcatcgcgtcgtgcacgtcggtgcgcccgtggccaacaccgccgcaccgactctggtgctcgaagcgtgctggccgctcaatgcgctctacttgacgcccgagcgctacctcgttggtgccaccttggtggcgacgacgaagatcgcggtcacgccggtcacgccgtcgtcggacagctaccagccgctcgggcttgcgccgacgctcgcgcacgagaacctctcgctcgcggccaacgacctaccgatgggggtgctcgccaccgttggctcgcctgctgcagcatggacgagttcacagcgaccctacaacttcgctggagcggaagtgacgtggaccattgcgttgttgcatgcgctcgaagctcacgacctcgtgctcgtcgaatcggtgacccacgagccagcaagcgtggtcgcaccattgctcagctgggacggaggcttcgcgagcctcgacgacctcaccgaggtcgtcgatggtgtcacggcgtcggctggctcctcgcgagtgtcgctccagaccgatcacgggccgctcgtcgttaccttgcgttttcgggtcatcgggcatggggtcgaggtagctggcgctgcggtcgggacgtcgcagggctcgtagcccgccgcagtgaccgcggcgggttcgtgcccccgggctggtggctcggttggcgagatcctcgggcgcgcgaacggcggtgtcgtcgcgctctgatggtggcgctcgttgttccagattgctcgacgggcaccgagcgcccggcgacgacctcgatggtcggtgggtcgtcgatcgcttcggacccggtcgaggcagctcgtggccggacggatcgccgtgatcagctcgggcgttcgtcgtcgaggttccgtgcgcacaccggccgacgaaggtcgggtcggctcacgtagcctgggggtcatgggtgaggtggcgtcgggcgggctgtgggatctgcaccggtttcgccagcgcatcgatgagccggagcgccgacttcgccttgtgtggccgtctcgtgcggtggacttcggaagcctcgacgaggcgagcgtacgacgagcccttgcgccggccccggcgagccgcggcggcgtcagtgcagcggtcttgattccgatcgccttcgacggcccctccggcccggaggttctcgtgacgcggcgtgcgcgttcgttgcgtcaccacgctggtgagatcgcgttcccgggaggacgggcacgcgcgggagagacgctcgtcgagactgcacgcagagaggccgaggaggaggtgggcctcgaggcgagtgctgctcgcgtgctggggtcggtcggggttggctacacccgctcgagtgcttacgcgttcgaggctctggtcgcggcggtgccgcgtgagacgatgctcacgctccaacccgatgaagtggagatggcggcgtgggtcccactggcgacactgttcgggccggagcgagctgcgagcgaactgtggtacgacgaccgagcgggttggctccgagtctggctcttcgacctcggtgatgacctcctgtggggagcgagcgctcgcgtcgtcgcggcgctggctcagtgtctcggcgcgacgtagagcgcctggagcaccgcgccgatcacaccgtcgtcatcgagcaacgtcgcgcgcgtgaggccaacaccatcggcgtcgatgaagctccgtgccgaaacggcgacgcgcgtcgtcgcgggctcgcgaacgaagtcgatgtggaggctcggcgggatgaagagccactcgtcgaaggcgaggtgggtcgagatcccgttcgcaacgtcagcaatgagcgcggcggcctcgagcggtgtcatcggctcgcctgcgacgaggtggatgcgcggcgtggcccagacggtcgcgggacctggttgggcgaaggagccgtcgacgaagcgccagtcgatcgcggcaccgtacgggaaactgtccatgatcggatcgcgatggccggcctcgggagccggcagcttgggtgttggtacgtgcgttggcgctcggccccgctcggtggcgaagaaccagcctcgtgcttcgaacgccacgcggtcgccgacgcgcgcacgcatgcgtgcgaggcggacgcgtcgtccgtcgcgagtgagttcgcgttcgatgcgcagtggggcgatcggtacggggccgatcagatccacgtcgagtgaggagagccgccagctggcctctggaacgatgcgccgcagttcgtggaccgcgagggcagccgggggtccgccgtgggtggcgttcgggtcccacggtccgacggcgtggttggtcggttcgatgaggtcgtcgtcgatcctgcgaaagaagctctcgtcgctcacgagcctcgagcctacgtcgcatcccacgccgctcttgcgggggctagtgagggtgctcagccacccagaggccgatccaggcgagtagggagcccgcgaccaccgtgccgagcatgttggcgagtgaacgcgtgagctggcggcgtctggccagggccagcgactcgaccgcgagcgtcgagaaggtcgtgtaggcgccgatgaatcccccgtcgatcaccgtcgcgaggttggctgggaggaggccgccgagcgcgagaccggtgacgagaccgagtgcgagtgagcccgacaggttgatcgtgagcgttccccatgggaaggtcgcttggggcagcacccgacccatcagtactcggtcgacggcccagcggacgatcgcgcccgcggcgccggcgatggcgacgagaacccaggtcacgagcgatgggcgatcccaaggcgccgcaacgtgctcgggaactcgatcgcgagcgcccgcacgccgtcgccgtcgagccgctcaagcagtgcctcgatgcgatcggcctggtcggcgatgacgatcgcgatgccttcgtcgtcgtcgagggacagcagcgtggagcgtcggagccgcaggtgctcgccgaagctctcgacggcccgaaaggcggttgcacccgcgaggccgagatcgagggctcggcgcatgacgtggtcgacgacggcctcgtggccgatccgatcgccctcgttcacgaacacgatgacacagcgcgcctcgtcggacgtcatagacaacctccctctatcccaggggctcgacggcgctgtgagcgggcgtcgagcagcgcggtcgtcgctgcgcggcctgcgacgaccgcgaggaggccagctgcgatcgtgagtgcaccatagagcacggcggacccccacgcaccgcgatcggcggtctgggcgatggcgagcgcgagcgacgacagcgtggtcaaaccgccgcacaggcccgtcgccacgagcagccgaagacgccgtccagaggtcggcgcgaggcgctccgcgagcgcgaggaccccgccgatcacgaaggcgccgaggacgtttgcggcgaggatcccgagtggaaacgacggggtggtgtcgaggacctgctcgagccagacccgcgtgagcgcacccacggcgcctccgatccccacgagcgccgcgcgccgcgctcgtcgcgcatggtcgccggtcatgggatcgatgcctcgaggctcgcgatgcgcgcgtcgaggcgggtcagctcctgggcgcgctgggcaggcggttcggggccgtcgagcaccagggcgcgcgcgagcgccgtcgctgcgagctcgagcctgggcgccgacggggccggcgcgatgaaggcggtggcggccgagctcaaggggtaggcggactcggtcggcgtgcgcgccgtctgggtcgcatccagaatgctcgcggcctccggcgaggtcgagttctcgaggaacgcgaggcatccgaccgtaccggcgcaggtggtcgagacccgcgctcggatctggctcgcggtgacgcccagcgtttgctggagccagatcgcgaccgtgctccctgcctcgatcggggcgatggtcaccggtaccggcgggagcgagagggacgggttgaggtgcgcgatcgtggcgtcgtcccagacgctgatgcgtccggtcacgaggtcggcgagcgcggcctcgctcagcacgagtccggtcgtcgccccgaggttgaccgaaacggtgagctcttcgggagcgtacggccagggcgcgagcccactctgggccacgatgctcgccgccggggcgaggctcgcgacgaccatctcgtcgtgcgtggtgacgagggagctagcgatctgggcgagcggcaccgtctggatgctcaccgacagggccgggtcgtcgcggcgcacggcgcgcacggcactctcgagggccgggagcgcacccggatcggcgagcaccgtgaggtgggtcgcgccgaggacgctcgcgagccgctgcgtcgccgtcgtcgaactcgacgacgggctcgtggtgccgcacgcggcgagcacgaccgctccgacgcaaggcgccaggcgcgccgccaccgttggtcgcatcaccctgtcgacgcctcccaccgcgtagactgcgagtcgcagtctacgagcgcccctgggggaaagcgtgagagacgcaatcgcacgacgtcccagcgaggagggtggttaccgtggcggagatcgagatcggactcgggaagtcgggccgacgggcctatgggttcgacgacatcgcgatcgtgccttcgaggcgaacccgcgaccctgaggacgtcgacatctcctgggagatcgacgcgttccgcttcgagctccccatgatggcctcggcgatggatggcgtcgtctcgcccgccaccgcgatcgagatcggccgcctcggcggtctcgcggtgctcaacctcgaggggctctggacgcgctacgaggatccggatgcggtctatgccgagatcgctcagctcccctccgacaaggcgaccgcgcggatgcaggagatctacgccgagccgatcaagccgtcgctcatcaccgagcgcatccgcgagatcaaggctgcgggggtcgtcgcggcggcgtcggtgacgccgcaacgcaccgaggagttcatcggtgcgatcttgaagggcgaactcgacatcctcgtcatccaggggacggtggtctcggccgagcacgtgtcgaagacccaggagccgctgaacctcaagcgtttcatccgagagctcgagatcccggtcatcgtgggaggcaccgcgtcctaccaggcgaccttgcacctcatgcggacgggtgcggtcggggtgttggtcggggtgggtcccgggcatgcgtgcaccacgcgtgcggtccttgggctcggggtgccgcaggcgacggcgatcgccgatgccgcggcggcgaggatgcgccacctggacgagacgggcgtctacgtgcacgtgatcgcggacggtgggatgtccaagggcggtgacatcgccaaggccatcgcggtcggcgcggatgcggtgatgatcggctctccgctcgcagcggcctacgaggcaccgggtcgcgggttccactggggcatggcgaccttccacccgacgctccctcgaggcacccgggtgcgtaccgagcagcgcggttcgctccaggagatcctggtcggaccggcccgggagaacgatggtcgcctgaatctcttcggggccctgcgtacctccatggccacctgcggctacgagtccatcaaggagttccagaaggccgaggtgatggtcgcgccagcgctccagaccgagggtaagtccctccagcgcgagcagcacgtcggccaggggcgctagtgcgccacgccgacgagcaggtcgtccttgtcgtcgacttcggcgcgcagtacgcgcagctgatcgcacggcgggtgcgcgaactccacgtgtactcggaggtcgtcccggctcgggacgcactggcgttcgtccgctcgcggcggccggcggcggtgatcctctcgggtggtccggcgtccgtatacgcccccggtgcgccggggctcgcgcccgaggtgctcgaggcgaacgtgcccatcctcgggatctgctacggcgctcagctgatggcccagcagcttggcggcgtcgtcgagcacggaggttcgggtgagtacggcagaacggtgatcgagcgcaccgacgagcgtgcgcacctgctcccgccgctccgtggcgaggcgcctgagacggtgtggatgagtcacgccgacgcgatcgttgccccgcccgagggcgcgcgggtggtcgcgagctcggccggggcaccggtcgcggccttcgaggatcccgcgaggcggcgcttcggtgtgcagtggcatcccgaggtctcgcacaccccaggtggcatggagctcctcggacggttcctgttcgacgtggtggggctcgagccgcgctggacgagtttttcgatcatcgagcaggcgatcgcagaggtccggagcacggtcggcgatggtcgggcgatctgtgcgctctcgggtggggtggattcgaccgtggccgcggcgctcaccgccgaggcgatcggcgaccggctcacctgcgtcttcgtcgacacgggcctcctgcgctcgggcgaggcggagcaggtcgaacatctgttccgttcccagttcgacatcgagctgatcgtggtggacgcggccgatcgcttcttcgacgccttggcgggcgtgaccgaccccgaggccaagcgcaagatcatcggcgaactcttcatccgcatcttcgaagaaacggcggcctcgaagaccaacgcgacccacctcgtccagggcacgctctatccggacatcgtcgagtccggtagcgatggctcggcgaccatcaagtcgcaccacaacgtcggcggcctcccggacgacgtcgcgttcacgatcgtcgagccactgcgacgcctgttcaaggacgaggtccgtcgcatcggcgtcgagctcggtatccccgagtcgttcgtgtggcgccaaccattccccggtccggggatcgcggttcgagtgctcggcgaggtgaccgcagagcgggtcgagacggttcgccgtgcggatcgcatcgtccaagacgagctcgacgaggctgggctctcgcgctcgctatggcaggccttcgcggtcctggcccctgggctccggtcggtcggcgtctcgggggacgcgcgtacctacgacgccccggtcatcgtgagggcggtcgagtccgaggacgccatgaccgcagattgggcacggctgccatgggaggtgctcgatcgcatctcgcggcggatcgtcaacgaggtcccgggcgtcaatcgcgtcgtctatgacgtgacctccaagccgccaggcaccatcgagtgggagtgacgaggtgctcgaggagctcctcgaggatctgaacccctcgcagcgagaggcggtcagcgctccgatcggaccggtgctcgtgctcgcaggggccggctcgggcaagacgagggtgctgacgcgccgcgtcgcctggctgctcgccgctggcgagcggccgtcgtcgatcctcgcgatcaccttcaccaacaaggcagccggggagatggccgagcgcgtccgcagtcttgttggacccaacgcggatggcttgtgggtctcgacgttccacgccgcgtgcgcgcggatgctccggctgcaccccgaactcgggggtttgcgctctggctggagcatctatgaccaagacgatgcgaggcggttgctcgagcggaccattcgacgcttggacctcgacaccaagcggttcccaccgcgggcgatcgcccagcaggtgtcgctcgccaaggctcggctcgtcgacccggagcgtttcaccgacgaggcggaggggctctacgagcgccaggtcgccatggtctatcggtcctaccaggccgcgcttgccgaggcgaacgcggccgacttcgacgatctgatcggactcgtcgtcgagggtctcgcgacgcgaccggagctcgccgagcattggcgacgtcggttccgccacgtcctcatcgacgagtaccaggatgcgaacccggcccagcacgccttcgtcgccgagctcgtcggtcgtagcgggagcgtgttcgccgtcggcgacgtcgatcagtcgatctacgccttccgcggtgcggatccctctggtgtcctcacgttcgaggagcgcttcgacggcgcgaaggtcgtcacgctcgagcagaactatcgctcgaccaacgccatcttggggctcgccaacgcggtgatcgccaagaaccgtcgtcgctacgccaagcacctgttctccgagctcggcgagggcacgccggcgcgacgctatcaggccaccgacgagcgggacgaggcccgttgggtggccgcgaccgtacgagagttcctccaacgtggcggcgtcgatcccagcgagattgcggtcatctttcgcaccaatgcgcagagtcgtccgctcgaagaagccttctcggaggcgggcatcccgttccgcgtggtcggaggcgtccgtttctacgagcgccgcgaggtgcgtgatctgctcgcctacctgagagtcctcgccaacccggacgacgacgtcgcgctggcgcggattctgaacgtgccacggcgcgggatcggccggggcaccgaggaggcgctccaggcggctgcggcactgcgcggtcggagcatgctgtcgctgctgcgtgcagagggcgtcgaggtgctcggtctgacgagccgccaggagcgggccctgcgagggttcgtcgagctcatcgatcgcctgggagcgcttgcgtcgctccatcgaccgagcgagctgatcgacgcggtcgtcgccgagacgagctacctcgagcacctcaacgaggaggatccgatcaccctcgagggtcgcctcgagaacatcgccgaactgcgtgcctcggcggcggaggctgacgatctcgagagcttcctggagcgcgccgcgctcgtgtcggcggtcgacgaggtgatgggtgcctcgggcgtcaccctcttgacggcgcacgccgccaagggtctggagttcgacgtcgtggtggtcgtgggactcgaggagggggtctttccccacgtgcgtgccatcgtcgatgccgaggcggtcgaggaggagcgtcgactgttctacgtcgccatgacccgagcacgcacgacgctcgttctcacgagcgcgaggcgccgggcgagctggggcgagccgctctacaacccacccagtcgctttctcgacgagctgccggctgatctcgtggcgacgaccgcggcgcccgtcgctgtcgggacggcgtgtgcggagtcgatccaacgtgcgagtgcggtcgtcgaagcccgtgcagcccggagcgagtgggtggtaggcgatcgagtcttccacgctcgctacggcgagggaaccatcagacgggtcgtgccgcggggcgtcgacgacgagctcgtgatcgcgttccacggcgctggcgagcgtcgcttcttcgcctcgatggtcaagctacgacgcgcgtgagctgagcccggctggggccgcgagagcccctgccgcgtccctggcggcgcatgtgcgccctcgtcggtcgtgtcggggcgcgcgtgtctcggctggctggccggatgggatgacgctgtcgagaagccggacgaccacagagcgtgggaatgcggagagtggtcacgcaacttcctgtggggagaaagtggcaacacagtgcgaacatgtcgatcaggtgtagtgaacagtgcgttacggggacaaatacctggagaactcgtgctggttggcccctcatggtgcggctacagttaccacagcgagagctgaaggtgtcgaattcgagtaaatgtgttggcacggatcgtcgtgcgtcgacactgatccgctcgacaaggaaggagaaccaccaccatgcgcatcatcgtctacggcgcggacggctacatcgggtggccgatggcgctgcacctcgcggcccaaggtcacgacgtgctcgccatcgacaacggtgcccgtcgccgttgggacgcagaaggcggtacccgtcccctgaacgagatcgcctcgttcaccgagcgcgtcgagacctggaacgccctcggcaagggtgcccccatccgcatcgccgaaggcgacatctgcgactacgacttcgtcctcgagaccatgcgcgcccacgacccagaggccctcgtgcacttcggcgagcagcgcagcgccccctactcgatgatctcgcgcgaccacgcggtgcgcactcaggtcaacaacatcgtgggcaacctcaacatcctctttgccatgcgcgaggtcaaccccgagatccacctcgtcaagctcggctccatgggcgagtacggaaccccgaacatcgacatcgaagagggttacctcaccatcacccacaacggccgtagcgacaccttgccctacccgaagctgccccacagcttctaccacctctccaaggtggccgactcctacaacatccacttcacgacgagggtgtggaacttccgcgccaccgacttgaaccagggcgtcgtctacggcgtcgccaccgacgagacggtgctcgatccgcgccttgcgacccgcttcgactacgactcggtctggggcaccgccctcaaccgcttcgtgatccaagggtccctcggctaccccatcaccgtctacggccgtggcggccagacccgtggctacctcgacatccgcgacaccatggcctgcatcaccctggcgctcgagaacccggccgcccccggtgagttccgtgtcttcaaccagttcaccgagcagttcaccctgaacgagctcgccgagaccgtggcaggtgtcctgggacgccgaggcctcacccccaccatcgcccacctcgacaacccacgcgtcgagaaggaagagcactactacaacgcccgtcactcggccctgctcgacctcggtctgcaaccccactacctcgccgacaccctcatcgactcgttggtggacttcgtccaggcgaacgccgccaacgtcgaccccgagctcctcgagaccccgacggtgacctggcgcgagggtgcgaacgaggtctggtatcgccacgcggacctcaccgtggcggccgagaaccgagcacgcgaggccacggacaccattcgggaggcgctggcgtaggtgccggcgcgagcagaggcgtgagggagggttgcgatggtcaagagccaggagtcgtcggaccgaccgtggtcaggcgatgacgaggagcagcgtggggctgaaaccatctggccgctcgtcgatcccgaatcgctcgagggcatcgatgtgacctcgtcggaggcggtcatcgacctgcgtgaggcgccgagtgcccctccggtgagcacgccggcggcgagtcctccagcgatggagctcccggtggtcgcagccccggtgcggccgtcgcgccgcggttggctcgttgccatcatcgtggcggtcgtcatcgtcgtggtcggctacgtggtcgtgagcggcctggctggctcaccactctcgtcgctgtcgtcggaggtggtcgacccgggtgaagtgagtctctcgttcccggctgcgggaacgatttcgcagctggccgttcacccaggcgagcgggtcgcgagcggccaggtactcgcgaccgaggtggtcccgggcctcagcgagacccgtcatgccgatcaggccgcgatcgcagcggacacgagcgaagtcagtgcgctgcaagcgctcatcgcgcagatgtcgagcgtgacctcggcgaacgctggggtcgtcgcccaggcggcccaggctgaggtcgcggcggcgcgccaagcactcacgagcgacgagagccagctggcatcggtccaagctcaaggggcggccacggtcgccgccgcacagtccctgctgggcgccgatcaggctgccgctgtggcggcatgctccggcgtcggcccgacggcttcgccgccaaccgcggcacaggtggcgtgtgctgatgcccagcatcgtgtcgctgccgatgagctcgccctcgcccaggccaaggcgagctcacagagcgccgtcgacggtgtccagagcctgattgctgcggatcaacgtgcgttgagcgacgcggaagcacaggcgagcgagagtgatggcgtgtcgtcgacgcagctcgcagcgctcaaggtctcgctggtagcagcccaggctcagcttgcgcgggatcaaggcgaactcaatgctgccgcccagaccgctgcgacacagaccctgcgagcgccgatcgctgggacggtcgtgagcgtcgacggcgcggtgggtgagacggtgagcgcgagtggggtcggcgatgcggtaccgagcggctcgagcgtggccgtgacccctgggttcacactgttcccgtcgacccagacggagtcgagccagccggtggcctcgaccccggtcgtggtcatcaagggtcacgcccccacgtacctcgagacgctcgtccccgagagcgtcatcggcaaggtgcacctcggtgatcaggtgacgttcacaccgagcagccaaggcatcggtgtcgtccacggggtcgtcgaacagatctttccccgcccggtcgttgcggccggcgtcgtgagctatgaggtccagtcggaactgagcggccgtcttccagccggtttgctgaccgggctcacggggaatgccagcatctcaagctctggtcgacgatgaccccacacggcgtcgtcgtcgtcctcggagccgtggccctgttggcggcgggcagttgggccgtgctccacggcgggcgtggtgaccatggcgacgggttgcgtcacgtgcgcctgccgtcaccgcagcgctcgatcccacgtctcgtagtgttcatcgtcgccatcgtggcgtggtcgatcctcgtagctcgcgactgggccgaggccgcaggcgcgttgaaggccgttcttgcgctgatcctcgagcgagccggactcggtgcctcgacggccagctcgtatctcgtccacaccaacccgctcttgctgctgctcgaggacgggagcctcagttctttcgtgatcgcacgtcgtcacagcgtgcgctcgctcgtcgtcagcgttggcgtcctcgctgtcgtcctcatcgggggaccgctcgtcgtcggggccgccgaggtgatggcatcgtggttcggggccccgtcggtggtggtcttctacctcgcagagctcgcgagtttggcggccggcttcgtcggcctgttggcattgatcttcctctcgagtgccttgccgcggcgctacgcggcaagggttgggctgcgcccgctcgccagcgcgctgctgctcatcggcgtcttcgtcctcattctcatcggcgccggcgcgctcgcccgcggcatcggtgggagcttgagcgctgtgtcgccgccggacggactgctcgtgttcttggccctgcccgcgctgatcatggccgtctcggtcgtgctgctgctcgtgcgcccgaaggatcgacctggggtcggggatcccacggagccgatcgacgtgatcatgccggccttcaacgaagaagctggcatcggtgccgcactcgccgcgctcgatgcggcggcggctgcctatcccggccgagtccgagtcctcgtcgcggacgacggttctcacgaccgcaccctcgaggtcatcgagatggcggcccagactgctcgggcggccgagatcgtcgctgtgggcgggccgcacggtggcaaggcggtcgcgctcaaccgggcgctcgaagccgcctccacgcgcatcgtcgtgcgtgtcgacgccgatatcctcgtggatgcgaactgcttgcggccgctcccagactggttcgccaacccggcgatcggctgcatcggtgccttcgaccttccgaacatggcgctccctgcgtggtacacgcgtggccgactcttcgagtgtctcatgaccttcgggttctctcggctggcgttcgagcgcgtggacgcgaacaacgttcccgggacctacatggccttccgcagagcggaggctctcgcgctcggtggctttgtcgaggggatgaacggtgaggactccgacctcaccttcaacctcggcaagctcggtctgcgttcggtgatcgacccgcgcatcgtgatctacgaggacgtcccccagacccttggggctttcttggagcagcgcactcggtggtcgcgcgcgtcgttccacatcggcgcgcgtcatcttccctggcgcgcgcgagagctccatccgcggctcatcatccaactccgcttcctcttcaacaagctcacctcgatgatccggccgatcacctacatctcgagtgccgtcttcttcttgctcatcccgcgggtcgctggctcgccgctgcgtaccctcgtgttgcttgctttcacccttgcgccgcaacttctcttgctgatcggcgtcgcgctctactggggattctggcgggaactacgccatctctgggtgtgggtgccctttaccatggtccgcaaactcggtttgctctcgggtatcctgtcgctgccgccgttgggcgcagccgtcgatccagaacgtcgggtcgaggccatggcagatgcgaacgctcgctaggcggctcatcctcggcgcgctcgcgctggcgctcgctggctgtggcgaggtgcaagcaccgcaccatcgcccgacgagtgagcgcgcggcgcacgagatcgccccgtcgctcgtcggggtgcattggtggctcgcggcctcggcgctgcgtcgcctcgatgcagcggcaggttcgagctggacgaatgcggtgttccgtccggcgaataccaccctgatcgtcgggccgtcgcaagcggccagctatgcggggtgggcggggcaccgcgccctcgatgcgacgagcctcgccggcgttcgcgaggcgctgcgcgtggcgacgtccggggatgtcgtattgctcgatctcgagcactggccgcgctcgccactggccgagcagcttcaggcgggtgcgacgttcacacaggctggcacgttggccagggcggcaggcgtcgatctcgtcgcggctcccgccaccgacctcgctctcgtcctcaccccgggccagcgtgttcggaccggttttctcgccagcggcgtggtgcaagcagcgtcgcgcgccgcgcagatcctcgagatccaggcacaaggtctcgaggcgacgccgtcgcggtatgcgagcttcgtcgatcaggtcgaggtgcttgctcggagtgcgaacccgacgattcgcttcgtgctcggactgtcgacgaacccgagtgggcaacgggtcagcgcgacaaccttggcccaggacatcgcgctgaccaaggctacggcgagcggctactggctgaacatcccccaggccggggtctcgtgtccgcggtgtggcatcgcgcagccgcaggtcgcggtggcgttgctgcggggtgagtcctgaggcgcaagctgctcctggcgggttcgctcgcgttggtggtggccgcggtcgtcgcggtcgcggcgccacgaggggcgaagcaccatcatcacacgcagcacctcttcatgccgagcccgacgggaggccaaccgatcgaggcaccaacgagcaggcacacgatctggctgctggccgaggcgcacttcgatcaagtcgtctccgtcgcccccgtccgtgctctctttgcccgtggcgtcgtgtacgaaccgatcacgccgcggcagcatccgagcaccctggtcccggtcattccgacggctgactttcacgccgagtcacagctcgcccaggcgatcgccgaccatgagcttgcgacgggagtgcgcgctgtgatctacgacaacgagcgctttgcgaacacccccaccgtcgagcaagacaacatccggctctccaccgagcgcgcagccgctgttgctcgcgccgcgggtctccagagcatctgtgactttatcgagtcggaccgacttccatcaggggagcgtacggcccagaacgaggtgccaccgtgcagcatcgtcgggctcaacacggtgcaacagtcggaacgatcgaccgcccggtaccgggctgtggtggcacgtgacgttgcggtgatccgctcggtcgatccgtcagtgccgatcatcgcaggcttgtcgtcgaatccgcgcggaacgccggtcactgcagcggagctcacggccgacatggaagcgacggcagggttggtgaacgggtactggctgaacgtgccggcgccaggcgtcggttgcccggcgtgccacgcgcccgaccccggactcatggcggaagcgctcgcggcgttgccagctgggttcgcgacgaccgggtgagtcggcacacacgacgaggacagtgacaaccagggggaaccacgacacgaggcgtgcgacggcagtggcggtggctgggtggcagtggctgggcgttgcgctggcgccaacgatctgctcgctcggcatcgtcgccgcgtcgtcggacacagctccagcggcgagcgaggtgccgggctggtcctttgccacggatctcgtcggcgcgacgacccaaggctcgctcgtggtgagtttcccgacaggcgcgagcgccggaacgcagctggtcgtcaacctgccgtgggcccacttctcgagtgccgtcacggtggcgctcgatggtcagtcctgccagggggtctcggctcgcgacgctggcgcgatcggcgcgagcctcgcgtgcacggttccggcggaactcgctgctggggagcacgtcatcgacgttgggggtgtgatgctcccgaacctcgtgctcgaggagtgagcgcccctgtggtggtcggtgctgaccggatctgcgcgaccgagtcggtggcgccacgttcggatgcagcggttggcgtgcgcatcgtggttcgcgacgcgagccgaagcgccgctggcgacagtgccctcgtcatcgcccagctcgtggatcggggcggtcttgcgaccacgaacggagccacgagcgttgcgctcgcgttcgacccggggaccggcgccagcgtcgcgccgccgtcgacatcgacgacacccgacggtgtcgtcggcgtgcggggatgtgctggccctggcaccgccggcatgacagcgaccgctgcgagctcgggcgaggtgctctgcgtcgtgatgcgccagacatcgtcggcgcccttgcgggtcgtcgacgcggcgagcgccttcgagtcgcctcagccgatggtcggtatcgctccgggctcggtcgtgggcctgggatcggcagcctgcgacgcctctgtcgtgacgaactcgggtggggtgctcgccgtcggcgagaacccactcggcgagctcggcaacggctcgaccacggtggcaagttcgacgccggtctcggtgacgttccctgctgggacccagatcgcgcaggtggccggcggtggctacttcacgctggcgcgctcgtcgaacggcacggtctctgccaggggcaggacgaccaggggcaggtcggcaacggcaccaccgaaaccgacgtcgccacgccggtgccggtcgcgctgcctgtcggcgctgccgaggtcgcggcgggttgtcacgcggcctcagtactgggtagcaacggcaccgtctacgcgagagggttcgaacacgacgggacagctgggtgccgggggtttcttcaacgacctcgtaccggtccaggtgcagttgcctcatggcgtgagcgtcagcgacgtcacctcgccaggcgtgtcgacggtggtcctgacaccacgagcggcgccgcctctgtcatgggcggcaacctgttcggccagctcggtgacggcatctacgtcacggccgcgacgccaacccgggttggacagtcacagctcgaagcggtcgcgatgggcggcttcacgaactggctggagccgttcccgaccatcgtccgcaccgacgctcggaccctcaagctcgagcgccctcctcggcgaggagtcgtggcagcgcacggggtgcgacgagcgcccgcacgacctcggcggcgcggcgtcgcttcgggacgatggctcgccgtgtgagaacgtcgtagtcgttgcgttcgacctcgagcatgatggcgctgtagagctcgcgtgccacctcgacgcagcggcgggaggcgcgcggcaggaggggatcaccggcgagtgagtcccgatagagggtccgtgctcgttcgatctcgaagcgcacgagcgctcgtaccgccggcgagggccgacgcgcgagcaagtcgtcgagcgccccgtggttcgccacgtcctcgagtggcaggtagatccgtccccgatcgaggtcttcgccgacgtcgcggatgaagttggtgagctggaaggcgagcccgagcgcgcgagcgggctcgcgagcagcgggtgggccaccgaggatggggaggaccatctcgccgatgacggcggcggatccttccatgtagtcgagcagatcgtcccatcgctggtagcgccggacggtgaggtcgcgccgcatcgcgccaaggaagcgagcgagcgtctccggctcgatctgccagcgctcgtaggtcgacaccagcgcatcgagggccgggtcgtcgctgccgccgcgtacgagggcctggcagagcatcgcttcgagctcgtcgagaccgcgacgcttttcgtcggtggtggcgctaccgtcgacgatgtcgtcggcccgtcgacagaaggcgtagatcgcccagatgcctgggcgcgcgtccggctcgaggaggcgggatgcgaggtagtacgtgcgcccgtagcggcgcgcgacggatcgagtcgaggagagaccagcggattggcgcatcatcgacgtaccatgcttcccgggtggtcggcgagcacgcgagccgcggcgagctgacccgaggtgagcgcgagcggaacgccgacgcccgggtgcgtccccgatcctgcgaggacgaggttgtcgaactcgcgaggggccatcggcgcgcggaacgggcccgattgccagaaggtgtgcgcgaacgagaacggcgtcccggcgtccatgccctgggcagcccacgcctcggggtcgagcacgatctcggagatggggtccgaacgacgagccagtccgaaggtgccgagacgctcttcgaggcgttcgcgcgccgcagccgcgtcctcgggccagcggagctggccgttcaggttcggcacgggctcgagggcgtagacgacacggccacggggcgcgatcgtcggatcggtgcgctggggcagcgagacgagcgtcgaggggtctcgcatgaggcgccgggtctcgatgaggtcgtcgaaggcttcctcccacgcttgcccgaagaacacgttgtggtgctcgaggtccgcgggaagcggggcgtcctcgtagcgcaccacgacgagggccgagggtgcgaggcgccaccgtcgcttggcgtagccgaggccgagacgtcgaccgaggccgagcgggtcctcggtcgtgacgacgacgtcggccgggtagcgcccctgtggcgtcgtgaccgcgctgatgcggctcccggtgcgttcgtagtgcgtcaccggctcgtcgaggtgcagctcggcgcccaggtcctcgcacaggcgcccgagcgcctcaccgagggccgccatgccgccgcgtggaaaaacgacgccgaggaccacgtccatgtaggcgatgacgccgaagagcccgagtgctcgctgcggggagacgccggcatagagcgcctggaaggtgaccgcccggcgaagcctcgggtcggacaggacgcgggccgcacgagcatccaagcgtccgaaggcgccgagtcgccacagacgccagagcgcgggtgcgcgcgtgagcagtcggtcgacgctggcgacgtcggcttcgatgaaggtcggcagctccgtcccggcgagctcctcgagccagcgggcccagcgctgccactcgtccagggcccgcgtgccggcgaaggcacggacttcctcggccatgcgctcgcgatcgctccaggttcgcagcacccccgcgccatcagggcccgtcgagtctgcgaacgcgagccggtaaccgggctcgacggggatgaggtcgaggtagtcgtcgaggttgcggcccgccgcgcgccagatcgatcgcagcgtaccgaccatggtgagcacgacggggccgaggtcgagcgtcgccccgtcgatgcgcacggcgtcggctcgcccccctgggcgcgagcgacgctcgagaatggtcacccgatgacctgcggccgccagcctcgaggccgcggagagtccggcgaacccagcgccgacgacgatgatacgtgccatcgatcagtgctgacgggcgacgatgaaggtcgcgaggtccccgagcgcgcagcgcgcctcagcggagagcgggaggtcgccgagggcatccatcgcctggtcggcaagctcgtcgatgcgttgctcgacccgatcgagggcaccgctacgacggacgaggccgagcacgtcgtcgagcgcacggccttcgaggttcgcatccccgagcgcctcgtcgaagcggacgagatcggcgacgtcgagccgctctcgggtctcggcaaccagcagggtccacttcccttcgcgtaggtcgtcgccgaccggcttgcgggtgcgagcaccgtcgccgaagacgccgaggacgtcgtcacgcagctgaaacgcgagccccaaggggagtgcgaagcgcgagagcgccgcgagcaccccgtcggccggatccgccagcagcgcgccgagatgcagcggtcgctccacggtgtacttggccgacttgaacagggcgatgtgctcggcgtgctccggggtgtcgaagagctgggcgctcgcgaccacgtcgaggtactggccgagattgacctcgagcttgagctgtgtgaacgtggcacgcaccgggagcggggccgcctcgagggcgccgtcggcaagcgtgagggccaagtccccgaccaagatgccgatcgcatccccgtaggtctcggcctcaccgcggagcttgagggagcggtgctcgtcgcgcgcgcgcgcatgaacggtcacagcaccgcggcgaagttcggagcgatccatgatgtcgtcgtgcacgagcgcgaaggtgtggaggagctcgatcgccaccagcaggtcaccgaggagctcgtcgtcgccgtccacaccgagcccacgcgcggcccagaacgcaagggcggggcggaggcgcttgccgcccgcacgcgtgaggcgtgacagctcatcgaacggttcggcgaagcgttcgtcgatggcgcgccagcgtgccgcctctgcgtcgagcagatggccgaggcgtgcctcgaccaggcgtgtgggggctccgaggacctccggttctgcgacgcacggctccaccaccgcgctcgattcgtcgtccacctgcgcctgactcctcgaccactcgtccttcacgacactgtgcaaccgcgaggtcgcaccgtggcttcccgtaccgagcctagtgacgagacctcggtaggctgaagccgtagcgacctggaggggagcgtcgtgatcgatccggagctggtggacctcgtgctccagcgcgcgctcgcccgtgggggcgacttcgccgaggtgttcgtcgaagaagtgcgctcgacctcggtgagcgtcgacgacgggcgggtcggcgccctggccgacgttggatggcgtggggtcgggatccgcgtcgtcgtcggcgagacgaccggctttgcccacaccaccgacctgtcgcctcgcgcgctcgtcgcggcggccgagaccgcctcgtcgatcgcgaagggaggcgcgagtcgggtcgctcccctcgaggtagcacccatcgagcctgcggcgcccgagcgcgacccgagcgccaagcggcgcatggtggagctgctgcgcgctggtgagacggaggcgcgagggctcgccgatgcgatcgtccaggtgtccggccaggccgcgaccgcgcggcgtcggatcctcgtggccaactccgagggccgattcgtcaccgatcggcaggcacgcacgcgtgtgtcgttccaggtcgtggccgccggggacaccggggcccagagtgggcgcgagacgtctgcggccaccgtcgatctcgaggagttgctcgacgccctcgacgtcggcgccctcgcgcaggtcgctggacgacgggcgcttgccaaactggcggcgcgtcccgctccagcaggcgttctgccggtggtgctggcgaaggggtcgggcggcatcttgttccacgaggcctgcggccacggcctcgaggccgaccacatcgccaagggcgcctccgtgtacgcaggccgtctcggtgagcgggtggcgagcccgctcgtgacgctcgtcgacgacgggacccgggccggggagtgggggagctaccacatcgacgacgagggcaaccctgcccagtcgaacgtgctgatccgcgatggtgagctcgtcgactacctctgggatcgccgcagcgccacgaagctcggccagagcccgcgtggcaacggtcggcgccaggactatcgatccctgccgatggtgcgcatgacgaacaccttcctcaccccgggggagagcgatccagcagacgtggttgcgagcaccgaccacggcgtctacgtggccgccctctccggcggtcaggtcaacacggccaccggagacttcgtcttcggggtgcaggaggcctacctcatcgagcacggccgcatcaccgctcccattcgcgacacccagctcatcgggaatggccccgaggtgctcgctgccgtggatgcggtcgcgaacgacttcgacatgaccgcggggacctgtggcaagaacggtcagtccgttccggtcgggtgcggccagccgacgctgcgactggccggtgtgacgctcgggggaacgatcggtggctgagctgttggagcaggctctcgcgctcgtggacgatcggcgggccggggaggaggtcgaggtcgtcgtcgggcgatcgcgccaggtggaggtcgtcggcttccacggcgcggtcgagtcgctgacccaggccgaggaggtcaccatcggggtccgggtcctcgtggcgggccgcatcggcttcgccacggtcgatgcgctcgaccccgctgccgcccgcgacgcgctctggcgcgcgagagagaacgctgagctcgtcgaggcggaccccgacgcggtcttcgcggtgcccgacgacgtcgcccccgtcgtgctcgagctcgtcgacgagaccctgtcggcggtctcgctcgatcgcaagatcgccacgtgcctcgatctcgagcgcgcgtgtcgggctgcggacccgcggatctgcgacgttcagtcggcgacctacggcgagctcgacggcgaggtcgccatcgcctcttccaccggtgtcgcgacgcaggtccgatcgacccgcgcttggctgttcctccaagcgctcgctgcggatgggcgcggtgtgctctcgacgggttttgcctcgtctggggcgcgaggcttcgagggcctcgacgcagatcgcgtggcgcacgaggcggcgagccgtgcgctccgggggatcgacgccaccaagcccgtgggccgcgaggtccaggtccgtttcgagcctcgctgcgcacagacgctgctcggtctctgggcgggtgccctgtcggggctcgcgctcgctcgtcgtcgctcgatgttcgtcgatcgcctcggagagcgggtcgcgccctcgtggttctcgttggtggacgacccgacggacgggcgctcgctgggggcgaccccggtcgacggcgagggactcgcgacccgaccccatcggctcatcgagggtggcgttgccgccgaggcgctctatgacgcctatgccgctcgactcgccggacggcaatccaacgcggccgcgctccgcgcggttggcggcctgccggcgccgggcgcgcgcgccgtgcgggtcgaggcgccgaggcgaccggtggccgaactcgatgccgccggtgacgtgctcgtcgtgcggtcgctgtcgggggtgcactcgggcaccagcctgatctcgggggacttctccgtggggatcgaaggggaactcgtcgggccgaacggtgctcagccggtgcgtgaggcgaccatctcaggcaacctccagcgcatgctgctcgatctcgctggcgtcggtgacgacgaggtcgaactgccgagcgggacgcgcgcggcgagcctgctggtcggatccatgacgctcgcgggccgctaggtgcgcctcgatctccatgtccacacctacgcctcgggggactcgacgacgagaccggaggagctcgcggcccgcatcgggcccgatgacgtcatcgccgtcaccgaccaccacgcgatcgtcgcggcgcgcgaggtcgcggcgcttgtcccgggccaagtcatcgtcggcgaggagatcgacaccggcgcgggggagctgatcggtctcgggctcgacgctcgggtgccgccgcgtgcgggcctcctcgagacggcgcggcgcatccgcgacctggggggtctcgtgctcgccccccacccgaccgatcccgcgcgtcgtggtctcggtcgagcgggactcgagcggctcgcggacgacggtctgctcgatctcgtcgaggtcgccaacgccaaacgcgtcgcctgggatcgggaggcggcgctcgtggcacgtgagcgagggatcacacaggtcgccgccagcgacgctcacgtacctgaggctctgttcgcgtcctacgtcgaggtcgccgggccgcggtgcgagatcagagggttgacggagctgctcgcgctccttgcgcgtggggcgctgcggcacgcgccgcgcgatccggtacgtccctggccccggccggtggtcccgggctcctgaggctcgaggacgatcgcgctagacttcgcgtcgtggacgatgtcctgtggctctccgccatccgtcgggcgccggtgcttgggcggggtggtcacgagtttggtcgtgtcgatgacgtggtgcttcgcctcgtcgaagccagctatccggtcgtcgtcggcgtcctcgtgcacgtcgacgaccagcccatgttcgtgccggcagatcgcatcgaggagttcggcaccgagcggatcgtcacgacgctcgaagagggcgagctcggccggttcgagcgtcggccccaggaggtgctcgcggttcgtgacctgctcgagcaccacctgatctggtcgaagtcgaagctgcgtccgcgactcgtgagcgctcgggacctcggcatgatcccgttcgcgggcgagtggcgcgtcatcgcggtcgacgtcgcccaagagcaccatcgacgcttctggcacgccaagcgcgaggcgagggtcgtcgactggcgcgatctcgtccccttggtgggccatgtgccgagtgcgaggatccgcctcgagctgcgctcgatccggcgcctgcacccggccgaactcgccgacctcctcgaggacgcctcggagtcggaggggcgcgagatcatggcggcgctgcaggcggacccggccttcgaagcggacgtcatggaagagctcacgccgcagggtcgtcgggacgcgatccgcgagcgcagcgacgccgaggtcggcgagctgctcggcaccatggagcccgacgacgcggtcgacttgttgatgagcctggagcaggagcgacgcgagagcgtgctcgcgctggtgcccgagccgcagcaggcgaccatcaagcgcctgctcgcctacaaccctgagtcggccggtgggctcatgacgaccgacgtcgtcgcgctcgcggcagggacgaccgtcgcggaggcctgcggcacgcttcgcgcgcgcgccgccgtaccggagaacctgtgggtgctgttcgtcgtcgacgccgagggtcgcttcctcggtcagctgcccctcgtcgcgctccttcgtgccgccgacgacgcctcggtggatcagctcgctgacaccgaggcgcgcaccgtgcgtcccgacgcggacctgacggaggtcgccgtcctcatggccgacttcaacctcgccgccgtggccgtcgtcgacgccgagggggtgctccttggcgcggtcaccgtcgacgacgtcctcgttcgcaccatccaaccgggatggcgccgacgtgccgaagcgctcgacgggtagccgcggcgcgcgtggcgtgtgcgggtcgatcgtggtaggcgcgcctgcgagcgctcgcgcgtgaccctcgctggcgcgctcgtcagtggccgaggtggacgaagctgacgaccatcagcatcaccgcgatcaccaggtaggcccgaagcccgatgagggcgacctgacggcctcgcgagaagcgcgggcggtgcaagagggcagcggcgggcatcgtccagcgcagacggtcttccatgggcatcgtgggacgatggtggcggctgcgaagttgggcgatcgcgacgaccgccgtcgcgacgacgacgagggcaccggtcgcgaggacgagcccgatcacgttgatcgagggcacgatcgtcaccaccgtgagcaccaggctcagctgcaggagcaagcccacgatgaacgttgcgaggacgttgagccaaggcgggttgacccaggggccgaggatctctcgatcgttgcacaggagcagcaagaacgcgagggcgctcggcaggaggacgcccgcgaggacctgcacggcgaggttgatgaggctgagggggagacgcgggatgagggtgagtcctccggcgagcaccacgagcgcgacgtagctcgcgtagaagcctcgagcctcgcggacgggggcgttcagcgactgctcgaccccgaacaagtcgccgagggcataggccgtcgagagcgtgaccgtggcggccccgatgagcgacgcctcggcgagcacgatggcaaagagcgcacctgcgacgacgctgacgtggtggctgaagcccgatgcgatcgcgcctgcgctgccaaacgaccctgcggctcccgcgagcgccgcggcggcggcgatgatcaccgcggcggcggcgacgttggtgacgacggccccgatgaaggtgtcggcacgctcgaagcggatccagcgaggcgtgatgcgcttgtcgatgacgttcgactgctggaagaacagctgccacggggcgatggtggtgccgacgatgccgatgatgaagatggtcgcctgcgaaccgaggccgcccttgacacctgggacgacgaggccgtggagtgcggccccccagtgcaccgggctcatgcccatgagggggaagacgaggaggctcacggccaccaggatcagcatgaagcgctcccagcgctcgaaccgtccggagacgacgctgccgatcagggctacggccatgaggcccgccgcgatcgtcgggctgatcccgaagaacccgagcgcgtagcggatgccgatgaactcggtgacgagggtgaggaagttcagcaggaagaggtcgacgacgctgaaggcggcccagaaggtgccgaagcgctctcggagcagcttgccgtggccgacaccggtgacggcaccgagccggaccaccatctcttgggccaccgcgaggacgacgatgaggatcggcagcgtccacagcagcgtgtagccgtaggcctggccggcctgggcataggtggtgataccaccggcgtcgttgtcgccgaccatgacgatgatgcctgggccgaggatcgcgagcagcgcgagcagacgccggcgccagttgggtgagccagccagtgtgccagcggtgacggaaccgagcccgccacggatgacctcatcctcgggcgtgctcgtgcgggagtcgtgcacggggggacctccacgttcgagacgatggccagaacgagcgcttaggcgcggcgtgcgcgccaagcccggacggagcggcggggacttgagggctcggtgcgcatcccagcctcccttcgctgcgtcggggtcctcagtgcatgcaggggcagtctacgccggatggggcgcgagcagggtcaggcggggacgtgcccgatcacgatcgccgcctccgagacgaccgggatgacctcgacgccgccgaagccagcctcccgcaggatcgtgacccagcgctcgcgggagatcggcctttcctggacgcgcaccacgtagcgcacggcgttcttggcgatgcgccagtacccggccggtccacgggcagcgaaggcgcggaccttctcggcgatgatcgcgcggtcgctggcggactcgccgcgcccgagcatcatgtcgccgatcacgaggcgacctcccggccggagccagccgtaggcggcacggaccacctcggccttcgcgcgatcggagagatggtgcaagacgtagttggagaccacgacgtccacgctgcgaggctcgagcgcgaagcgctcgagcggcgtcgcctcggcggtgacgttggcgaggttggcggcgcgcgcgcgctcgaggaggcgggcgaccatccgctcagagatgtcgacgccgtggacgtggtgggcgatggcggcggcgggcaagctcacctgacccgagccgcagccgaggtcgacgacctcgtcggtggggccgagcgcggcgtgggcgacgaccgcctcgacgacccgttcgagccctggcgaggcctcgtgctcccacgatccgacgcgccgttgccacacggtgcgttggagccagattgcaaggtcttcgctgcgtgccacgcggccagtgtaggagagcggggccgaggtacgcttgagggccatgtgcggccgtttcgaccagcggttcgggccggagcgcctcgcgcgagcgatcgccgagcttgcgacgccgctcggcgctgaatcggcgacgccgtcgggcatcgcgtcccgcggcgtcgtcgtgccgtcggacggcgcgatcgtcgtccgtatgagcccctcgctcgaggtcggtgagctcaccttcggcgtgaggacgcgggccggctcgctcgtcatcaatgcgcgtcgtgagacgctcggcgagcggccgctgtttcgcggtgcgctgtcggggggccgctgtgtggtgccgatcagggggttctacgagttcaccgggccgcgcggtgcgcgctcgccggtgttcttccactggaatggcgagctgcactggctctgcggcctcgccgtcggcgagggactcgtcgtcgtgaccgagcctgctggcgggcccgtcgccgggtggcacgatcgcgagcctgtcgtgctcgatcacctgggcggcgccgcgtggctccgcgacggcgaactcgccacgggcggtgcacacgacgccgaggtcatcgtgctcgatcgctcgtggacgtcgccacgtggcgatcgcgacccgttggcgttcggggggcctaggccggatccgacgtgatctcgggggtcgccgattcgtgcgcgccgagccaggtgcggatcttggcggcgatcccgaagccgtcgaggccgagatcggcgaggagcgcgtcggggggaccgtggtggatgtagcgcgtcgggatcccgagcgtcgcgacggggatggtcgggcgcacggcgcgcagcgcatcggcgaggaacgcgccggcgccgccgtggacgtagccgtcttccacggtgacgaccgcatcggccgaactggcgagggcgatgaggtcggggtcgatcggtcggacgacccgtgggtcgatcaccgtcgcctcgaggccatcgtcgtggaggaggtcggctgcggtgagcgcgggcgtcaccatcttgccgtaggcgacgatcacgaggccagatcccgcgtcgcgcaccacccgagcgccaaggcccgtgccgacgccgccgcggatgcgccggggacccggtgtcttcgagaagcggatcaggctcgggccgtcgagcttgagcgcctcctcgagggcgatgcgcacctcgtcggcgctcgacggcgtaaagatcgtgacgtcggggatcgcgagcatctcgacgaggtcgaggacgccatggtgactcggtccgtcgtcgccggtgatcccggcgcgatcggcgacgaagacgacggggaggtggtgcagaccgacgtcgaggttggcctggtcgaacgcccgagagaggaaggtcgagtagatcgcgacgaccgggcgcagcccgaccatcgccatccccgctgcggcggtgacggcgtgcgcctcggcgatgccgacgtcgaagtagcgatcaccgaagcgttcctggaacggcaggagccccgtgggagcgcccatcgcagccgtgatcgcgacgacacgccgatcgcgttcgccggcatccaccagcgcgcggctgaacgcctcggtgaacgagaccggctcggccccctcgatggtcgtgagcgctcgtggcaccttgaggtcgtgcatgcgctgcacctcgtcgtcgaccgctggctggtagccccggcccttctcggtgagcacgtgtacggcgatcggcccgtcccactccttggccccctcgaaggcgtagacgagctcgtcgatgtcgtgaccgtcgacgggcccggcgtagcgaatcccgagggcctcgaagaacacccgcggctcgatcgcttcgcgcagcgcggcggtcaccgaggcgatctgggatgcggcacgagggccgacacgaggaatgtccgagatgacctgtttgacgcggttgcgcgccgacatgtaggtggggttgagtcgcagtcgggtgagcgacgacgagagtcgggagatcgtgggggcatacgagcggccgttgtcgttccagacgatgatgatcgggagcttgcggtgaccgatggtgttgagcgcttcgtaggcgagcccgccggtgagcgagccgtcgccgaccaccgcgaccacccggcggtgtggtgcgctgccggtgaggtcgaagccagcggcgatcccgtaggcatacgacagtgccgtggaggcgtgggagttctcgatccagtcgtgctcgctctcggcgcgattcgggtagccggacagccccccttgctggcggagcgtgtcgaagatcgcgtgacgcccggtgagcagcttgtggggataggtctggtgcccggtgtcgaagaggatggcgtcacggggcgagtcgaacgcgagatggagcgcgatggtgagctccaccgctccgaggttggagccgaggtggccaccgttcgcgagcacggtcgtcacgatgcgttcgcgcagctcggcacagagcgccgtccgttgggcgggggtgagcgagcggaggtcctctggccccttgattcgatcaagtagttcgtaggacatgtaacccctagcttacgacggcgacgaccctcgttgcacaacgcgaatcattgtccacttcgtcccgtaggctcttcgtcgtggggcactggttctacctcgaggtccttggcctgtgcatactggtgacgctgccgctcgaggtcctcggggcgcgggtgtggcgccagccgcgtcggctcgctctcagcgtcggcatcgtcgccgtctgcttcagcctgatcgacgccgtcgaggtgtaccagcgcctgtggcactacaaccctcgctacgtgaccggtctgcgcatcggtgatctgccgatcgaggaggtcgcgttcttcgtcgtgatcccgatctgttccctcctcacctacgagaccgtgcgacgacgccacgagctcgtcgcgcggtggcgccggcggtgagctacacgctcgaggcggtggcgctcgcgatcgtggccgtcgccatcgactggtgggtcacgcgctcgcgtgtggtgcgaaccgcgtcgttctggatcacctgggtcgtggtcgctgcgttccagatccctgtcgacggagccctcacccgactccgcgcgccggtggtggagtaccgatccgggacctacctcgggatacggctcggccacgccatcccgatcgaggacttcgtctacggctttgccctcgtgctcgtgacgatctccctctgggtccggtttggtcgtcgcgcgagtcgctagggtggtactcaggcgtcgacagagcgtctctggcggctgtcgacggcgaagcaggaggtggcgcatgctcgtgctcatcgcgctgatcgcgttcgtcgcaatggaacccgtggccgcgctcgtccatcgtgggatcatgcacggtgtgggctgggtgatccacgcctcgcaccatcggccccgggaagggacgttcgaggcgaacgatgccttcccgctgttgttcgccctccccacgatcgcgttgttctggttcgggcggcatgaccctgtcgctgttgcgatcgcggtgggcatcacgctctacggcgtcgcctactcgttcgtgcacgacggctacatccacgagcgcctcggtcggatgccgaaggtgcgctacctcgagtacctcaagcacgcccatgcggtgcatcacctctacaacgagggcccctatggcatgctcgccccgatcgtgcccgccaagcatcgcgcgaagctcgagctcgaggcggtgcgcgcctggcgtccatcggtcgcacggtaggagcttcgctcctcgcatcgacgagaccagacagctagcatcgggacggtcgagcgaaggaggctgatcgtgccgaaggtgctcatcctgaccggcgacgctgcggagtctctcgaggtcttgtatccctaccagcgactgctcgaggagggctacgaggtcgatatcgcggcaccgtcgaagaagaagctccgcttcgtggtgcacgatttcgaggagggcttcgatacctacacggagaagccgggctactcgtggcctgcagacctgagctttgcggaggtcgaccccacggcctatgtcgcgttggtcatcccgggcggtcgggccccggagtacatccgcaacgaccccgatttcgtccggatcgtccgccacttcttcgaggctgaccagcccgtcgcgcagctctgccacgcgccgatcgcgctcgctgccgccggcgtgctgcaggggcggcggtcggctgcttatccagcgcttgcaccggacgtgcgcgctgcggacgccgagttcgtggatgcggcggcggtggtggatgggcagatggtgtcggcgcgcgcgtggccggatcatccgagctggatgcgggccttcatcgggatcctccgcgagaaggctccggtcggctgagtaccgtgccggccgcgaccagcttgtcgtaggtcggcatcgcacgacgggtactgtcgcgatcggtgcgacgtctggccacggtggtggcgcggcgaagctcgcatctcgcggcgtcgacggtcgtgtgcgagccgaggtgtcacggcgcacccgtcggtgactcaggggggtgctgtctgctcgagcacgtcccggagagggcaccgtctgttcgggcatcgtctggtcggggcgtcgggtggcctcgccggttggctggaccggttgtacaggaccagccgcgctggatggtcggtgcgagaccctcgcgggcgatgaggtgcgctcgcggtcgtgccgagtgggtcagtcctgcgcggcgaagttcggccggatctggaacagcaagtaccacccgatggcgatctcgatgagcgtctcgagcacaccgccgaccccgacgaagatggcgatgacgatgccgaaggcgagctggaggaccgtccccacgaagatgaggcgccagcctcggtagcgtccgcgcttcagcggtcccgtggccgcgatgtagagtacggcgaagaccgccgtcagggcggctgcgaggtagagctcactcgtaacgtgggtactcacgaagaagatgcccgcgagcgacgagccgagctcggtcgcaaggcgtgcgagctggacggcgtcgagtgcgaagaggatcccgacgacgaggctgatcagccacgcccaacgggtgagccacgccacggctccggcgggtagcttcggcaagccctcgctcagcgagccgaggcgctgctcgagcgcagtgatcacgacgacctccagttctcagcgatgtctcagtgtagcgacactcggtacgacgaagcggtcgttcatggggcggggcgaggagtggcgatcggcgcgacggtcccggcaccgaggtcggcgaggcgcgctgcgtcgatcgcgacgatggtgtcgggcgtgcccgcggccacccatacgacgcccgcacgagcgagctcggcgtcgaccaccacgcaggcagtcggcggcgcgatgagtggggtcgcgcccccgggcacgacgccgagcgcctcgatgaggtaggtccccggtgcgggctcgatgcgctggcgggccgcgcgctcgagcgagcgtcgatgcactctgcgatcgcccgcgacgacggcgagcaccgggccaaggtctccgcggaacacgacggtcttggcgatcttgtccgggtgcgtgccggcggctgcggctgcatcggaggcgaggtgggtcccggtcgcgaactggcgaatggtcgcgaggacgcctcggcgtgcgaggcgctcggcggccaagccagcgggatcggcgagcagttgcggcgtcatgcctcgagcgcgtcgacgatcgagacgccggccgggccgtcgagctcgccgatcacgagcacgcgcaccggctccccggccgcgacaccgtcgccgtcggggaccagggcgagcacgttggcgcccgcgagccctgagagcacgtgggagccctgaaggcggtagggctcgacgacgagctcgccgctgcgaacgtgggcccgcgcgcggacgaggtgcagcttgccgtcggggtggcgggtgatgggttcgagtgccctcgcggtgaggaccgggcgatgccaggtccgagcaccgagcatcttgcggatgagcgggcgtgcgaacaactcgaagctgacgatcgacgacaccgggttgccgggcaggccgatgacgggtgtctggcccatgcgcccgatggcgagcggcttggcgggcttgatcgcgacctgcatccagcgcatggttccccgctccgcgagcacctgcttggtgtagtcgaagtcaccgacgctcaccccgccgctcgtcaggatgagatcggcgctcgcagccgcctcgtcgaaggcgcggccgaggagcgctggatcatcggggatcgcgccgagatcgctgggaatgcctccggcctctgcgacgagggcgaggagcgcggggcggttcgagtcgtggatcttgccggggggaagcgggtcgaggtcggtgagctcgtccccggtcgagaacaccgcgacccgcggccgacggtggacgaagaccttgcggacgccgagggacgcgagcaggcctctgaccgctggcgtgacgggcgtgccctcggcgaggactcgctcgccggcagcggcgtcggagccgcgtcgacggacgtgcgtgccggccgcgatcggagcggtgaggtggacctcagagccgtcgacgatgacgtcctcgacgatcgcgatcgcatctgcgccctttgggatcggggcaccggtcatgatgcgtgcggcggtgcccgcggtgacgacgacgtcgttcgggtcgtggccggcggcgatggtagccacgatcgacaaggtcaccggcgtggcgcggctggccgcttgcgtgtcgacgctacggacagcgaagccgtccatgccggtgttgtcgaacggagggagcggatcggcgacgacgaccggcgcagcgaggacggcaccgagtgcctcgtcgatccccacctcgaccacgggtctcgcaccggcaagctcgagggctgctgcctgggcttcagcgagtgggatcacggtcctcctctgtcgtctcgaggagctcggtgagcacccttcgcagcgccggaccgaggtcgggccgttgaagggcgagctcgacgacgctccggaggtagtccagcttgtcgccgatgtcgtagcggtgacggccgtcgaagcgcaccgcaacgaccggctcgtgctcgatcagccgtgcgatggcatccgtgagctggatctcgcctcccttgccgggcggggtctcggcgagggcgtcgaagatcgccggcgtgaagatgtagcggccggtgatggcgagattcgacggcgcctcggaggcatcgggcttctcgacgacgctgcggacgtagtcgacaccgtcctcgtcgacgacaccggcggcgccgtagagcctgatgcgctcgggcgggacctccatgagcgagagcaccgaggcgccggtgcgctcgtggagggcgagcatgtcggccaggagcggcgaggcgggtcccatgatgtcatcggcgagcatgacgacgaaggggtctcggcccacgtgctgggcggcgacgctcaccgcgtggccgaggccacgcggttcgccctggcggaggtagtggatctggccgagatgggagatgtgctcgaccagcgccagttcggcgaacttctcttgcctggcgaggaggagctccagctcgacggcgcggtcgaagtggtcctcgatcgatcgcttgccgcgcccggtgacgacgaggatgttggtgaggccgtgcgtcacggcctcctcgacgacgtactggatggccggctggtcgacgaccggcagcatctccttcggttgggccttggttgcagggaggaaccgtgtgccgagcccagcggctggaatgaccaccttggtgagcacgaccgcctccatccatcgtctggcgcctggccaacagagcggagtctaggcgacgagaagggccaggttggggcctacgatggaaggtaccaacgtgcgcgccgtgtgcgcgagttgcgatcgtggtgcgatgagtcgttcgaccgaggtcgaggaggacaccgatgccgacctacgagtatgcctgcaagcagtgcggcgagcacctggaggtcgtccagtcgttccaggacgagccgctcagcgagtgcccgcggtgcggcggcgagctgcgcaaggtgttcggctccattgggatcgttttcaagggttctggcttctacaagaccgattcgcgtgcgagctcgtccgggtcggtcggtcgcagccacggctccggtgggagcgatgccgcgagcgctcccgcgtcgacctcgtccacgtcgacgtcgaccacgggcgctgagtcgtcctcgtcgagttcgtcgacggctggctctgccgcctagggtcgcctgcccgggcccgggggttaccggacggtaggctacgtccgtgcacaaccaccaggcctggtgcggtccttcggccgtgcgagcgagtcggggcgccagctctcgtggctgaggatcgtcttcgtatcgccctcacggtgtatcgagggaaccccacctccggaggccaaggcgtctacacggccgaactcgcgcgccgtctcgtcgcgcggggccacagcgtcaccgtcgtgtcgggtccaccgtatcccgcgctcgccgagtcgatccgcctcgagcccctcggcggcctcgatctgctgcgccagccggatccgtttcgccggccccgactcgacgaactcaccgacgcctacgacctggcagaggtcgcgctcttggcgaccggcgccttccccgatccccgcgcgttcggcctgcgctttcgcgcctggtggcggcgtgagggtcatcggttcgacctcgtgcacgacaaccagtcgctgacgccagcgcacgccgagctcgtgcgcgacggcgtcccggtggtggccgcgatccaccatcccatcaccgtggatcgccagctcgccctcgcggccgctggatcggtcaaagagcgcatcggcctgcgccgcttcttcggcttcgtgccgatgcaggtgcgcacggcgcgggtgatgccgcgcgtgctcaccgtctcgtccgcctcggctcgtgacatcagccgcgagctcggggtggcgcgctcgcgcctccgggtcgtgccgatcggcgtggacgcggaggtcttccgacccctcgaaggggtgcagcgcaccgccacgttgctcgcgaccacggcgagcgcggatgtgccgctcaagggtctcggggtgctgctgctcgcgctcgcgcgcctgccgagcgacgtcgagctcgtcgtgatgggcccgcgccgggagggctcccccatcgaggcgctcatcggtcagctgggcctcggtgagcgcgtgcacctcgtcggtgcggtgagccgcgagcggatggtggaggtgtacgcgagcgctgcggtcgcggtcgtgccgtcgatgtacgagggcttctccttgcccgccgtcgaggcgatggcctgcggggtgccgctcgtcgcgacgaccggtggggcgctcgcggaggtcgtcggcgggctggcgccccaggtgcccccgggcgatccggtcgcgttggcccaggcgatcgccgcacagctcgccgaccccgccggcgcccgcgagcgcgccgcgagcgcgcggagccgggtgctcgcgcgctactcgtgggacgaggcggctcggcgcaccgagcaggtctaccgcgaggtgttggaggcgtgatcacctttcggccggagcacctcgcaccgctcgagggtcgtcgcgtgctcgacctcggtgcgggtggcggtcgccatgcggcatggctccgcgaccacggggccctcgtcgtcgccggcgacctcgtcgtcgaaccgaccgatcgtgagggggtcgactgggtccgcctcgacggtgcggctctgccctttgcggacggctcgttcgacgtggtgctctgtgccgaggtcctcgagcacgtcgcgcacccggctcaggtggtgcgcgaagcgcggcgtgtgctcgcacccgggggccagctggtcgtgagcgtgccctcggcgtggccggaggccgtctgttgggcgctgtcgctcgagtaccacgccgttcccggcggccacgtgcgcatctggacgctcgcagggatccggcgcctcctcgaggccgagggtttccgcgtggtcgcgcgccatcgccgtcacgccctgcacgcgccgtactggtgggctcggtgcctgctcggcgtggagcgctcgggtcaagatccgcgcatcgagtggctggggtggcgtctcgtcaaggcggccgtcggcgaggctccgctgctcgcgcgcctcgagacgctgctcgaccccgtcctcgggaagtcgctcgtcctctatgccgaggccgcaccgtgctgagccggagcgagctgcgtcgcaccgcggcggccatcgcgagggtccagttgccctcggggatgatcccctgggccccgcgtcgccatggcgatccgtggaaccacgccgaggcggtcgccgcactcgcgctcggtggggaactcgccgccgccgagcggggtctggactggctggcgggcgtggtcgcgcgagacggtgccttctgtcagtactacctcgcgagcggcgtcgaggagcctcggatcgacctgaacgtgtgtgcctacccgatcgtcgcgatcgtcgcgtgggtcgcggcagggggctcggtcgcgaccgcacgggcgcacctcgcgtggtaccggcgcaccctcgagctcgtcctcggccaccagctcggcgacgggaggttcccctgggccctcgaccccgggcgtcgtcccctcgagggctccttgcgtgccggttcggccgcgatggtgatcgcgctcgatggcgccgcctgggccgcgaacgaactcggggtgctcgaggctgggccgatcgaggaagcgcgctcgcgtctcgcgctcgcgatcgccaaggacgaggggttcctcgaccgcttcgagtggtcgatggactggtactaccccgtgctcgcgggcgtcctcgagctcgatgcggccgaagatcggctcgatggactcttcgagcgggcgcgcgagtcgaccggccagctgcgctgcgtgctgtcggctccgtgggtgacgacggccgagaccgccgaggcggcgatggcggcctggcgactcggtcgcatcgcagatgcccgagcgctcctcgcgtccgtcgagtccctccgcgaacccgacggctcctaccgcaccggtatcgtcgtgccggagggacactccttcccgaccggggagtgctcgacctactcggcagccgcggtggtgctcgcgcaccacgtgcttcgtgccccgccgcgcgccggcctcatcgaggccctcgtcgcggcctcgtagcgcgcctcgcgatggcgagcgagccggtgcgctcgacgaggtcgaagccgaggtggagggcggcggtgagcatgcgccacggtgcctggcccccgtcggccgggtcctcgaagacgtcgtggacggcgagcagcccgcccggtacgaggaagcggcgggcgagctcgagatcgagatggcagctccgcgcgtcgtgaccgccgtcgacgaggacgaatcctgccaccgggcgcacgaggtcgatgaggccacgcccatcgcccacccagagggtgacgtgacgctcgaggtcagcgagcgccagggcgtcgcgcagcgtcccgagcgagtcggggctaccgaggtcgccgtcgaggagacgcgggtcggcccaggggaacggtgggcgcatctcgatggagccccggtggtggtcgacggcgaggaggcggaggcctcgttcgcgtgcgaccgagccgagccgcacggtcgagcgaccgcagtaggaaccgagctcgacgagccatccgcccgctcgcggggcgactcgcgcagcctcgatgagcgcacggagctcgtcggcggggaagaagcccgggagtaggtcggcgagagcagccggcccgtctcgcctaggctggtcggcgtgcagcttcgctggatcgtcgtcgcgctcgtgacgctggcggccggcggcgccctcgggggcgccggctggatcgcgggtgccatcgcggcggccgtggtcgtggccgccgggaggcgatgccgaggggcctcgtgcgcgagctcgcacggcgggctcaggcgagttggctggtgagccgtcctgcgtagcgggcgcgcaggcgcaggttgacctggtagcgctccagggtctgggcgagcacgcgcttgcccgccgggatcgggtgctcctcgaggaagcgtacgatctcgccggcgcgctggtaggtggtcggtccgatgacgagcgcgatgctctggagcatgcgatcgatcgtgttgagcgggaatcgggcgagcatctcatcgaagcgagcgaacaagaagtcgatcgcctggttctggagcgctgggttcgcgatcactcggttgatgaggaagggtgcgtcctgggttcgcacttcgctcatggccagatccagcacgcgccgcccgagcgctggttggcggaactccgcgagggcgaacaggtgacgctgctcgtcctgggggttgcgcgggtgccgatagcgatcgagcatgaaggcaaagtccgactcatcaccgaagcgcgcgacgacgccgaggacggccgcgacgagatcggcgctcggcccgccgatgccgctcatctcctcacggaagcgttctctggcgtgctggcgcacgtcgggatcctcggcgatgtcgccgagcacgtcgtaggcgatggcacgcgcggtgcgatcctgcggggtgtccgtcgggcgggcctcggtgccgaagtagtcgaggaccggtccgaacaccgaggccgcgagggcacggacgtgggtgatctcgctcggttcggcgatgcgctccagcaggccgagtgcggcttggccgatcccgaggatgttcgggtcgcgctcgtcgcggaggcgctcggcgagaccgaggaagtcctcgagtggcgcggcgcccgactgggtgagcgcccatgcatcggcgatgaggttgaagcgctcgagcgtctcgagctggccgaacgactcggccagctgggcgaggagctgttgggcgtagcgggcccgaaagacgccctcgccgtgggcgttgaccacgaccggcgcgggaccgacctcggccgacatctcgggctggtcgagcagcacccgccgctcgccatcgacgagcgagcgcagtgcgatcggcacgtgccacagtgatccgatggcgccgatcggatcgtcgtcggccgcgaggagccggaacggcgtctgggcgagccggacgccatcggggagcggatcgacgctgacgagcggatggccgccctggaacacccaggtgtccatcatggcgccgacgtcggtaccgctcgcctcgccaagggcagcccagagatcctgggtctcggcgttgccgtaggcgtgggcccgcaggtagcgacgcacgccgtcgcggaagacctcgggtccgaggtgctcggaggccatgcgcaagatggacgcccccttctcgtaggtgagaaggtcgaacatgtcctcggcgtcctcgggtgcgcgcaccgtgtactcgatggggcgggtcgagggaagggcgtcgatgcccatggccgcgagccgaccgatggcaaaggcctcccaccggcgccactcggggcggaaggcgtcgacggcggtgacctccatgaaggtggcgaaggcctcgttcagccagatgccgttccaccagcgcatcgtgacgagatcgccgaaccacatgtgggcgagctcgtggcagacgacgtcggcgacgcgctcgagatccacctgcgcggcgttgtcgcggtcgacgaggagggcggtctcgcggaaggtgatcgcgcccaggttctccatcgcgccggccgcgaagtcggggatcgcgagcaggtcgaccttgggggcggggtaggcgatcgcgaagtagtcctcgaagaaggcgagggcgtgctgggcgacctcgagagcaaaggccgtgagctgctccttaccgggcacgtgcacgacccggatggggacgtcgcggtggaagaccggctcggtcgcgacgaagcggccgatgaccatggcgagcaggtaggtggacatcgtcatcgtgggcgcaaaacgccaccggtcggtgccgggtgcgatcgtcgtgcgctcggtgacgggatagttcgagtaggcctcgaggtggctcgggatctcgagcgtgacggcgaaggtggccttggcgtcgggctcgtcgaagcaagggaaggccttgcgcgcaccggtggattcgaactgcgtcgtcgcgatgcgatgcgtcgtgccgtctgcgtcgcgataggtcgacaggtacagtccgtcgaggtcccgacgcagcgcacccgagaagtcgagatcgagcgcgaaggggccggctggcatgggcgcatccgcgtggagctcgaccacgccgtgctcgctgcgcgggcggggtgtgagggtgacgcgcgtcccggcgaacgtggcgatcgccgacgagatcgccagatcgaccgcgtgcacctcgagcaccgcggtgggctcgtggacgtcaccgtcgatgcgcacgtgacccgtgtaggggtcgacgtccgggtcgacctggagcgtgaggtcgtagtgtcgaggggtccagacccgcgaaagccggtacgggttgtgctctgtcacgggtgccacgctagctcggcccaggtccctgtgagacacgatgccaccggtaggctcgccgtgtggccagacgagacgtggtagcgctggggtcggcgatcgtggatctcggggtgcgggtgcgcgctcgggagatcgatcgtctcggccttgcacgcgggacgatgacgcttgccgaggccgaggacctcgatcgcctgatcgaggcggtcggtggtgaggtcgagatccgaggtgggggatcggccgcgaacacggccgtcgggctcgcttcgctcggggtcgacaccgccatggtgacccaggtgggcgacgacgacctcggggagcggtgggcaagcgaggtcgccgaggccggcgtcgaggtcgtgctcgtgccggcgccaccgggctcgcggaccgcacgctcgttgatcatggtcgacgaggggggagagcgcaccatggtgacctcgctcggggtcgcgagctcgctcgatgtcgacgagctccctctgcccctgctcgccgaggcccgctggtgcttcgtcgagggctacctgctcgatgcggccggcgacggactcttcgagcgcctcgatgtggtccggcgtctcggcggtcggatcgccctctcgctcggtgaccaactgctcgtcgaccgtcaccgcgatcggctcgtgcgggctctcggtcgcgtggtcgacgtcgtgctcggcaacggcgccgaggcggcccaactcgtgcgtcgccaggccctctcgaccatcgtcgaggagctccaggctcgcggcgtcgagggcgcactcacgctcggcgccgatggcgcggtcgtcttcagcgcggacgaggcgctccatcagcctgcgcccgagaccatcgcagacgtcgtcgacaccaccggtgcgggcgatcagttcgcggccggctaccttgccgcgctcgtccgcggtggcgacctctcgagccgagcgatgctcggcacgcacgtcgcgaccgccgtcgtgacgcacgagggcgcgcgtccacggcccgacaccccactcgccgcggctccggcgctcaccgaactcttggccgggctcggactgagtcgtgaggcggatcccgccttcgacgagcggtcgagcgatgagcctgtggcgggggagcgccacggcgagtgacgagccatcgggcccgcgcgggtgggccgtggacctcgtgtgcgtgcggtcaggtcgccctgcgtcgttcgtcggcgcgcggggggcccgccatggctcgggtacctcggcgcgcaggtgccggcagaagttgcgcgatggtcagggcgtcgggctgggtgagggaccaggagcagctgggctgcgacgattcgtgagccagacgagggtcgcgagtgcgacgccgaccccggcgaagagccaggtcagctcccgcgcgccgaggcgcgggaggaggagcgctgccgcgagacccgccgcggtccacccgatcgagtagctcgcatagaggacggagaaggcgctcgtgagttcgttgggcgcgaacatggtggggacgagtccgacgcggagcgcgttgatcggcgcgatggcgatgcctgcggcgacactggtcgcgagccagagccacgcggcaggcgccgagagcccccaggcagccagggccgctccaagaccgagcacgagcgctgcgagggtgctcacacgtgcgggccgatggctccagatgcgcgtgtagacgaccccgctcgcgaccgagccgacgctcatcgctgtgagtgcgacaccgccgagcgggctcgatcggagccagtgcacggcgagagggaccgcgagcaggaccgcacccccctcgagcacgccctcgagcgccgagagcacccagagccaggtgccacggcggagccggtgggggagggctcgctggtcgatgtgcggcctcgtgcggtagcgaagtgccccgacggtggcgacaaggccggcgagtgcgacgaggtcgaggaggagcggacggaggccgacgacgacgaggacgctggcgacgaggggcgccccgagccacgtgagctcctgggccaccgagtcgatggcgaaggcgcgcccgcggtcggaaggatcgaggcgatcggtgaggttgcggcgcagctcgcccgtgacgagggtcgctgcggcaccgacgccgaacgcgccgacggcaccgagggcgagtggggcaccgacggtgacggcagcgagcagcgcggcggcgcaggtcatgaggccgaggcggctggggagcgacgcggcagcgacgaaggggacggcgagcagggcgagcgcgccgacctcgccgagggggacgagtgccgcgaggccgctcgcggtggcgtagccaaggcgcgcaccgacgacgtaggtgatcgcgatggggacgaggaagttcgcgacgcgatagggggtggcgagcgcgagccatcgagcgagcgcgcgaccgggcggcgcgctgcgttcgaccatgggagtcaccctaccggcgagcgcacgacgaggtgggcagggcagcgctcgtgtgattggatggtaggcgtggcacttccactcgaacagtacggcttcgtcggcgatctgcacaccggcgcgatgatcggtgcggagggcagcgtggcgtggctgtgcgtgcctcgcttcgacgccgatgcgtgcttcgcgtcgctcctcggcgacgagtcgaacggcacgtttcgcatcgctccgtcgggcccgttcgagtcgacgcagacctacgtcgaggacacgctggtcctcgagacgacctttgcgacccggactggtcgtgccaaggtcatcgacttcatgccgatccgagagcgccatgcacggctcgtgcgcatcgtcgaggggatctcgggcgaggtttcgatggaggtgaccctgacgctgcgcttcgactacgggcgctccattccgtgggtgcggcgcgtcgcgcgtggccactcgttcgtcgtggggccgatcgcggccctgctcgagaccccggtcgagctcgagggtcgcaatcagcgcacggtcggttcgttcgtggtgcacgagggcgagcgggtcccgttcgtgctcagtttccacgactccgtcctccccccgcccaggcggatcgacccccagctcgagttggccggcgtcgtcgagtggtggcggcgctgggtcgccacttcccaggtgcgcttcggtcgctacgagccccttgcgcgacggagcctgatcaccttgaaagcactcacctacgccccgacgggtggcatggtggccgcgctcaccacctcgctccccgaggaccccggtggttcgcgcaactgggactatcgcttctgctggctgcgtgacgccgcgttcgccgtggaggcgttcctcgcgcgcggcatgctcgacgaggcccgcgcgtggcggggttggctgttgcgcgccatcgcgggggacgcgcgtcagatccagatcctctacggggttgggggtgagcgcaggatccccgagctcgaactcgagtggctgcccggctacgaggggtcgcggccggtgagggtgggcaacggcgccgcgggtcagttccagatggacgtctacggcgaggttgccgacgtgttgtggcggatggtgcgagctggcatccgtcccgacgagaacgcatgggagatccagcgctacctgacggacttcgtcgtgtcctcctggcgtgagcccgacgacgggatctgggagatccggggcgagcgccagcacttcacccactcgaagatcatggcctgggtggcgatcgatcggggcgtcaaggtcgccgaggcgatgggcgtcgaggcgccctcggcctggcacgcggcccgcgctcaggtgcacgccgccgtgctcgaggaagggtggaacgagtcggtcggtgcgttcacccaggccttcgggtcgacgcggctggacgcggccgtgctgctcgccccactcgtcgggttcatcgaccccgacgatccgcgggctcggcgcacggccaagaccatcgcccgatccctcacgaagggcgggttcgtccagcgctacgagccgaccgccggtgtcgatggcatcggcgagcccgagggtgcctttctgccctgcaccttctggctggtgcagaacctcgccctccagggcgaagtcgacgaggccgaggtctacttcgagcgtgcgagccgggcggccaatgcgctcggcatcttctcggaggagtacgagccgacggagcgacgcatgctcggcaacttcgcccaagcgttcacgcacgtcgccatgttgcacgccgcccacgcgctcgagcgtgctcgcgaggcccgtcgcgacggtgagcgtgagcgccagggggcctagcctcagttctggagatggtcgagcaacgggaaggactggccgatgacgcagaggattccgttcgtgctcttcggggcgaccggcgacttggctcgccgcatgctgttgccggcgctcatgtcggtgcgagagcgccatgcagactaccagttggacatcatcggcgtcgcgggtagtcgtttcgacgacgagagcttccgtgcgcacgtggtggagatcctcaccaaggacaagcgctgctcccgcgaggaggccgagaccttcgcgaagaccatcagctacctctcgggcgactaccacgacccgaacctcttcgacgcactggccgctcgggtctcgcccgacgagcgtcctatcgtctacttggccatccctccctcgctcttcgaggtcgtgatcgaacagctcgcgcgcgccggcttcgacgagcacgctcggatcatggtcgagaagccgttcggccgtaacctcgccgacgcccagcgcctgtcgaaggtgctcgcaagccacttccgacccgagcagatcttccgcatcgaccacttcctcggcaaggaggcggtgcagaacctcttggtgttccgcttcgcgaactcgatcctcgagccgctgtggaatcggaactacgtctcgcggatcgagctcaacatgctcgaggcgttcggcgtcgaggggcgcggcgccttctacgacggcgtcggcgtggtgcgcgacgtcgtgcagaaccatctgctccagctgctcacgctgctgctcatggagcccccgctcgcgatgagcgggcgcgacctcaccgaccagcgcacgaaggtgctccaggccatccgtccgatccggcccgacgacgcggtgcttgcccagtaccgtggctatcggctcgaggccggggtggccgacgactcgtccacgcccacgtacgcggcaatccgcctcgaggtgaactcctggcgctgggcaggggtgccggtgttcgtgcgtgcgggcaaggggttgcgcgagacccgcaccgaggcggtcgttgagttccggcgcccgccgacgctgatcttcggcaccggggaaggggagcagcaccagcccgagccgaacgcgttcatcttccacttcaagcccgacgggcgcatcgagctcttgatgcagtcgaaggtgcccggtcctcggctgatctcgagaccgacgatgctcacggtgtcctcctcggacgactcggcgcgctccgacgacgcctacgcccagctcatcgacgacgtggtgcgcgacgatcagacgcgctttgcgacccaggagtcggtggaggctggatggcggatcgtcgatcccgtgctcgaggcgccggccgagtcgacctacgtcgtcggcagtgatggaccgcgcgaggccgatcgcctcgtcgccgacgtgcatgggtggtatcgatgacggcgcaggtggcgagatgggggtccgacgatgagtgacgagatcctcgcggtcgatctcggcgggacgaactttcgcatggccaaggtgagcagcgagggcgtgctgctcgctcgggccgagatcccgacggcgtcgatcaccgacgtcgtggacggcctcggtcggctcgtcgaccaggtcgacggtggcggggtcgcaacgctcgtgttcgcggcccctggcgtcgtcgaccgtgacgcgggcacggtcgtcttctgcgggaacctcgatgacgccgtgcggcgcaccatcgtcgcgagccggatcgccgatgcgctcgccaagcgcgtcgtcctcgtcaacgacgccgatgcggccgccatcggtgaggcgtgggcgggagccgggcgcggcgctcgaacggtcgtgtacgtgaccgtctcgaccgggatcggtgcgggtctcgtccaccgcggcacgctctacgtcgggcgcttcacgggcatggaggccggtcagatccgtctcggcctcgaagacgtcgatcgcgccgagcacgtcggttcggggaccgcgctcgctcgtaccgcccgccagctcgggctcgagctcgccaaccccgaggtcgtgcgccgcgcgcaccaggagggtgtcgcgcgcctcgcgctcacccgcacgatggaggcgctcggggtcacgctcgccaacctcgcctggctcctcgtgcccgatcgcatcgtcatcgggggcgggctcggcctgtcggatccgctggtcctcgagctcgccacgcaggcgttccaccgcgccggcccggcgttcctcgaggatctctccatcgtcccggccgcgctcggcgacgacgccggactcatcggggcggcgttcgcggagcgggcgctccaaggcgcccagtgaggttctcgctccagtcgacgcgctcgctcgcagcgctcgctggggcgagcatcctggtcggtgcgtacgatcaggcagcgatcggggtcgccctcggtccgctgcgacgcagctggcacctctcgagctccgaggtggcgctcatcgcctcggcatcggctgcggggatggtggtgggtggcctcgtggccgggttcctcgccgatcgctgcgggcgtcgtcgcctgctcgtcgtcgacgtcgcgctgctcgcgctcgcgagtctcgccgctgcgttcgcacctggggcgggtgtcctcctcgctgcgcgcttcgtcggtggggtcgccgtcggggcgagctacacgatcgtcttcgtctaccagcgcgagctcacgagcgccgcgatgagcacgcgttggatggcgaccacgctctgggcggccaactggggcatgcttcttgcctacggcgtcggcgccgtcgcaggtggcaccacgttgggtgcgcgcatcgtcctcggcgtcggtgcgctcggcgcccttccgctcgttgcggcccgacgtcggctcccggagacccggacgacggatgggcacctctcgctccgcgcgagcctcgcagccctccgttcggtgcgagagctcgaggccgcgggggcgtggttcctctatcagatctctgaccagggcatcaacgtgctgctccccatcgtcgtcgccagcctcggcgtggtgtcgctgcggagcgccgatgcgacggcgctcgtcgtgaaagccgtgaccatccctgcgtcgctgacgacgatctggctggtgggttggctcgggcggcggcgtctccagttggctgggttcctcggccgagcgctcgccctcgggctcgtcgcggtcgccttcgccctgggcgctcctctcgtcgtgaccgtgatcctgctcgcggttggtcttgcggcaggctccatgggccccgacaagacgacggtgatgggggcctgtctcgaggacgagccgatggcgctcgcgacgcgccagggcgtcgcacagaccgcaggtcgcctcggtggcatcgtgggaccggcggcgttcgtgctgctgaccagcgtcggtggcccggcacccgggatcgccctgttcgcgctcagcgcgctcgcgggctgggccatcaccctcccgatgacggcgtgagctggtcggtcggctagctcgcggcttctcggggcgcgtcgcccaccagcacgtcggtcgcgacctcgggagcgacgacgttgatgggcacgccggtgccgagctcgaagcctgcacgggtggtgagcttcggatagacgtgggcgtgccagtggaactgcccgaaggcgcgatagggcgatgagtggaacaccacgttgtaggcgacgggcccaaggcgcgtccggaggcgtgcgaggccgtcgcggaccatctcgccgacggcgaacaaggtctcctgggcagcgaggtggaggtgggctccgtggtgacggggcacgatgagcagctcgaacggcgtcgccgaccagtagggcgcgatcacgaccgcgtgttcggttccgagcacgaggcgctcaccgatgctctcttcgagtgccaccgtgttgcagagcagacatcccccgacgaagcgcgcaaaacccgcctgctcgtcggagagctcgcgtgggacgaaggagatgccgaggagctgtgcgtgggggtgggccatggaggcgccggcgtcacgcccttggttgacgatcacctgggagtagcggatggcagccgagtgtgagtgcgcctcgatccgatctcggatggccgacatgaccacgtgcgtctgctcgtcgtcgagcgctgcccagctcgcgtcgtggtcgggggtgagcacgaggacctcgtgaatgccgctcgcgggtgcgctcgtgaagaccggtccgtgggtcgtcgagaccatgggctcgtcaccctcgaaggcgggatagaggttcgggacgacccgtacgctccacgagccgctcggcccgtaggtctcgagggcgggaggggtgtcttcctcgttgcccgggcagaaggggcaaggacgcgagtcgtcctcagggccgtgctcgtcggagagggcgagggcctttggacgccagcgacgctgctctgcgacgacgacccagcgaccggtgagtggatcgaggcgcagctgatgcgtggccatgggctccctctgctgagaacggacttatcgcccccagcgtagcgcgtcggcggttgctcgggcgggcccgccggtcgctggcgctcgtcgtggttgggtgtcgcctcgtagactcgctcccatggcggtctacctcgaccacgccgcgaccacgcggatcgcgcccgaggtcagggcgctcatggttgagctgctccgcgtcgagggcaaccctgcggccgcacacgcctgcgggagggccgcgaaggccattctcgagcgggcacgggtcgaggcggccgacgcgctcggcgtctcgtctcgtgaggtcgtcttcacgggttcggcgaccgaggcgctcgacatcgggatcggcgatctcgacctcgcgcccgacgtcgtcgtggccacgagtccgatcgagcaccccgccgtgctcgatgcgctcgcggggcggcccatcgtcgagcttcccctcgacggcgaggggcgagtggccatcgggtcggcgcgcgagatcctccgcgacctcggcccacggctcggagcgctcgtcgtgaccggggctgcgagcgagaccggcgtcattcagcctgtcggtcggctcgcccacatcgcacgcagcgtcgctgcgaaggcggtcgtcgtgagcgacctcgtggcgctcgcaccgctcgggctcgacgcgggctctccggctcgtcggatgctggaggtcgtcgacgtcgcggtggtcgcgccgcacaagctcggcggtccgacgggggtcggagtcctcgtggtgcgggagggaacgccgctcgcgccgcggcgtcgctacgtgggccaggagcgcggcctgcgcggtgggacacaagcggtgtggctggcggggggtgcggcacgcgccctcagccttgcggctgcccagggcgcgtcacggcgcgaggccatcgtcgcgcgacgtgaacggctcgagcaagcgctcgtggaggcggttcccgctgccaaggtggcaggcgcgggtgctgcgcgtgtcgggatcagcctggtggccgtccctggggctcgctcggaggaactcgcggtgctcctcgacaccgaaggcgtgtgcgtgtcggtgggggcggcctgtcgagcgggtgctcccgagccatccccctcgctgctggcgatggggtgggacgagcccgaggcgcgatcggtcgtacggctgagcgtcgcgccggagacgaccgacgacgacgtcgtcgcggcggcgatggcgctcgcgcgtatcgcggagctcctcggggccgccgggtgatcggtcttctgtcggccacgggtccgatcgcgacggtgctcatccttgcccatgtcggcgtcgggatcgtgggctatggtaccaatgcgctggccggctgggacgcaagcgaggtcctgcgcggtcggacggaggggcggcggtttctcgacgggagcgtcgcgccatcgcagctcgccatgctctgggttccgatcctcggggcgctgctcgtggcactcgtcgatccagaggcccttggcacggcgtggttcctcgtcgcgttcggtgcgtggtgtgtgagtgtcgcgctcgtgctcgcggtggcgtggccggcccagcgagaactcgggcgcttgctcgctgcgacgtcggccgtacccgaggcgctgcgcagaccagctcgacggatgctgcgtgcgcagcagctcatcgtggtctgctacgtcatcgcgttctggttgatggtgctgaagccagggaatcggtaacgatctgcgtcgtacgagcgtgatcgattggggtggtggcctggatcgcaaggatgccgatcatggatcggactgatcgccgggtgcgcgatgcgacgggccttctcccagccagtgtgacgcctgctaccggaggagagaattgacatgacgccgagctcgcccgtcgcgtctctgccgcgcggcgccgacgaggacgccaccttaaggcaggtccgacgaacgtaccctcgctggtgctcgaccagcggcgcaggtgtgttggcgtcggctgtgacctcggcgcgagcgacgcgactttggcaactcgggtgggccgggaacgcatcgatcgacgtgagcaagcccaggagcgcgcgcgtccacgcggcgacgccgccgaggagtggctggccgcatgagcatctgctcccaccgcgaatcgagagacctgtgccacacacatggtcatagcagacaggcgatgctcttggcgactcgccagaaggtgtcgcagccggcatcggtcccggttggggtcgcaagaagacaagcctgtcatgagccacatccacgacacgccctcatcggtggacgtgcttgcgatcaagccaccgcagcgggccgggatcactggcggcatcggtccccaggcggacaggtcccaggcattgcaccccgacggggtcactcggttcatgcgtctcaccgggaaccagacgacgacattgatcgatcctgccagcaggcccgaggccagccaaggacgatacgtacaggtggttcagtccgctcccacgacactctcgtgccaacgtactcggctgtgtgcgagggatggggcatcacgtcagcagggagggaactgtcgactgcacctcggtcgaatgcagggaccgagaacaccgcccaggcacggtgtgcctgggcggtgtggagtgggggatcagtggtctagtacagccgtgcgagggttgaggccggctccagatacaccgtcttcaagttgccgctcggggtgaactgcaccacctcgaaggaggagaagacgttgtggtactggttgaagttctcgttgccactcgcgccctcgtagttgatcttcttgccctctttgaggagtgttgcgcagctggtgtagctgtagcacttgatcccaggagggttcgagaccttggtgatgtagggccgccacaccgtgggattggacgagtgggctgcatccatggcgagtgccgcgataatcaccgcgtcgtacattgccggggaggccggcaggggctggttggtgtgccacaccgcctcgtaggccgacaggaaggccttgttcgactgggcgtatcccggaggcgccgccatgccggtcagccatcgagacgcattggagagtcccatcgcctgagccatctgcagtgacgcacccgtgtcgcccgtgatgtaggggatgttgagatgccccagctgtttgacgttggcgaagaaggtgctcgctgtctgcggatccatgtggaagaacacgcatcccggctgtgcacctgagaacatcttggccacgaccgacaggtaggagctctggcccgccacgatcgtctcggaagcgacgatcttgccaccgagcttctcgtacgcacgggtcactggtccaacctcggcttgcgcgttcggcccggagtcgtacacttctgccgcctgggtgcagtgcttggccgtgtaggcgtagtaggcctcgcccgacaggagctcagagtctgacgggaacactcgatagacgtatgggtagcgcatgtagtcgagctgcgtcgtgccgccttccatgagatcgaccacgtggtcaggaccgaagtcccggatcacgccctcgatctcgagcgaggacggtccaaagaccacgaccggcttcttgagcagcaacgtccggagcgccgtgactgcgtccacagggtcccccgcagtgtcctcgagctgtgaggtgatcttcgcgccgagtacgccgccaccgtggttgaccgcgtagatgcccgcgagcacgccgtggtcgaaccattgtccgacgaacgcctccttgccgctcatcggcagaaggatgccggcttgaatcggtccggtcagcttgccagaggagctcgccgagctggccgacgagctcgacccgcatgctgcgagcgccagagatccgagcgcagcaagccccgccgccatgccacgggtccgccaccggcgagtcccctgtcggttccgttgcatctatccttcccccttcgttgtcactcgtgatcttgggaatcacgatcccaggaagaggcgaccgccgcctcctccgccccccccgattggccgaggaagattgctgccatgtcgagctttgcgagctctgccggcgccccgtcacgaagattgcgtccggcgacgaggatgtagacccagtccgcagaggcaagcgcccgctcgacgttctgctccacgacgaccacggtcgtcccgagggcggccacctgggcgatctgcgaccagacaacgtccacgttcgccggtgagagaccggcagtgggctcgtccaggagcaccaccttcgggttgctcatgagcgcacggcccatgccgagcatgttgcgctggccaccggacagcagacccgccttgcgcttgcgggccagcgccaaggcggggaagatctcgaagaccagctccttgcgggcgtcgagcgaacctcgctcgacgaatcctccgagctcgaggttttcctcgacgctcatcgaggcaaagacgttgtccacctgagggacatacgccatgccagctcgggcagcgtgatgggcactgagatccgtgatgtcggtttcgtcgagatacaccttgccggccatgcgcggaatcagtccgaaggtggccttcagcgccgtcgacttgcctgccccgttggggccgatcagggtgacgacctgggagaccgacgcgtggaagctaatcccgtcgacgatcggcgccttgccgtagccagcggtaagtccctcaacgcgcagcacgtgcatcgctggctcctcccgtcaagtacgcattcacgacggcctcgttctcgcgcagctcggccatggtcccggttgcgagtgcgcagccagctgccatcaccacgacgtggtcggtgatccgctcaaccacatcgaggttgtgttcgacgatgagaaaggtcacgcccagcgaagagcggatctcgttgatgtgttcgcagatgcggtcgaccagcgcggggttgatccccgccatgggctcatccaagatcagcatcttcggctcggccatgacggcacgagccagctcgagcagacgcttctggccaccagagaggctgccagcgtactcatcgcgcatgtgctccaacccgaaggccgcgaggatccctcgggcgcgtgcaaccagctccagctcctgctgtcgatagcgccgaggtgcgaagagcgcggtcatgagaccctcgcccacctgacggagcggggacaccatgaggttttccatcacggtcatcgccggatactcccgtgagatctggaaggttcggatgagaccgagctcggcaaccttgtggggcgcgagtccagtgatgtcgtgcccgtcgaagttgatcgtgccggcgtcggggcgcagcgctcctgcgatgaggttgaccatcgtcgacttgcctgccccgttcgggccgatcaagccggtgatcgatccgtccgcaacggtgaagctgcagccatcgaccgcatggacacccccaaaggcgcggaccacaccgtcgaccaccaggatcgggtcagtcgtcgacatcgacggcacctccagccacgggaatcggatcgggcagacctacgagcttgactggctccgggaagcgcgctttgcgctctgggacaacgccttgcggacggaaccacaagacgaggatgacgagtgcaccgatgcacatgttgcggatctctgggatcaggttcggcatcgaggagatcgctggcaagaatcgagtggcctcattgaagagcaccgcaaccaggaacgatcccacgaccgcaccagtgttgttgccacgacctccaacgatcagggcggcccagatgacgaaggtctcactcgtgccccagcctgccggggccagcgccgtcacgtaccagatggtgaggacgcccccgatcccgacgaagacgcaccccagcaccatcgcgatcatgcgcactcggtaggtgtgcttgccgaaggcctcggctacgtcgaggtcctcgcggatggcccgcatcgtgcgaccgagcggcgatcgatagaggcgattggcaagcagccagcagatagccatgaccacagccgagaaggcgagaaagaccagggaataggagttcggtccgagctggagcacgccgttgaagggttgcggcaccccgaccagtccctcgaacccatcaaagatcttggtgttgttcccaacgagcccatagatgatcgagccggcggcgagcgtgacgattgcgaggtagtcgctgcgcagccgccggagcgccacaagcccgatcaggtagccaagcaatcccgctgacgccgccccgatcagcatcgagattggccatgggagcccaaggccaaggatgtagtagatccccgagctcggcacctcgtgggtcagcgacgcgacccccgccatgtaaccgccgatcgccatgaaggtgatgacggtgaagttcaggatccctgcgtagccgaactgaatgttcaagccgagcgcgaagatgttgtagatacagaagtacaccccgagagtggccgcataccccacgatgacgcccatgatgtgcctcctaagcctttccagcggtcgcgaagatcccctgcggccgaatgagcagtgtcaagaccagcaccaagaaggcgacgtccaggctgtaggcagcagagatcacgagcgtcgagaggctgatggcgagcccgatcacgagtgcgcccaccatggcgccgtagatcttgccgataccgccgaggatgaccgcggcgaagatcacgaacaggaaggtgttgccggtgaaggcttgaaactcgaccgtgttgagtgcgagcgtgatgccccccagtcctgcgagcgcaccactcaggaaccatgtccagcgtgtggtgcggcgcgtgtcaatgccgctcgcggcggcgagcggcgcgttgtccgacatcgcccgcatcgccatgccgagtcgcgtgcgcgtcagcagcaggtggaccccgaccatcaccacggcggcgacgatgacgaccccgatctgggcggcggtcaagctgaaaggaccgaggtgcaggggattgcctgctgcgatggggtagcgatcgaacccaaccccccagattgcctgcaccaggttcagtaggatgagcgagaggccgaacgtcacgatcaagaggaagaagccactcgtgcctcgacggacgaaaggctcgagcacggcgacatcgaccgccacagccgcaagcccactggcgatcaccccgaccaagccgccgagccagaagggcaagtgcaggccgaccgacgcagtgtaggtcacgaacattcccactgcgagataggctccgtaggcaaagttgacgtagttcgtgactccgaactgcaagctgaggcctaccgcagcgagcgccagcaccgccgaagtcacgatcccaaagcccagggtcagtaagaacaggctcattctcccccctctcgttggcctctcgtcttagtgccgcttgcaccgcgtgcgggagtttggccaccaagatgcagtttcgtgcgaatcgtgcactttggctcgtttcgctcaccgcgcctcacccctgggagctcgcgggtccacgcagcgaccgtgtccgtgccgtggcgacgcgtgctgggggagggacatgaacagtgcatgctgactcgcccctggtgacggcccgccaagtgccggcgaggcgccccaccggaccggacaattccatcgcgtcgcttcggcccaggtcctcgatcggcaccgcacgatcaggaggtcgttcgcgagcgcgacgtgaacgagccggtgcttgccagccggaccaccctctgttgcagtcgtacgtgaggccacgtcgctggtcgtgtcgctgcacggagagggtggttgacgattgagaccccggccaccatgacgcccgagcgcatgccaagtcggcacgggaccagagccatacccgatatgcccggaccaagggttctcgagcgaacccgaaggacgagatgctgctctgcattcgtgggctcgggcaggccagcgatcggggcgtcaagtcgttggccgatgctgttcagcacccctgtactcgggcctttgccgagcgtgacagcctctcgaagcgagggggagagcttcggtccgccaaacgggtcgcgggtccttccgcgtcagcgagtggcgttgccgcgtgagcgtggtcaagacggcgcgcggtcgtgcccgctagggtcctcgtcgctctgtgcagccggaggtcgcgcgtctcgagtgctgccctgttgggtgaggccgaccgcatcaaggctcgcaaggccaccgcgttgcagaagacgtcgccgtagacctggagcgaccgatcgtcgccgacgctggcgatcacgaggcatgaggtggccccgacgcgtgcggtcgtcgtgcgccgaggagcacacagcgcgtcgtctccggggccacggtcgtcttggggaagcgagacggcagctcgacactgcgccgatgtcgagcgcgcggaagaaggtacggtaacgtgttcgcgctcttcgggtgttgtgtcgaccagcaacgcccatcgtcggcatgaggttgagccgcggacctaccactcagcgaaccgcggccgtgatcgccgagatcgggcctgcgcgagggcggacagcgacttgcgatggaccggtgcgttgcccaggggggagtggccgaggatcggcgtgcgacggtgtccgatcccatcccaaagcctgccaccggccgagcaggagagggccgtccggagctgcgggccgaggtgattggtcttccccgcagaccgaagcatgcagggccagcatcgtgccctgcctgaagtcggtctgcactggctgagagacctggtgagctgcgacgaccgaacccgggagagcctcgtcttgccggttccgctcgtcgctcgccatgggctcgtcgctcgtgcgattacgtggatgaggttggtggcgatggtgatgcaacctcgtgtttcggttgggactcgagtccaaccgaccctgacgtggcgagccggtgcgggtgctaacgaggccatcggtagcgatgctcaggtcgcccgattccgtagcggagcacgagctcgatccgtcccatgcgcgcgaggtgtgagaggtagcgttgcgcggtggcccgagagactccggagcgggctgcgacttcctcggccgagagctcctccgtcgcgccgcgcagcgtctcgacgatgaccccgagcgtctcacgcgattgccccttgggcagcgaacgttcgacgctcgttcgcagcgtggtatagatctcgtccaccttgtcctgactggcctcctcaagggcgtcgagcttcttccgcatggcggcataagcctcgaggcgctccatcaggatcgagggtgcgaagggcttcaccaggtagtagagggctcctgagcgcacagactcggcgacactcgcaacatctcgtgcggcggtaatcaccatgacgtcgatgggtcgccctgcgatgcgcccgagtgccttgagcacttcgagccccgagacatcggggagatagagatcgagcaacacgaggtctggatggtgctcctcggcggcagccagcgcgtgcgctccggtgtgggactctgccacgacctcgaagcccgatacacgctcgacaaaggccctgtgcagcgcggcgacccggaagtcgtcgtccaccacgaggattcgatacctcatgagtgctgcgtgtcagagaaggctgggatgtgttgacgcaggatcccaggcaatcgaacgacaaacactgcgccaacctctcgcagcacctcgatcgaccctccatagcgctccacgagttgcctgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagccgtacgagggcgaggccaagcccccggcgtgtcccactgcgcgtgagcttggtgctgaagccgtcgagaaagatctctgaggcgatgtgggctgggacccttggacctgagtcggcgacgatcatggtgagcgcatctcccatggcgagaaagctcgcctcgatccaggcgttgggagtatctgcagctgcatcgatcgcattgtcgatcaggttgccgagcagtgtgacgagatcgctcgcgggcatgcactcgggcggcacgcggtcggaaggtccgaggcgtagctcgacgtgacgctcggcagccactgcactcttcgccaacaggagcgccacgatgacgggattgcccacctcgcgggccaggcgatccatgagcgcggtgtcacgaagtgcgatgtcggtggcgaatcggatggcctcatcggtctctcccagttcgatgaggccgacgacggtgtggatccggttggagaagtcgtgcgcctgtgctcgaagcgcgtcggtgagtccgagcatgccgtcgagctcgcgcagcagtgcctcggactcggtgcggtccacgagcgtgacgacatagccgagtaggcgcccttgcacctcgacggctcgacgattggcgatcaggattcgatcctcgtggacgacgagcaggtccttgcccacgacctcgcccgtcagaatgccttggagtcgaccatctggcaccagcacgccgacagggcgctcgaggaaccttactggaaggtgtaggaggcggcgggcctcctcgttggcgaactggaaccttccctcgggatcgatccccgcaaccgcctcccggatgccgtggaaaatcgcgtcctgttcctggatgagtttggtcagctcgtcgagctcgaggccaaaggtgcgatcgcgaagccatcggctcgccagccacgatcctgctgcaccgatggccagtgccacggtgagcgcttcgagcgcacgcactgcggatccggtgatgagggcaagtgggttaggcgccgagaactcgacgacgactccgagaccagccgagtgcgagatcggggctcgcgcagcgacgggtccggaaccgccgttgaggacgccactccagacgtttcgtccgtcgagctcggcgacgagctgaccacgagtgagtgatccactccccgcctcgacgagaccatggcgattcacgactgccacggcgagcgcgccaatggccctgcgcgactgtgtgaggagggcttgtcggttctccgttccggactcgagggtggcgatatctgggttcgcagcgacgctctgtgccgcaaggagcgcctgatgtgtgtcggatccgagcccagtcgggacctcgagcgtcacccacgcgatcgctgcaatgacgctcaccagaatgatcccggcctggatggccagcatgcgagaggcgagcttcgcgccccgcctacctctcgagaccgacggatcgtcacgcatgtgtaccccaccacaacacgccgcacggtctgcattgacctgcccttgagtgtacggtggtcgcttgtgcccgcgcaagtgagacgaagtgaaccgagcctcctcgaagtcgcgcggtcgctcgtggcgcagcggccagcgcgtgtgtaggcaccgggcgttaactgaccctagaacaccggaacgatagtgacccaccctccagagtaggttgccctcgagaatcaagaagggggcagcccgatgctgaagggcaggatgctcctatgtctgtcaagtggcgagcgcgctcagcccttcgagccactggcgatactggatggccaactcgtcgtgacgcgtgaggccgccctcgagccgcgataggcgccccacggtcgttgacagggcagctgcagccgcttggagcacgacgcccaagggagtgccgtagctcgcgaagttccgtgccggtgatgacgggcgcggggttcgtgaggaggccaaagatctcccgggcgatggagcgcttcaggcagcgcatgatctctcgatcactcttgccttcctggcgtcgccgctcgaggtagcgcatggtcgggccgtgacggtgggcgaggcggaccatcgcgatgcgccagagcgcgttgttcgcctcacggttgccaccccggttcaggcgatgtcgtacgaccttgcccgaggaagctgcgatggggctcaccccggcgagcgcagcgaaggaggcctcgctccggaggcgctcggggttgtcgcccgctgccacgacgagggctgaggcgacctcgggcccgacacccggagctgcgacgagtgcagggttcacctccgagcacaggcgagcgatcgcgtggtccagctcggcgatctctcgctccagggcctggtggcgcctcgccagcgtcacgagcgccagcgtcgttgcggcaccagtcgcaagtgcccacagcgtcgccccaggctgccacacgctccacctggcgagcacgacgaagcctcgtgagttcctcacgctgctcatcggccaaggtgacgatcaggtcgcggagctggttgccagcttcgggtgcgtgctcggatcgcagagcgacgcgcgacgccaagtgggcttccccccatttgcttgacagtctgaatttaggccacggccgcctcctcccgggcccaggtgagctcgtactcgattggcggtcggtacccgaggctcgagtgcagccggacggtgttgtagcgatggatccaggctgcgatggctgagcgggcctcggcgaggttcgcgaagcggtagcgagccaccagctcgcgcttcaaactcccgaagaaggactcggccacggcgttgtcgtagcaagtagtcaccctgcccaccgactggcgaacgccgagggtcgcgagcaggctccgaaccttccgggagaggtactgtccggattcaaccggtcgtcgcaacacctgttgctccatctgagcctaggagtgcctccagcgcttctgctggggtccgccagccgagtgtcttgcgaggccgctggcccgagcgcgaaggcgaccgcgtcgaggtcgtgctcactccagcgggacaggtcggtgcccttcgggaagtactggcgcaggagtccgttggtgttctcgttcgtcccgcgcatccatggcgagtgagggtcggcgaagtagatggcgagtcccgtgtcgatgcgcagctggacgtgctgggccatctccgtgccgcgatcccacgtgagcgatcggcgcaggtgctcggggagggtggtgatcttggcagcgatcgcagtgcggactgcctcggcaccgtggccggcaaggggtggtccgtgcttcgcgcgcgcctcaccgtcgtggccctccatgggcggtaggtggagcagcatcacggagcgggtggtgcgctcgaggcgcgtgccgatcgccgaacggtgcagcccgatgatgaggtctccctcccagtgcccgggcaccgcacggtcctcggcctcggcgggccgctgcgagatcagcacctccggggtgatgaagccctggcctcgtccgtgagcccgtgctcgtgggacccgaagggctcgtccggtcctcaaggcaggtcacgagttcgcgcctgagcaccccgcgcccctggacgaagagtgcctggtagatggcctcgtgactgatacgcatcatcgtatcgttcgggaagtcgatcgggaggcgcttggcgatctcgtcggggctccaggcccgtgcccacctgcgatcctgactgcggccgtggcgacgacccgtgaacctgacggtgggaccgtctgcggtcgtgccatcgggatgggcgatgcgaccagcgaggcgatcctccacgtaggcacggagctcctcgttgcgaacgagcttggccaccttcgggcgcttggcggcgagcttgcgccttccactgggcaacgaccgcccggtactcgagcgtgccacccctcgtggctgcgttgcgacggagctcacgcgagatggtcgaggggtgacgcccgagctgacgagcgacgcttcgaccccagccccttttcgctcgtgcgagcgcgatctcctcgcgctcgctgagagcgagagggagcggcccgagggctcgcccagcgtgcatggtggcaccccaccagcatggctgaaccagcgcgcaccgaccgccaccgacacgcccacgcgctcgcaggcgtccgcggtcgagatccccgtggcgatgagctgccagaaggcccgctggagcacccgtggtgggtctggccgccctggggagcgcatcggcggccgcagggcacgatcggccgcccactgtcgcctcgctcccggaggagcctggttcctgtttcgttgcacgtgctcctccgtcaccgggggtgttgcaacgaccggttgaacccggacagtagctctcccggaaggttcggagcctgctcgcgaccctcggcgttcgccagtcggtgggcagggtggctacttgctacgacaacgccgtcgccgaggccttcttcggaagtttgaagcgcgagctggtggctcgctaccgctgcgtgaacctcgccgaggcccgcgtcgccatcacagcctggatccactgctacaacaccgtccggctgcactcgagcctcgggtaccgaccgccaatcgagtacgagctcacctgggcccgcgaggaggcggccgtggcctaaattcagactgtcaagcaaatggggggaagcccaggcctcctggcgggagatccagtggtagcggctcactgtcccccctccttcacccagaaggccatcgctcgcttgagcagctcacgttccatggtgagctgcttgacctgccgacgcagccgggtcagctcctcgcgctcggcgctggtcaggccttctcgctcacctcggtcgaatggaggagccccgaagcgaccagctcatcgatgctgccgccgtactcgaacattgggttgagactcagccaaggttccggccaaagcgttccctcgctgagggcttcttgcaccctggaacggattcgctcatcgcgaatatcaacgaagctctcgacgaatgatctgaactcgcgaacgacggtgtctcgaaggtcgaagacgtccattgccgtcctctagagctccgacgtcagggtcacaagttgatgcgaaccattctccactacagtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccacagtctcctggcacacaagcatgctggtgcgagcaccgaggccatggctcgatctcatgtcgatcctcggcgaagcttagcggaggccttgggtgagggccagcggcccgggatgccagcgtagcgtcgctgccgctcgtccagggtgcgaacgcggtttggccgagccacatggacctcgcgccaggagcaaggttgtatccctcgtgctccgtgccaactcctctgacgtgcgcacggtacacgcggagcatggacccgcatgagctccacagcgaacttggctgcaagcaccgtaacggccgtcggccccggcacagccggggccgacgtggtctgggtgggagtgaaggttgtgtcggctacggagtcgtgtcgtcgttgacgttgacgtcgaacgtcgaccagccctgagccccgttcggtcctgtcgcgatgacgcgccagtagccggccgtcgggaacgtgagggtcgcctgggccgtgccgtcgacgagatcgactgatgcggggtacgtggcagacggagcccccgacggaccgaccaccgtgaggttcaccgtgcccgagacggatgtatccgtcgtgaggccagcagtcttcgcctcgacgttcacgacgagcggcgttccgggcgtcgctgcgagattctcggcaggatcggcgacctggatcgtgtcgctcggcacgtcgggtagcgatacgggagcgatcggcgcttggtggaagtcgaacatgccgagcaggtcgttctggcgggccaccagcttggtgagcgggtgcatcccccagaggcgatccatgagggcaaggatccccatgtcggtcgtctgcttcgagaagactccgggtcgcacccacggcgagatgaccaccatgggggtgcgggtgccgtagccgaaacgctgcgcgatcggcggggccacgtgatcccagaagccaccgccctcgtcgtaggtgatgaagatggcggtgctcttccactcgggcgagtgctcgatcatcgacacgagctgtccgacccatgcgtcaccgagctggatgtccgtgggcggatgctcgctgtagagccaggtcggaacgacgaaggagaagttcggcagttggttgttctggacgtcggccacgaactggctcgtgttcgcgacgtcgttccagaggtgcttgtcctggagcaccggcgtgtaccaggctgggttccagtgggtgacgaagccgttcccctcttgggttgggggtgggccgttgtagtcgccctggaagatgccccaactcagcccgtgctgggtgagctggtcgaagacggtgcggatcgggaaggacccagagctcggcggggaatccgacagccacgcgtctgcggtgcccgccacggcgtagatccgattgggctgggtcgggccgatcgcgggctggaagttgttgtcggcgagcacgaagtgctgggctaggtcccagaggttcggctcgacgctcttgccgaaggtcgtgatggacgcaaggccgttcgtcggcagcgtggtgtagtagttcatcttccaccccggcttgccggtcaggtacgcgttcgacggcgtcgcggaggtgaagtagcccgtcccgcccgccagcagtgcggggcggtagtccatcgcctcgatctcggcagcgcggttgtggttgaggtccaccgtgtcaccgacgttggcgggagccgggatcggcgcgacgggtgcggctgcgtagttcgtcgacggattcgggaactcggttcctgccgggatcccgttcgcgccagggaacgacccgaacaggttgtcgaacgtatggttctccagcatgatctcgacgacgtgctggatcgggctccgcatgccgctcgtcgcggctgctggggctcctgtgccgagggtgctccagcccactaaggctgtcgccaaactggtcgccgccgcgatcgaggcgacccaccgactgcgtgctcgcatcgttacctccccttcgatgatgtgggtgtccactcgggacgactccatgcttgaccccagagcttgcgctcaggttgcgctcaggtgactcgcaggacacggggagtggaacgtttgggtggcggtccgacgatcggtcgccctcgcgagttcggatctctcatgtccccacggccacctgcatgcgacgagcgcgaggccgctgcccgagggagcttgctcgcgtggcagatggacccctgaccggctccttccggcgagctgggcgggcgtgcgagatgtcgcggccgcggtggtcgtggcgctggtaccgggacgcatcccacggcagaaccgtgcgcgtgggggtgctcatgtcgtcccgcacaccccttcgacctcacggccgaggctgtgcttgcagcgaggtggtgccctgaaggtagatcgatcgctcccgctgggaatcggaccgcgcgagctcggcgaaccccacagcatcccacgcgatcgctgccgtggcgcgagggcggctcgaccgcgcgacacgtgtcgatcgccttcgtcgccccgacctaggtgcgcccccaccgtgggcgcgatccgtgcgcgtgcgcgtcgcggatgtgccgactacggcgcgctctggccgcggtggttcgccaactcgaggacctcggccccgtgtgcgagtccctcgacgacgcgttcggcgtgcgtcaccacgaccagggttcgatcgatggcgagccgggcgagaagtgcgacgagatcatcctcggtctcgccgtcgacgttggcggtcggctcgtcgaggatccacgtgtgctggtcggcgagcagcaggcgagcgagtccgatgcgctgtgcctcgcccgaggagacggcgtcgtgggcgaggcgcgtttggagcccgtcgggtagtcgcgcgagcagcggtgcgagtcccacgtcgccgagcgctcggacgaggtcggcgtcggatgcgtcggggcgggcgagccggaggttcgccgcgagcgtcgcgtcgaagacccacgcttcctgggggacgtagccgacgtggtgcgccacggtcgactcggtgagctggcgcgtgtcgacgccgccgaggcggatcgtgccacgggtgggctcccatgcggctcgcagcagaccgacgagcgtcgacttgccagccccgctctcaccgacgacgaggagccgacctcttggagggatcgagaggctgaggcgatcgaggatcgcggtggtggcgccagggtaggagaagctcacgtcctcgacgtcgatggcgaggggaccgtcgggcaggggcgtagtgttcgctggctggtcgcgacctcggagcgcgaggaccgagtcgaggcgtcgggacgaggcgagctcgctcgcgagatgggtcgcgctcacgccgatgccgctcgtcgcctcgaagagcccgagggcgaggaacggcacgacggcgagctccacggcctcgaggtggtggtgcgcgatcgccccggcaccgatcgcgacggttgcggcgatggtcagtgcttcggcgagaccggcgagcgaggcggggatcagctcgagcgctgcgttggtccgtcgacgcctggcgagcttgcggatgtgggccgcgagctcatcggtgagggtgtgctcgcccggcgttccggcgcgctcgggagcagagtcggcgatggcgagtgcgatcgtgtgggcggcttcggcggtcgcggcgagttcgcgggtcggtgctcgcccgagccgcgccgcggccgctggcgcgacgacgagcgtgacgacgaggccgagggcgaggaccactccgagggcggggttgaagacccaggccacgaccgtgcccacgaggcctgcacccaccgcaccggcgaggggagccgcgatgcgcaggagcagcgaggagagcgcatcgagatctcccgtggcagctcgcgagagcgtgccggcgatcgcgctcgggaccctgtggggtgcggccccagccacggcacgatagagcgcgacgcgaaccacgcgcacgaggcgcagcgtgaggcgatggccgaggaggcgctctccatactgaccggcacctcgggcgagggcgaagaagcgcaccgaaccgacggccacccccagcgtcaagatgccaggtcggagcgaggacttggcgaggaggtaggcggagaaggcgaacaggatggctggggagagcgcagcagcgagtgaggtacccaggtagccagcgaccagtctgcgctcagagtcgaggtggttgcggatgatcgtgacgaggttcatgtcgtcggctccgtcgtcggcgatggcgtcgctcgggtcccgatcgaagcgtcgctgagctcgaggacgcaggtagcgcggcgaaccacgagctcgcgatggctcgcgctgatgacgatggaccccttcgcctcgcgcgtgagcagctcgaggaatcgctcctcggtgcccacgtcgaggtggctcgtcggctcgtcgagcacgaccacgtcgcggccgagtgcgagtgcacgcgcgagggcgactcgttgtcgttggcccgccgagaggttcgcccccccgggtgcgaccaggtcgtcgcggcgctgaacgagttcgatcgcgccgagctcggcgaggaggtcgagtgcgacctcgaggcgatcgtggcccgcgacgagttggaggttgtcagcgatcgttccgggcaccatggcggggcgagccggcacccacaccgttcgttccgcagggagcgctcgatggatctcgtggtcgagcacgagggttccacggagcgttgcgccgcgacccacgagggccatgagcagcgtcgacttgccgatgccgctgcggccgacgacgcagagatggtcgccaggtgcgagcgacagcgtgaccggagggtcgagctctatctcgacagtggtcacggaacggagctcgagcagcgcctcatcgtgcgacggtgcggcccgcaggagacgtgtcgccggagcttgggacgtgcgtggcacgggggactcaggaggcgccgcgagggcgtcgatggcctcggctgctgcgcggccgtcggcggtggtgtggaactggagcgatgcggcccggagcggggcgaacacctcgggcgtccagaacaggacggtcgcgcccgtggcgagcgccatcgaggcgtcgttcagtcggatgccgatcgagacggcgacgagcgccacgacgatcgccgagaggatgtcgaggctcacacccgagaggaacgcgatctcgagcacgcgcatggttcgatgctcgagcgatgcagctgcggcgtcgacggcatcggcctgctcgtcggcgcgtccgaaggcggccagcgtccccgcaccaccgaggagatcgaggtagcgatgctcgagctcgatggtggcatcaagttggtcgcgagcgcgccggtcggtggcgatcccgatgagcgccgcgaggatcggcatcgcgacgaggccgccggcgagctcgatgccgaggatggggctggccaaccaggtcgcgaccacgagcgtcgggatctgcgcgacggtctcggcgaccggtggcgcgaccgatgcgaccgcggtcgcgaggcggtcgaggccctcgctcgcgagataggcgaggcggctcggatcggggttcgtcccgcgtgcggccgcgaggagggcgggctctgcggcgctggctgctcgctcgccagcctcacgggccgccacctggcccagccgccgcaggacgacccgcacgacgagggcagccccgaggacgacgccggccgtggcactcgcgccgagtcggtgcgcgacgacggcgtcgctgagcgctgcgccaaaagcgcgagccgccacgaggagcgcgacgagttgggcgagcgtggtcgcagcgaggatcgcccagaacggcatcgcccccggtgcgcgaagcgcccgggggtcgatgggaccacgtcgctcgctcacacctcgtgcggctggtcgctcgcggggacggtctcgtggggcagcgagacgcgacgccggaagatgtagtagctccagccctggtagaggaggacgaacggggtgaagatcgccgccacgatggtcatcgcgcgcaaggtgtagggctgcgaggcagcctcggcgatggtgagcgacgcagcggacgagagcgacgaggtgatgacgtcaggatacaaggtcatgaagaccgtcgccgtgatggcgaggatggcgacgcccgtcacggtgaaggcccagcccgagagccgctcgcgattgagccagctcgccgcgaccacgagcaggagggcggacacggggatcatgcctgggacgtcaccggcgtggtgctcggtccgtgccacctcccacgtccaggcgaggaaggcgaggatgatgacggcggtgatcggcgcgatgcgcccggcgagcgcggaggcacgctccttcagtgcgccggtggtcttcaggttgaggaacaaggcaccgtggaggaggaacaggctcagggtcgcgagccccgcgacgagcgcgtagggctgcaggagcgagagcagcgagcccgtgaagatgccgttcgcggtgatcgggatccccttgatgaggtcgccgaaggcgacgccccagaggagggcgggcaccagcgaccccaccgtgatcacgatgtcccagttgcgtcgccaggtcgcgctctggcgcttgccgcggtactcgaacgcgacgcctcggatgatgagcgcgacgaggaggatgaacagagcgaggtagaacgcggagaacatgcgggcataccacagggggaacgccgcgaacgtcgccccgcctgccacgatgacccagacctcgttgccgtcccaggtcgcaccgatggtgttgatgacggcgcgacgttcgaggtcgtcgcgtccgatgagcgtcagcagcatgccgaccccgaagtcgaagccctcgaggaagaagtagccggcccagaggacgccgatcaggatgaaccagaagagttcgagaccagtggtgtgcatcgtgcgctcctagtagatcagcgagccgacttcgtgctcggtctcggtgtcagcgccgggttcgagtgagcgtcgaccatagcgaaccatcaacgagatgtccacgaccgcgaggatgccgtagagcaccgtgaacccgacgagggtgatcccgaccgaccatggcgacaggtgcgaggccccttgggaggtcttcaacaagccgtagacgatccagggctggcggccggtctcggtgtagatccagccggtggtgttggcgatgaaggggagcgggatggtccagagggcgaccttggcgaaccagcgcgactgctcgaggcgatggtggtagagcagccagccaccccagagggcgatcaggatgatgacggctccgatccccgccatgatgcgaaagctccagtagtcgagggcaacgggcgggatgtagctgcccgggccgtactggcggaccatcgcggcttggagctgattgatgccctgaacgaccccgttccagtggtcggtggcgagcaggctgaggacgtgcgggatgccgatggagaagatgggcttgtcgtggaggttgccgatcgtgaggatcgattcggacgcaccgcgggacgtgttgtagagggcctcgccggcggcgagcttcatgggttgggtctcggcgatcacctggccgtcgatgtggccgtcgaggcccatgagcagcgccgagatgagcatgacgatgagcgacacgcgcgcgcctgcggcgaagacctcgcgggtctcggtgctgcggtggtactgccacagcgagatgccgagcacgagcgcagagccggtcaggaaggaggcgagcagggtgtggaacagcgtcacgaggaagagctcgttcgtgaggatggcccagaagttcgtcatgaccgcctggtgggtggccggatcgatgcgatagcccaccgggtgctgcatccacgagttcgcggcgaggatgaaggcggcagacagcatggtcccgatcgagacgagccagatggaggcgaggtgcacgcgccgtggcacgcgatccttgccgaagagccacacgccgaggaaggtggactccatgaagaaggcgaggagtccctcgatggcgagcggcgggccgaagatgttgccgacgtaggcggagtaggccgaccagttcatcccgaactggaactcctggacgatgccggtgacgaccccgatggcgaagttgatcaggaagagcttgccgaagaagtcgagcacgcgctcgtagcggtcgtcgcccgaacggtaggcggccgtctgcaggatcgccacgatcagacccagcccgatggtgacggggacgaacaggaagtggtagatggtggtggctgcgaactgccacctcgacagcagcacggtcatcgacgcgaccatgagaccctccctctgacaccgcagctcgagctgaacgtacgcaaccgagctgcgagctccagcctacgaatcgtcctgatgggcgcacctgggcccttcgtcacgtcttggccgggactcgggtcgcccgccgggagcagcgagtcgactagcctcgtggcttcatgggttctctcatcaagaagcgccgcaagcgcatgcgcaagaagaagcatcgcaagatgctgaagaagactcgctggcagcgccgagccggtcgctagctcgcacgacgttcacgaacgccccgcggctgcggggcgttcgtgcgtcgtggcggcttcgccaccggagcctgcccgcttcgccaccggagcctgcccgctgtgccagcggccctcggcggtcaggctgactcgccggcgctcggtgtctcgctcgacacctcggtcgctggggaggcgagggcgcggggcagcgtccgtgtctcgatcagccacacgggcaagtccgcgagcatgaggcgcgtggcccggacgtcgtcgcctcccacggtgacgtgggcagcagggcccctcgcgaactcgtcgccgaggccgagggtgcctgccgagtgccaccacgccagcgtcgagcccgagccggcgagtcgaggacgtcgtccggtgcgtcgctcggcagcggcgatgagcgcccccagccgtggctcgatggcgcaggcggcggcctcgaggtcgtttgcgacctcgtcgtcgtcgtgtggtccaccgagtgcgtcccaggctcgatagacggagcccgtcgcgacgccgaagggcggcacgatgagcgtcacgaccgcatccaggtcgtcgagggccatgacctgctcgccgatgccgcgggcatcgacgtggccagcgagctgacacagcgcgacgtcggcaccgaggtgccggccggtcgcgagcggtgctccgaaggcgcggaggacggcgcccgcgtcggcggagccgccgccgagccccccttcgaccgggatgcgcttcgtgatcgcaagggtgcctgtctcgccgatgagctcaagggctcgccaggcgaggttcgtcgcgtcggtcgggacgcgagcgaggtcgacccagggggcgccagcgacgaggtcgatggtggtggcaggggccggggcgaggtcgacggtgtcggcgagggcgaggtggacggcctcgatctcgacctcgtgcagaccgtcggctcggcgtccgagcacgcggagggtgcgggtgagcttggcgggcgcgacgagcctcaccgggcacccttcgaggttgcgatggcgcgccccagcgcgacccactcgtcgagcgcgagcgactcggcgcggcgcatggggtcgatgccgacggcatcgagcgccgccagctcgtcgtcgccgagggcgcgtcggagcatctgacgccgacgttcgaagccgtggcggatcgcacgcaccgtggcgtcgaaggtcgtgggctcggtcaccgcgagcggctcgctgcggcgatcggcgacgacgagcttcgaccacaccgtcggctgcgggtggaagacgaccggtggcaccttggcggcgacgtgcgcgtcgatgctgagcgcgagccgcaccccgagcgccgagcacgctcgggtgccggcggcagcgacgatgcggtcggcgaactccgcctggaccatgacgaccacacgctcgaggaaccaggcctcctcgacgaggcgaacgaggatctgtgagccggagtggtaggggaggttcgcgaccagcgcgctggggcgtcgttccagcgggagcgggtcggcgagcgcatcggcgtgctcgattcggacgttgtcgatccctcgcgcggccagcacctcgccgagcgccgggatcagtcgtcggtcggcctcgagcgccaccacctcgtcgaagtactcggccagccacacggtgagcgagccgaggcccggccccacttcgaccgcgacccgaagccccgcctccgcggccagcgctgcttccttgcgcgcgatgttgccgtcggtgaggaagttctggccgagggccttggagggctcgagcccgatgcgctcgaggtgtgcgacgatctcccgcttcgtgactggacgcatggtgctcagggagatggctcgacctcacggagcccgaagagccgccgtgtcgtcgccgcggtgatcgccgcgagccggtcggcgtcgactcccttctcgctggccacgaagcgtcccgtgacggcgacgttggcgatgtggttgggtcggccgcggagcgggaccggcgcgaggaagggcgtatcggtctcgacgagcagccgctcgatcggggcgagccgaagcgcctcgcgaacgggctgggcgttcttgaaggtcacgatccccgagaacgacaggtaccagccgcgtgcgagggcgcgctcggcctcgtcgggaccttccgagaacgagtggatgatgaccgctggcggactcggggcgtcgtcgaggatggcctcggtgtcggcccaggcttcgcgcgtgtggaccacgagggcgagcccgaggcggtgggcgagggcgacctgctcggcgaagacgcgccgctggacggggcgcggcgagtagtcgtagtggtagtcgagcccgcattcgcccaccccgacgacgatgcccgggtactcgacgacgagcgcggcgaggtcggcgatcgcgccaccgtgcgcctcggcatcgtggggatggatgccgatcgtcgcgccgacgctgaggtcgagccgttcggtggcgagctggtcggcgatacgggccgcttcttgcgagctcgcagggtccgtcccgatcgcgacgaacccgacgaccccggcgtcgacgaggagcgccagctcctcgtcgaggctcacgcgctcgggatgggcgtgcgcatcgatccagcccgcactcatcggcgccccaccacggcatcgaggtcggtgcgtgggaagagcggggctggcttcgtgatggtggccccgcccatgcccggttgccaagcgagcggtcccgcctcgtcgaacccgagcgctcgtcgggcacgttcggccccatcggggatggcgggggagaggagcacgctcgcgaggcgcgccccctcgcgagcggtgccgaggacggaggcggcctcggccgatcccttcgcgagacgccagggctccgtggcctcgaggtaggcgttcagccgatggacgaggccgatcgctgcgtccatggcgtcgttcggccgccaccgttcccaacctgcgcggacggcctcgatggtctcggcgatggcgagctcgtcggggggcgtcgcgggtgcgtcgggcacgtggcccccgagccgttggacgatgagcgagcccacccgcgcgacgaggttcccgaagccgttcgcgagctcggcgttgtagagtgcgacgagcgcctcgagggacacgtcccagtccggcccgatcgccgaggagcgcaccaggtagtgccggagcgcatcggcactgagcgcgcgttggacacccagcgggtcgatctggttcgcgagcgacttcgacatcttctcgccctcgttgagcagccagccggtcacgatcagctgggccgggggatcgatgccggccgcgaggcacatcgccggccaccacacggcgtggaagcgcaggatgtccttgccgagcaggtggtgggccgcgggccaccaggcggccacctcggcggagtcctctgcgtagccgatcgccgtgaggtagttcacgagcgcgtcgtaccacacgtagaagacgtgtcgcgagtcccaggggacgcgcacgccccagtcgatcgaggtgcgggtgatggagatgtcggtgaggccgccctcgatgaagcggagcacctcgttgcggcgcgactcgggccagatggcctccggatggcgctcgtagtgctcgaggagacgatcttggtagcgcgagagggcgaagaagtagttctcttcgcgcatccgttcgcaggcgacgtggtgcaccgggcaaagctcccccggctcgagctcgccgggttggtagtaggcctcgcaccgcacgcagtagaggccctcgtaggtgccgaggtagatgtcgccgcggtcgtggatgcgctcgaggaagcgttggacgcttcggtggtggcgtggctcggtggtgcggatgaagtcgtcgtaggagacctcgagcgcatcccaggcgcgtcggaactgggccgaggtcacgtccacccaggcctgtggactcacgccgtgcgcctcggccgactgggcgatcttcagcccgtgctcgtcggtgccggtgacgaagcgcacctcgtcgccgatcaggcgatgccagcgggcgatcgcgtcggcgaggatcacggcataggccgtgccgaggtgggggtcaccgttgacgtagaagatgggggtggtgatgtagaagcgccccacgagcccagcgacctcctcgccgatcgatctcgtcccaagcttaccgaggcgccggtcgctcgctgggacgagcgtcgggacgcgccgcgaggatggcggcataggcctcctggcggggcgcgttcgtgaggcgagcgacgatccgcgccgcctccgacggcgcgagcgaactctcggcgagcgctcgggtgaggcgctcgtgctcgacgacgctcgtgggcggggcaactcgtgccggccccaccacgacgacccactcgcctcgccgatcgatggcgcgcgcccacgcccctgcggcgcgcgcggtcccttggaaggacgtctcgtggatcttggtgagctccttggcgagcagcacctcgcgctcggggtcgagctcgccgatcgcatcgacgagctcgaggatgcggttcggggcctcgaagacgacggtggggacgccctcggcgagcaggtcagcaaggagccgtcctcgctcggccccgcgctggggcaagaaccccgccacgcagtagcgggcgacctcgtggggccagagcgccatcacggccgtcgcggcgctcgggccggggatgacgacgacggtggcgcccaccgcgcgcgcggtggcgacgaatggcgcccccggatcggaggtgcccggcatgccggcgtcgacgacgagcacgacgtgctctccgtcgaggaggtgtgtggcgagcgcttcgggctcgatcgcgttctggccgcggagcgcgcggaccgctcggaggcggatgccgagtgcgctggcgaggcgcctcgtgacgcgggtgtcctcgcagacgacgaggtcggcggtctcgagggcgcttcgaagccgcgggctcgcgtcggcgaggttgccgatcggggtgccggcgacgctcagcacgccgctcatcgacggacctcgaggcggtcgcccgccgaagggggggcgtcgtgccagagggcgcgtggcaggacgacgatgcgccagggggcgacgacgaggcgtggccgccatggatggagccgaacggtgctgcggacgagcccgttgcggtcgagggcgagcgcgagcgcatcgccgagctccccgagcccgctccagagcgcgatcggtgtcgagatgagcaggccgtgggagtcctcggtgtgccagatcaccgggcccgcggcgtccagggtgccgagcacccgaccgcgctcgttcaccagccacgccatggcgatcacacgttgaagcggatctcgagcacgtcgccgtcggcgacgagatagtcgcgcccttcgagccggaccttgttctgcgccttggcccgggtccacgagcccgcctcgaccacgtcgcgccaggaggccacctcggcgcggatgaagccgcgggcgagatcggagtggatgatgcccgcgcaggtctgggcgttcgagccgcgtcggaaggtccacgcgtgggtgtccttgtcgccgctcgtgaagaaggtccagcgctccagggtttcgaaggcggctcgagcgatgcgctcgagggcgctcgaaccgatggcgagggcctccatcatctcggcacgttcggcaggctcgagcctggcgagctccgcctcgagcgcgagcggtgcggtgacgacggtggcgtgatcgccgaggcgccctcgcacggtgtcctcgacggccacgtcggcctcggcaccctcgtcggcgttgatcaccgcgatggcgggtttggtcgtgatgagaaaggccgagcggaccagctcgagcacgtcggtctcgagggtggcccgatagagggggatcccgtctgcgaggaccgcttggacgacctcgagggcggccacctcgggtcgggccgaggggtccgaccgcgcgaccttgcggcgccgctcgagcgcgctctcgacgctggcgaggtcggcgagggtgagctcgagctcgagggcgtcgaggttcgcgatcgggtcgtcgtcgcccgggactcggtcgtcgtggaacgcgcgcagcacgtagaggatggcgtccgcctctcgcagctggccgaggaagcgattgccgaggccggcgccttgggaggacccagcggtgagcccggcgatgtccgcgagctgcatgtgggcatagaccagcttgcgcgagtggtggatcgccgcgagcgcgtcgacgcgctcgtcgggtacgaccgcctcggcgatggtggtgtcggtggtggtgaaggggtggggcgcgacgggggtgtcgagaccggtgagggcgttgaagagtgtggacttgccggcgttggcgagtcccacgagaccgagcttgtccatggccccctcgatcatagggccagcggggagtcgtctctcgagccgctagccttgccccccgtgtcgaagcgaaccgtcaagcgcaagttgcgcgcgaagaagaaggccaatcacggacgcaagccgaactgcggtcgcggctagtcgtcaggcgtgatgccccgacgtcgctcgatgccggtgatctgaccccggagctcctctgggacgatcggtctgggtttcgtgctggcctcggcgagggcggcctcgatcgcgtcgtaggcctctcgcgatttgggcgcgcgtgccagatagagcacgacgtgcgcgagcgtgatgcgggcttcgggcatgccgatgcgctcgaccgtgtccgcggccgcggccgcgaggacaagagcctcgggatcggcgaggccgacgtcctctgatgcaaagatcacgaggcgccgcgcgatgaagcgcggatcttcgcctgcggcgagcgccgcggcgagccaccggatcgcctcggtcggtcggctctggcgcatcgacttgatgagcgcactggcgagctcgtagtgggtcgagtcgtcgagcccgagcgcggcgatctcgctgatgcgctcgaggagctcgacggtgagcggtcgctgggccgccgcgggggctgcacgctcgaggatgcgcaacagcgccctcgcgtcgccgcgcgctgcggcgacgagccaggcgatcgccgcatcgtcggcgatgaggccgaggtgggcgagcgctcgctcggcgaccgcgcggagcacggggggctcgagtgcgcggagccgaacgacgtcgcagcgcgacagcagcgcgggtgagagcgtgacggcggggttctcggtcgtcgcaccgatgaaggagatctcgccccgttcgatgggcgcgagcaggagatcgagctgggtccggccgaagcgatggacctcgtcgacgaaccagagtgtcccgtcgccgtggcgggcgcgtcgggcggcttcggcccgcgcctcgcgcaggtcccgcacgccggtgtcggtcgcgtgcagctcgacgaggtgctcgcctcgtgcccgtgcgagcaggctcgcgatggtcgtcttgcccacccccggcggcccggtcatgatcaccgcgatcgtccggggcgcggtggcgagggcctcgaggcgcgctcgcgcgtggtcttgtccgaggacctcggcgagcgaggtcggtcggagctcctcggcgagcgggcgtgctcgcaccatgtgctcctcgaagagactcaccgcgtccctgagcgcagctcgcgacgtcgcgcctcgagcccgagtgcagcgagcacgccgtcgtcgacgggcttcggtgcaccggtcatggggtcctggccgctctgggtcttcgggaacgcgatgacctcacggatggtctcctcgccgagcaggagcgcgacgaggcgatcgatcccgaaggcgaagccgccgtgcggcggcgggccgaagcggaaggcgtcgaggaggaagccgaagcgatcggccgccgcctgctcgtcgagcccgagcaggccgaagatctgtgcctggaggtcgggacggtggatcctgatcgagcccgagccgagctcccatccgttcatgacgaggtcgtaggactgggagcgcacccgcaacggctcgcgctcgaggaggtccatgtcgtcggcgtggggcatcgtgaaggggtggtgggccgagacgaggtgaccctcgtcgtcgacgccctcgaagagtgggaagtcgatcacccagaagacgtcgagcgcgtcggggtcggcgaggtggcgcccgagcgcgaggcggatggtcccgagcgcggtgcaggcgacctcgaagcgatcggcgacgacgaggatcgtgtcgccgacctcggctccggtgcgctccacgagtgcttcgagcgccgccggcgtcatcgccttggcgagcggtgaggcgatctcgagcggcgtgcggctctcgacacggaaccaggcgagtcccttcgcgcccgcgctgcgggctcgttgggtgagctcgtcgagtcgggagcgcgagaggggctctgcgacgacgagggcggtgacgtagtcggccgcgagcgcgcgcgcaccggagtcgcggaccgcctcggtgacgtcgacgagttccatgccgaagcgtcggtcgggcttgtccgagccccagcgggtcatcgcctcgtgccaggtgatcgtcccaatggggacgtcgtcgacgccccgtaccgagcggatgacctcgcgaatggccgcagagacgaaggatcgcacgtcctcttgggtgacgaacgacgcctcgaggtcgagctgggtgaactcgaactgtcggtcggcgcggagatcctcgtcgcggaggcagcgcgcgatctgatagtagcgatcgacgccgccgatcatgaggagctgcttggcgatctggggcgactgcggcagggagtagaccgatccgggctgggtccgggagggcacgaggaactcgcgtgcgccctcgggcgtcggtgtccagaggagcggcgtctcgacctcgacgaagccctgggcctccatcgcgcgtcggatggcggcgttggtggcggcacgggcgcgcaggttgcgctgcatgcgtgcgcgccggagatcgaggtaacgccacctgagccgcgtggtctcctcgacctcggcgtgctcgtcgagggggagcggcaggggatcggcgtcgccgagcacctcggcgtgttgcacacgaagctcgatcgcgccggtggcgaggtcggtgttctccgttccttcgggacgccgcgccacctgaccctcgatgcgcaccgccgcttcggtgtgcagcgaccctcgaccgtccatgacgcactgcacggtgccggtgtggtcgcgcacgtcgacgaagacgaggtgttctccgtgctcgcggatgcgcgccacccagccgcagacgctgacgtcgcggtcgaggagggattcgtcgagcgcgccgatgtagtgcgttcgaaggccggctgctggcggcagggtccgttcactcatgcgcggtggcatctccttcggttcggggcgctggcctcggcggcagcacctcgcgagcctagactgccgccgtggtcacggctcagggaaggctcatcggcgtcggggtgggcccaggggaccccgacctcgtcacggtccgtgccgtgcgtacgctcgagcgcgcccgcttggtgctggcccccacgctcgatgcggcgagccccgggcgcgccgagcgcatctgccgcgaggcggcgccgtcggcacggatcgagcgcgtggtcatgccgatgacgagcgatgcggaggcttcgtcgcggcgccgggcgagcgccgccgaggtggctcccctggtggtggccgcgctcgaggtgggtggtgacgtcgcgtgggtgacgctcggcgacccagggatctactccaccttctggctcctcgtcgatgccgtccatgcgctcgcccctgacgtgctggtcgaggtcgtcccgggcgtggtcgccttcagcgcccttgccgccgcggccggcgttgagctcctcgacgacgccgaccacctcgtcctcgcgaccgggcgcacccggaccgaggtcgtcgacgctgccctcgccgatcccgacagcgccctcgtgctctacaagcccggtcgccaggtccagagggtgcgtgaggcggtggcgtcgtcggatcggcgtgcggtcgtcgggtggctgctcggcacgcccgaagccgagatccgaccgctcgccgaggcgcccgacgaggttccctacctcaccacggtgctcgtcgcaccgaggaggccacgggcgtgagcgtcgagctcgtgctcggggctcggcgatcgggcaagtcggcctgggcggaggcgcgcgccgtcgagctgcggatcgggacctatctcgccaccgcagcggcacacgcgctcgatgcggagcgtctcgcggcccatcgtgcgaggcgcatcgggcgcttcgtgacgctcgagccgggcgacccgggcgaactcgtggagttggtccggaccgtcccggggggcctcctgctcgacgggctcgggctctgggtcggctggcagctgagctcggaccacgacgtgtcctcgggcgagctcgtcgcggcgctcgcacggcggagctccccgacgatcgtcgtctccgacgaggtcgggtggtcggtgcatcccgagcgtgcactcgcgcagcgcttcgtcgatgagctcggtgcgctcaaccaggcggtggccgccatcgcggcccaagtcaccctcgtggtcgcgggcctgccgcttcggctcaaaggtgcgtgagtgaagctcgtccgctcgctcgccgggggcctcggcttcctcacgatctggccgttcgcggcaccggtgagcgccgagagcgtcctcgggttcccgctcgcgggtgtgctggtggggctgtgcctcgtcgtcgtcagggtcggagcccagcgtgccggagccctcgtggtgggggcgctcgcgttggcggcggacgcactcgtgacgcgtgggctccactacgacgcgctcgccgacaccgccgacgggctcggggggttcatggagccggcagagcgtctcgcggcgatggacgacccccgtctcggcggcctcggcgctctcgcgctcgcggtgacggtggtggtgcgcgctgcggtgctcggtgcggctggcatcagcgcgctcgggctcgtgctcgcgctcgcctggtcgcgctccgtcatgggtgtggtggtgctggagagtccgagtgcaaagcccggtggcatgacgcggtggttccgcgacgcctcgctcggggtgcgtgtcgcctcggtgagtgccctcgtcgtgttctcggcggcgatcgtcgtggtcgagggcgcgccggggttgttcggcgtgtgcgtcgggacgatcgcgggcgggttgctgtggctgagggccactcgcgcgctcggcggcgtcaccggggatgtggtcggcgcggtcggcatcgtggccgagaccgcgctcatcgtgggggtcgtgctgggtgcgacgcactaggtcgctcgagctcgcggtcgcgctcgggctcgatgcgatgctcggtgacccgcccgaccgctggcacccggtggcctggttcggtcgggccgcgagcgtgctcgagcgacgctactggcgtgacgatcgtcgtgtcggcgcgctcgtggcaggtgcgctcgttgtgggtggcacgctggtcggcgcggtgatcgatcgcgtgcctggtggggccctagccagtgcgtgggtcgccctcggaggggccgggctgcggcgacgagcgctcgacgtcgcgcgtgcgttggacgacggtgacctcgagcaggcgcgtgcgtggctcggctggctcgtgggtcgcgatcgcgacgggctggacgcgaccgagatcgcgcgcgcgaccatcgagtccgtggccgagaacacggtggatgccgtgctcggccccatggtctggcacgtcgcgctcggctcgatgggctcgatcgcgctgcgcgccgtcaacaccctcgatgcgatggtcggccatcggaacgctcggttcgagcggttcgggtggttcgcagcacgcctcgacgatctcgtcatggcgccgccacgccggctcgcgatcgcgctcgcggcgccgtcgcatcgccggctcctcccggcggctcggtcgcacccgagtccgaacgccgggcccatggaggcgctggtggcggccgcggtcggcgtgcgcctcggtggtgtcaaccgctacggggacgcggtcgtcgagctcccggtgctcgatggcggacccccgcccgacgccgcagccattcggcgggcggttcggtggtcgcgcagcgtgacacttggcacgctcgcctttctcgccgtggccgagcaggcggcgaacgcggcggtgggccgggccccgtagcgtggtggtgtgctggttcgtgaggtgcgtgtgcacacggggcgtcggctcgtcaccgacgtctccgccctcgtcgcagcgatcgtcgccgaccagggcgatggcctcgtcaactgcgtggtgccgcatgcgacggcaggtctttgcctgatggagatcggctcgggatcggaagacgacctcgccgtcatgctcgagcagctcgcgccgcgcacgacgccgtggcgccaccgacacggaactcccgggcacgggcgtgatcacgtcattccggcggtcgttgcgccctcggtggtgctgccggtgatcgacggtcgcctgctgctcggcacctggcagtcgctcgtcatcgtcgattcgaacgtcgacaaccccgagcggcggctcgtcgtcgccatgctggctgatggcaaatcccggggcgcgagcgcacccgaggagcgctcggatgcgggcgaacggcccggtcgggacgtgccttaggccgtgcgcagacgacctgagggccgccgctccggtgggacctgtgcgatgagtgggttcgtctggtcgcgctcggagatgacggggtcatcgagctgccagaggccgtggaacgtggggtcgttccagcggagtccgagttcgtcgtcggggttgtagtagccgtcgacgaggtaggtcagcgtcaggtccgtgagggcggcgaaaccgtgggcgaccccaggggggatgaagaggccgatcgggtcctcgtcgcccatcagcagggaccacgtcgtgccctcggtccgcgatccgtggcgaaagtcatagagcagcacctgtgccgtgccccgcacgacgtaccagtagtcggcctggtggaggtggtagtgcatgcccacgagcgagccagcgaccttgtcggagcgcgacccctgcaccatctcacgaccgagcgggaaccacgagcgacgataggtctcttggaacgcgccgcgcgcgtcggcgtggacggtcgggcggatgacgatcacgtcggcgatctctccgtgggccatggcaacctcctgactcgccggctcagtgtaggcccggccaagctaagtgggcggtggccgtgagtctctgagcgatcggcgacattcggtaggctatgagtggcacagttgcacgcacggtgcacgcaaggagctctatgaatgcagcgatcgtgatcgtcgcgctcttcgtggtggtcggcgtcgtggccatcgtctcgcttcgaggacgtacgcgcgaggtgcgcacggtcgatcaccatcagcgagcgctcgacacgctcgagcgcttcgccaaggagcgcggtgtgcaagccgaccatcgcgtcggcttgcccaagagcgagcaacgtcgagtcgccgccggatcggacgacgcgcccccggtgcggctcgacctcggtcggctcgccgacctcaccgacccggacatgatccgcatcgaggcggactacctggcgagtggcgccagcgccgagacatccgctcaggcgcccggtgacgaggaaccgacgaaggatgctgccgtggccgcatccacggaggacgaggcggtcgagcaggccccgccaccggcgacgaggccgatcgatcgggccgtggccgatcggaccacggcgatggcggcgatcacgcccgatcgagcgcccgaggaccgaaccgaactgctctcggcggtgggcccatcggccgccgtggccgccgacgatcgatcgcaccgcggtgacgacgctgtgcgcgagcaccgggtctaccagctccatcggcgtactcggctcccggccgtgatcggtggtgcgggaatcgcggcgatcgcgatcggtctcgtcgccttcgaactctcgagccaccatgcggcagcaccgacgtcgcagtccgcctcgagcccgacctcgtcggcgccctcgaccacgaagcagtcgtcgaacgcgaagacctcgacgacgtcggcgtcgaagaagacctcgacgacgtcgaagacgacgtcgtcggcgaagaaggccaagggttcggcgagcgctgggccggcggtcgcgctggtgagctccagcagtaccggcgcgacctacaacgtggtcggcggtgcccacaccgtcgttctgcaggtgtcgagcgcaccctgctgggtcgaggacgcccaggctcccggtggtcaggtgctctgggacgcgaccttgccggcgggtggcagctacacgatctcctggagcggtggaccgctgtggctccgcaccggcaactcgggcgtgctgtcggtgagcgtgaacggccatccggtgcacttcagcgcaccgccgggtccgttcgacctgctgttccagccggtgcgttagtcggtcgctggggtcagcgccgcttgcacgaaggcaaggacctgggcctcgtcgtgccaggcgtccttgcgcttcgtgggcccgaggtgaccttgttcgtcgtcgacacggatccacacccgtgcctcgggattgaccaaccggagcttggctacgtacttgagtggttcgaagaagccgacgcgcacgtcgttcagcccggtcgtgacgaggatcggcgggtaggtcccttcgtgcaggttgtcgtaggggctccatcgcgccatcgtctcggcgatgacgtcggattcgagcggattgccccactcctcccactccgtcacggtgagcggcagtgaggggtcggacatcgtcgtcaggcagtcgacgaaggggacctcgaggacggcggccgcgaagcgctctggcgcccgattgagggccgcaccgacggtgatgccgcccgcactggcaccacgaatggcgatcgcggagggatcggcgatgccctccgcaacgaggcctgccacgacgtcgagcaggtcgcgcacggtccgttccttgcgctcgagccgaccggcgtcgtaccacgatcggccgagttcgccgccgcctcgcacgtgagcgatggcgaacgtgatgcccgcgtccaagagtgagaggcgcgagatcgagaaggtcgggtcgatggcctcctcgtaggcgccgtaggcgtagacgagcacgggtcccggcgcaggtgcgctccggcggcgagcgatcgtgaccgggacgaggacgccgtcgtcggcggggagccacagccgtctcgtctcgtagtcgtcgaggtcgacgtcgccaccgacgcgctggcgccagcgctgcgtcgtcgtctcggtggtcggcatgtaggaccagatggtggcgggctcgacgagcgagaccgtctcgaagcgaacctcgtcgtcgtcgaggtcgaggttgccgaccagcgctgcggtcgagggctgctcgggatcgacgaggaggcgacgttcgctcgctggcgctccccaggggaggaacgacacgacgagcgaggcgcggcgtcgcgtctggatcgcaaggccgtggcgggtgatctcgaacccctccaggatctcgccgtcctcgagtaggtcgacctcggtgaggggttgctcggggtcggcggtgcggaagagacggaactcggcgtcgtcgcggctctcgatgaggtagaacccgtccgggccgtggtcgagctggtagagtcgaccctcctcgcgcggtgcgaagggccgagggggggtcgcgagtgggtcggtggcgtcgaggagccaccattggctcgtgcgcttggattcggcctggatggtcaagaaggcgcgatccttcgtccgtcccacgtcgaggaagtagtgggcatcgggttcttcgagcacgaggatgtcgtcggacgggtcgctgccgatgcggtgtgcccacacggacgcggggcgcagggtctcgtcggggcgcgtgtagaggagcgttcgcgagtcgttggagaggacgaagccgtagccggccggaaagatctcctcggctcgagtgatgatgccggcctccagccggccgacgacgaggcggagctgctcggagccgtcggtgtcgacgccgacgacgacggtgtgctcgtcgtcgccgatcaggagtccggcgagtgcgaagtaggcgtgaccgtcggcccaggcgttctcgtcgaggacgagctcgcgtggtccgcctgcgacgggctcgcggtagtgcaccggatagtcgaggtccggttcgatccggctgaggtagcgccatgacccgcgacggacggggtagctctcgtcgggttcgaccacgcgtgagcggatcgtcgcctcgatgcgtgttgcggcgggcgccaggcgttctgcgagtgctgcgaagctggtgcgagccgaggcgatcatgtgctgggtgcgcgggtcgtcgatcgagcgcagataccagtaggggtcgatccgtgtgcccgcccgccctcggagcgtgtgtggttcggggtcgggagcaccgagaggagcgaggtccctcgtgagggcatcgagcatcgtgcgcatggacgcgagtgtagggagcgccgttggctcgggccgttcggggcgatatagactaccgaggtagtgcaaatagggaggcccgatggcgaaggttgacctggccctcgatcgctacaagctcggctggtctgacgaagaggcctatgtcttcaagccccgcaagggcttgagccgcgagatcgtcgaggagatgtcgcgcatcaagggcgaacccgagtggatgcgccgattccgcctccgctcgctcgactacttcttccgtcggccgatggcgccgtggttcgcggtgaacatgcccgacctcgacttcgatgacatctactactacatcaagccgaccgatcgccaggtggaccagtgggaggcactccctgagaccatcaagcgaacctgggaccgcctcggcatccctgaggctgagcggaagtacctcgccggcgtcaccgcccagtacgagtccgaggtcgtctaccaccgcaaccgcgaggagctcgcccagcaaggggtcatcttcaccgacatggactcggccgtgcgcgagtaccccgacctcgtgcgccagtacttcggcaccgtgattcctccgaacgacaacaagttcgctgcgctcaactcagcggtgtggtcggggggttcgttcatctacgtgccgccaggggtcaaggtcgacatgcccctccaggcgtacttccgcatcaacgccgagaacatggggcagttcgagcggaccctgatcatcgcggacgagggcgcgcaggtccactacatcgaggggtgttcggcgccggtctactcgagcgactctctgcactcggccgtggtcgagctcatcgccaagcccggtgcgcgcatcacctacacgaccatccagaactggtcgtccaacgtctacaacttggtgacgaagcgtgctcgagcagaggccgaggctcgagtcgagtggatcgacggcaacatcggctcgaggctcacgatgaagtacccgtcggtgtatctcgtgggtccgaaggcgtccggtgaggtgctgtcggtggcctacgccggtgccggccaacaccaggacacgggcgcgaagatgatccatgctgctccggagaccacgtcgaccatcgtgtcgaagtcgatctcgaaggacgggggcaatgcgacctatcgcggactcgtccacgtcgacgatggcgccgagggcgcgcggagcttcgtgcgttgcgacgcgctgttgctcgacgaccattcggtgtcggagaccaagccctacatggaggtcgccgagcgcgcgtcgtggatcggtcatgaggcaacgatctccaaggtcagcgacgaccagctgttctatctgatgagccggggtctgtcggagtcgcaggcgatgagcatgatcgtgaacggcttcatcgagccggtgacgcgaaccctgccgatggagtatgccgtggagtggtcgcggctcatcgagctccagatggacggggcggtcggctaggtcgtcgtcgctgccgcgagcgcgcgctggttggcggggtcgtagccgagttcgcctcgaggtcgttccatggcggcgtcccggggcgcgcgggcatcgctcgccgacatgtctgctctttcgtagctcgtcgcatttgggagcttcgggggccgtggtcggtgtttggtctgcgaggcttctcggggagccatcggaggctcgtcgcacgcgcatccgggcgctggggcaacgatcgtcgtcgtgtcgcgacgtgcacgagccgctcgaccgtgcctcgccagattcaaggtctcgccgtgaggttcgccggctgagggtcgtgtgagcgcatcgcgatgcctgaagcgtacgccggctcgcagtcgcggcccgaactcagatggcctgcgccgttgtcggctgtgggcacgggggcgcgacagctgggcagcggcgccgtcgtgaggatcgaggacgatgcgcatcgaaggccggtggtacaatcggccggagagccattcggaggcgtcgtgctcacagtcgatcaagcgacctcccagaccaaggggaatcaggcgcgcccaacccggtcggtgccgcgtgtgttgcggtttgctcctccttcggtcctcaccccggacgaactcgtccggctgcagcgttcggtgggcaacgaggccgtcgagcagttgctcacccaacgcctcgatgcgcttgctcacaagaagcccatcgatttcacggcaccggtcacggtcgtggtggatgacggtgtgcccgacgttacgaaagggcagtcttctccagagccggatccatacgccaagacgccgggcaccgttgggaccggcaccgaactccagggccccggcaacgcaccagtcgggccgacgtcgccctggagccagggcaatcgcccctttggaccgcgtacgacgccgttgatcggccagcgggactcgaagtcgccggatccatacgccaattcgaagtcgccgagtccggtgtccggacctgcgagcaattcctggcagtggggattccgatcgcacgtgcctgcgaagctgagcgtccttggttctggccggcgaagcgatccgtacgctcggtcgcctggaagcctgcccgcacccacgacggctccaatggcacagggtccatcggtcacgcaggcactcgaggttacagggtctggctccggcgctcgggtgcccaagtcgctgaagacgacccagggctatctcaaactcaagtcccgtcgctccgaatttgaaaacgagttcacttcggtcagcgaatccatgaaacgggtcatgaagtttgtcgagtcggggttgcagcgtggagagttccccgacaccacggtcgagggtgtcctcatgcatgcctttggttggaccgaggatgattgcaagaaatatggtaagttcctcaaggatccgacgaagcagtacaagaaggaagagacccccgtcgtgactgctgtgcagccgaacgagcgctatcagtacgagctgcatttcggctcaaccatcacgcgaggaacatcgaccactccgtatgacaccacagcagagcggagtcagttcctcggcagtggttatgccatctacgtcatggaccagcaggggaagttctatgctggaaaccagaaggtcggtcttttccaccactcctcgctaatcggaggaggccaggtcgcaggcgcaggggagctgcaagtcaagaacggcgaactgaagttcttgagcaacgaaagcgggcactatcgtcccggcattgaacaatgtctccaagtgcttgaagagctacgatcgcagcggattgatctctccaaggtggagttcaagttcgtgtcatcgtgggatgaaccaaagatctggaatgccgaacagctctggaacgtgctctcgcattctcaggtaccgtcttaggcccggtcggaacgagggtctctggtgaccgaatgagtcgttcgcagcttggcgacgtcgtcgcggcgtatcttgtcaatcggccttggggtgttcaacaggtggccgacgccacctatgccatcgaagttcatggtgaacatgggcagtggcagtcatacctcacggttcgagaggacgagcagcaggtgctcgttcacgccatactgccctttcgcatcccgttcgaccgccgagccgaggtggcgttgtatctcactcgggccaactacggcctggtcatcggcaacttcgagtttgatctcgatgacggcgaggtccgtttcaagacggcgatcgatgtcgagggcgctgccttgaccgaggcactggtcgaccacctggtgatcgcaggagccgtgacgactgatcgctacctcccggggatccatgccgtggtcgaaggtgcgacggctcgcgaagccatcgccgtcgtcgagggcgagcagggccaagagttgtgagggtggtcaacgctccgctggaggcggagtgtcggaacggttgctcgacgcgcgaacttggtgcatctccgcggcgggaaccggcgagcctgtgagcaacggtcgagctgagctgctcgtgggtccgagccaccctcatcgtcatggcggcggtcggccttcgggatctcgtcaccagggagtcctcgtcgagtgcgcgcagagacggcagatcggaggcgacgttactcagttggtggtgagggaactcctcgaaacgagtgcgtagccgctcaggatcaggtcgcgctgctcgttgtcgagggacgaggatcctcgtcccatcagcgcccttcagcgcgtaggtcaagaccggaccatcggtctcacggaggagtcgcggggcgaccctgacctggagatcaggttggatcacgtcccgccgagtggtgtcaactcactccctggctggcctcagctcacgacggctggctcctcctcggcgggcgaggccagcacgcgagcagcgcggaggggccgagacgtcttcgaggtgcccgccgtctgtcgtcgcgcgtggcagtttcgagctcgaccatggactcctctgacaggtcgtgttgctcgaaagcgccccatttcccgtgttggccgagcacgatagcggtgacgaggcgcccgagagctgcgtcgttgccgaagaccccgacgacgttggtgcgccgctcgatctcatgatgggcccgaccagagcgggttcgtgaccagatcgtgcccgaggagctccccgggaagctctcgggacggtgcgcgacctcctctgtggcctcggcgaccatggcgcgagccgctgggagtgtcgtggcaagggagtcgatgacctcgtcgtcctgggtcgggagcgctgccggggaggcttccctctgtgtcaatcttgagtgagaccactctcccgaccccattgttgtatcgagagggcggctgaccaaggagatcctgaggaccatgacgaccgacgagaccgcgagcacgcaccagactggagccatgccccccacccctgacccagaccctgaggtcccggagcgagctcgaggaccaagacgcttctccgcggcctacaaggcacggatccttgccgagtatgacacgcttgcaaaggccgagaagggagccctgctccggagagagggcttgtactcctcactcatcaccgagtggcgacgccaactgagaccgtgccatcgaggaagcactcgcacgcccaccaggacgccaacccgctgatccccgcgaccaggagatcgcacgcctcgaggcgccgcgccgagcgcctcgaggccgacctcgccaaggcccgcaaggtgatcgaggtccagggaaaactctccgcgcgcctggagcacctcgccaccgacagcgcgcccgcgacccacggcgagaccacgtgatcgacgaagccatcggcgaactggcgccaactgtcggggtacgcgcagcctgcgccgcccttggagagccccgggcgcgctatggccttcccccctccaggttgacacctgctataggaggaagggatgagccagacaccgaacccaccaccgggcgacgggccagttcgtcgtcgacgaggtcgctacccgagccagttccgtaaggacgccgcagcgttggtcctcgatcagcggcgaaccatcgccgacgtcgcccgcgagctcgccttcaacgaacagacccttggcaactgggtccgtcaggaacgcatcgaccgcggcgagcgcgaaggtctcacgagcgccgagcgcgaggagctgacccggctgcgtcggcaggtcaagcagctcaccatggaacgtgagctgctcaaacgagcgatggccttctgggtgaaggagggcaaccagtgagccgctaccactggattgccaaccaggaggccgagggcgtcccggtaacggcggcgtgccgagtagcgagggtctcccgccaggcctactacgcctggcgacaccgcaacaaccgaggccctgacccagagcacctggtgctcgtcagcgaacttcgcaccatctggcaggcaagcgacggcacctacggcagccctcgcatcacccacgagctgcgacgacgcgggttctgcgtgaaccataagcgggtggagcgcatgatgcgcgagctggggatggcagcgtgcccaccccggcgcttcgtgcgtaccacgaggcgtggggaagacacgccgctcccagatctcgtctgtcaggacttcgcccctcgcgagccagcgcgccggtacgtgagcgacatcacctgcgtcagaagcgacgagtgtaggcaccgggcgttaactgaccctagaacaccggaacgatagtgacccaccctccagagtaggttgccctcaagaagtcaagaagggggcagcccgatgctgaagggcaggtcgttgatgaggctattcgaactgcaggcagaggggctcagctaccgcgagatctcacggcgcacgggccactcccggaacactcctacgtcgctacctgccagacggcgcaggcacgaggaaagtcacccgcccccgacggggctccaagctggacccctccaaggcgcaagatcgaccggctggtggccgaggggctcacctcggccccggccatcatggaacggatcgccaagctgggctatgagggcaaggtcaccatcgtgcgcgactctgtgcacaccatccgccatatggcacccccgaggccggtgcccatccgccgctacgagaccccgcctggccaccagctccaggtggagcgggggatcttctcctacgtggacgcccgaggcgaggagcggcgcatcccagggctcgtggccaccctcgggcactcgaggcgcactgcgccacgtttgccccgagcgccgacagcgacgggttcatcggtgcactgctggaggccttctgccacttcggagggctcacgaagtggtgctcaccgaccacgcaaagaccgtcgtgctcggcggggatggcgagagcggctacgagtaccaccctcgagctccttgacctcgctcgctacctcggcatctcgatctcgctgtgtcgggtccgccgacctcaagaccaagggcaaggtggagcgctccatccgctacgccaaggagcacatctcgccagcccgccagttcgtcgacctcgcggacttgaacgaccaggcccgtcggtggagcctcgagcgtgaccaccggctgcatccgagcctcggtaccacgccgatggaggtcttcgaccgcgccgagcgtgatgccttgcgtcccctgccgccacgcaccgagctcgatgcctttgtgcgccgtccgagacgggtgagcttggacggcctcgtctccttcggtggcatcaactacggggtgccgatcgcctatgtcaagcgcacggtgtgggtgctgccccgaggtcgcactctcgagatcactgacgcaaccgggaaggtgatcgccacccacccgctcgggttcaagacccgcacagtggtctacctgccccagcagtaccaggggatcgctgcctcagaacctgcgctcgcactccgaggcccccgagctcgccaactcgccgaggtcgatgtcgaggtgcgctcgctcgatgcctatgaggcgcttgtccatgcttgaggtcgccgaagcactccttggcgagctcggccttgcccgcagcgccgagctgctcgcttcgaccatcgaggcagccacccaacgcgaggcctcgtacgcggacttcctgatcacgctgctcggtgccgagcgcgacgagcgtcgccaccgtagctacgagactcgtctcaggctggcgggcctgccccatcgcaagggccttggcgagttcgacttcgacttcgccaccggggtggaccgctccctcgtcaacgagctcgcctcctcgcgccttcgtggtgaacgctgcgggcgtggtgctcctcggaccccctggggtgggcaagactcaccttgcggtgggactcgccctgtcggcgctcgaggccgggcactccgtctacttcgccaccatggcccgtatggtggcagacctcgagggcatggtgagcccgaggcgcttgcgcaaatacctcgcccccaaggtgctcgtcatcgatgagatcggcaccggacgctctcgcacggggcagcaggggtcttcttcgaggtgatctcggctcgctacgagaccgggagcatcatctgcacctcgaacaagggcttcggggagtggggcagcctggtgggggacccggtgctcgcaaccgccatcttggaccgcctgctccaccacgccacggtcctgaacatccgcggtgagagctaccgcttgaaggaccgcaccaagcaacggctacccggtgggctgctgtcccaggcggccgaggccatggcgaaaggaggtgatgccgaacaccacgatctggggagctatcccctatagttgtgtcgcgggtgggtcagttctgactggtgatatcgggtcaaaagaaggccggtgcctacaacgaggggttctgctatctcgcctcggtactcgaccttggctcgaggcgcgtcgtcggttggtcactcgagcgtcgcatgccaggagaacaggtggtcgaggcgatcgagggagccctttcgactcgggggagccttgctggggccatcttccacagcgatcgcgccaatcagtacctctcccggaaggttcgccagctgtgcaccacgctcgggcttcgccagtcggtgggcagggtcgctacctggtacgacaacgccgtggcggaggcgttcttcgggagtttgaagcgcgagctggtggctcgctaccgcttcgcgaacctcgccgaggcccgctcagccatcgcagcccggatccaccgctacaacaccgtccggctgcactcgagcctcgggtacggaccgccaatcgagtacgagctcacctgggcccgggaggaggcggccgtggcctaaattcagactgtcaagcaaatggggggcagcccagctcgctctggcgtcgctccctggatccaccctccaacacggtcggagtgcattccgagcctcgggtacgtgccgcccgtgaagtacgagctctcctggggggcgaggaggtggctgtggcgtaacttcagactgtcaagcaaaggggggaggcccagggtgcctcttctggctagctgctaactgacacaccagagatcgctcgggggcccgccctcctggagtgcgggccggccggatatgacaccacttggtgggacgccactcagtttcctaccctaggattggctcatggcagctacgaacatcccgcagtatcacgagctgatgtggccagtgctgactgctctcagggagctgggcgggtctgccacggtcagggaaatctacgaccgggtcgtcgaaaacgagcatttctccgaggaccagcaggctgaatcgaccaaggatggtcgtatgtctgagatcgagtaccgcctccattgggcgagaacccacctgaagggaatcggcgcgatcgagaacagctctcgtggtgtctggtcgttgaccgacaagggccggacgatcacgctggaccagatgaggaccgatacgaaggcgtatcgagacgaggtgcagcgtcgggcaagacagaagcaggctttgaacagcgcagccgtagaaactggtgatgaggagccggagacctggaagaatcaacttatcgatcggctcctcctcatcccgccggacggcttcgaacgactcgctcagcgactgcttcgtgaggccggatttgtgaacgtaacggttctcggcaagagcggggacggaggcatcgacggtgtcggtgtgtaccgactttccctcgtctcgtttcccgtctacttccagtgcaagcgctataaaggaaccgtgacggcaggtgcggtccgagactttcggggtgccatggcaggccgtggagagaagggtctcctgatcacgaccggctctttcaccaaggacgctcagaacgaggccagccgtgacggagcaccccctgtcgagctgatcgacggggatcggctctgcgacctcctccgtgactaccggctcggcgtggacgtccgggagcgcgtcgaccttgagattgcgctcgattcctcgttctttgacgagtatggctctaccgacgctaccagcccgacctccgcttgaagcccgctgccaaacgccccacccgattgtcccctcttccgaggcgaagcggctgtcgtggtggatgaacacagggaggagctggcacgtgcgggcctggctccttggacttcgcggttcgtgtccccgctcgaggctggcgacgcgtgagctgccgaggcacgagcagtcggctggccgcgtcaacaacaagcgcatccatcgcctgtgggttgcagcgaggcgctcaaggtgccgatgcaagcgccgcaagcagccgctccgcggtcttggcgtcgcaggaggcgccatgggcccgatcaagcctcacgtcgtgtctggcctgtgactttcagttcgatcagacgagcgacgccaaggagccaaagctcctcgacgtcatcgacgagttcatccgagaggcccttgccacctaggtggcacgggccatctgtgctgatggcgtcgttcgctgtgtggaccagatcgcgcttgcgcggggagtaccagcctctgtccttggaccacggactgcgagttcgtggcgcgaggcagtggcggactggtgcagctacaacgcagacggggaccgttgtcatcgacccaggctcgccgtggcagaacgcctggatcgaaagcttcaacgggaggatgcgcgatgggcacctgaacccaaaccgcttcgacagcctgctcgaggccacagtgctcaggccaagactggaggaacgacgacaactggaccaggcctcagagtgcgcatggctgggtcagtcccgcgcagttcgcaaaggcctggcgagagaagcatgagttacagccacagaggggctggactcggcaatgggaaccggtcaaagtctcgagccgccgagagcgcgagcgccggggcggtcagtagctcccgccttcccgacggtgggccaggctcccaaccggaggtggatcagaccccaccaaccggtgggggccgagcactcgcgtgggggccgtagcgagatgtctgtcgctgtcggaacccaccatgggtagtcctcgcatcgtgggaagtggactcgggcggcgagcgcgatgacgggcggggtgtgagcgatcctcaggagtgcacgggcaagagatacgctccgatggtgtcgtgcacgcgtgctgggcacgtggcacgtctggtccgggcgcgagtgaggggagccgggacgccacttggctgcagggccatcgcatcggcggcgtacgactggactgattgaatcggattcccaatgggccaggaagcccacgccccttcggggccatcggcgaggcggggctgagctatgcctgagtgcggaggaagggtgggcgctgtcgggcgaagttacgtcggcggcgcggtgcgtcatcgaccgcgtacgacgcgtaccgatccgaacgccgtgacgaccgtggccgagagggctcggccgtcgtgcatgggttcacggtgccgtcgacgcaagcgcgagccgacgatggtgacgccggtgagcgcgagccgatcatgggccgcgacgacgagcttggtggttccgaacaggttgacgatgactacgcgtcggggcgggggattggtggcagggaactccactcgaagtcggcccatcgcgttcacgatcacgttgacggatcgcttgagctggagaactcccgatccgaacgcattgaagccgatgccaaccccgggctcgtgtggcgcgggcagctcgagcggccggaggtcggcgaggagtcgagcgagctcactctgcctacgcgcggcgtaggcgccctcgatgcgctcggcggcctcgtcgacgtcgagctcgccggcggcgagcgcctgacgaaggcgctccgcggctgcctctcgttcggcgtccgagcagcggtgctcgcggtcgtccgccatcgatgctgagcctataggccttttgcgcgcgacgcgggcgatgaggggatctgagtggacgatgagggtgtggggccaacccggtcagacagacgactgggaggtgggagcatcactggtgcgcgacgggtgacggggtcggcgcaggttgtcgaggatgcggcggagctcgccggtggtcgtctgctcggtaccctcggcgggtggcgtggacggcgcttcgatcgagtcctcgagatcgaggcgtggcagatcgaaaccgaacgtcgtgcctcgccccaggccgtcggaacggacccaggccgttccaccgtgtgcatgcacgatcgcagcgacgagtgcgagtccgaggccggccccgccgctcgcgcgtgagcgtgactcctccgcgcggtagaagcgctcgaagacgtgctgggcaaccgctggtgtgagtcctggtccgctatcggcgacgctgacgcggaccttctcgtcccactcgagcatcgcgaccgtcgggtcaatcccgccgaagagatcgctcacctccgtgggcgtgatggccccagggggcagaggagcgctgcgcgccaaggcctcgaccgtgacgtggacggtcgtgccgggtggtgtgtgggttcgtacgttggcgagcaggttcgtgacgacttgggtgagccggttgtggtcggcgaggacgagcaagccgtcgggggcgtccacggtggtcggacggcgatcgtcgaccacgttggcgtcctcgacggcatggcggacgagactgccgacgtcgacgggcgccaactcgagcgggagggactggtccatgcgcgcgagtgacaggagatcctcgacgaggctgcgcatgcgctgactctgctcgagcgagcgctgcaccgccatctgcgcgatctccgggtcgtagcccgagcgatcgacgagctccaggtaaccctggatcgaggcgaggggcgtgcgcagctcgtgactcacgtcggcgatgaactggcgcagtcgctccctggaggtctccgaggtggcataggcgctctggagccgtccgagcatggtgttgagcgctcgagcgagcgcctcgacctcggccggaccggattcgtcgacgcgagcctgggtgtcgcccgcgctgatggcctgggcactgcggcgcatccgctcgagcgggctgagccccagttggatggatgcccagcccacgatgccgagcgtgatggtcacgccgagcgatacgagcagctcggcgagcgcgaggcggccgacggtgtcctgcacgctggtgagcggttctgcgacgaccatcgtgccgccgaactcggggatctgggccgcgaggacgcgataggtgatgtcgctcaaggggtcgtgcagcgacactggtcgtccgacgggcacggcgagctcggcccgtccgttgctgaagcgcgtgagtggcggtgcctgctgccccacgtagagggtggggctgagtggggtggtgatggtcgagccgttggcgtagacgaaggttccccacgatccgaacggcaggctgagatgcaggtcttggttcccgttcgggtgcaggaccacctcggccgctgcgggggcgatcgactcctcgagggtcgtgtcgatgcggttgatcaggaacgcgtgcagcgcggtgatggtcgcgagatcgatgaccgcaacgccgaccacgagggtcgcgagggtgatcgcgagcagacggagccgcagggtccgttggcggcccccgtggtcgctacgccgactccgccgcacggagggagtagccgacgccgcggacggtcttgatcatcggtggaccgtagccgtcgagcttcttgcgcagatacgagatgtaggtctccacgatgtttgcgtcgccgccgaagtcgtactgccagacgtggtcgaggatctgcgccttggagaccaccttgttcgcgttcagcatgaggtagcgcagcagcttgaactcggtcgccgtgagctcgatctcgtgtcccgctcgcagcacctggtgggcatcctcgtcgaggacgaggtcgccgacgacgatccgagtgggcgcacccgtcccctggccggagcgtcgcaggatcgcctcgacgcgcgccacgagctctgccaacgagaagggcttcgtgacgtagtcgtccgagccgagctggaggccctggacgcggtcctcgacggcgtccttcgcggtgagcaggagcacggggacgtcgttgcgctcttctcgcagacgacggagcagggtgaagccatccatccctggcatcatgacgtcgaggatgagcaggtctggcttcacggtccggagtacgtcgagagcctcgcggccggacgaagcgacgctcacgtcatagccttcgaaggtgagcgccatctgcaggagctcggtgatgggcagctcatcgtcgaccacgagcacgcgaacgcccttcgctggcttgcgcaaactgtccatctgcccacctcgctgtcgtgttgagtgtaggtccttaccaggggccgtgcatcaggccgccggcgaggtgccgagcgtcgccgtcagggattgctgggccccgctctgggtcacgatcgacaacgtgatctgttgccccggcgacttggcgtggatcgccgtggcgagtgcgttcgcggaggtgacggcctgtccatcgaccgcggtgatcacgtcacctggctggatgcctgcgttggccgcgccggagccgggatagacgtactcgacgagcacgccggtctgcgaggtcggcaagccgagctgtgagtcgagcgtgggcgtgagtgtctgtatcccgacgccgaggaatgctccggatcccgccgtcgtggtcgacggtgacgtcgaggaaccggtgtaggcggtcgggttctgttcgatggtcttcacgatgggcagcaccgagttgatcgactcggcaaagcccaggttctgcgccgaggtctgaccgctcgaggcgatgaccgccgtgttcatcccgaccacgtccccttgggcgtccacgagcgggccgcccgagttgccggagctgatgggggcgtcggtctggatcatgccgctgatggtctcggtggtcccgaggctgtccgtcgcggtgatcgtgcggttgagggccgacacgatgccttgggtcaccgttggcgtgccttggagcgccagggcgttgccgatcgcgaccactgggtcaccgaccaccagcgcggacgagtcgccgaacgtgacggtcgggaggttcgatgcgccctcgatctggagcagcgccacgtcgtgagccggatcggtgccgatgatcttcgccgggcgcgagctcgactgaccgtagagcgtgacgcgcacgttgctcgccccggccaccacgtggttgttcgtgagcacgagaccgttcgacgagatgatcatcccggtcccggcgtcttcgaactggctcacgccgaagccgttgctcgtcgtgccggtggcggtgatgtccacgacggcaggctcgaccttggcgaggatcgcggggatgttcagcccgccttggccgctgagtgcggcgggctgcgccttgacctggcggatgacgatcggtgtgcgcgagccgccgctcgactgtccggtgaggcggaccacggcgtagctcgtgcccgccgcgacgagggcagcgagcaccgcggcggtgccgacgacgacgccggggcgccggcgtggcttggtgcgggtgggctgggtcgatccgaagctcgtgatcggctcggcggtcgaggtccacgacggttccgcgtgggcccaggtgacggtgtcgtcctcggcccgcggtagctcgtcggcgccgacggtgggtacctcgtcggtcggacgctcgtcgtcacccgacggaggttcgctcacctcggcggggtcagcggacgcaggcgcctcatcctgcggtgattcggccgcgtcgtccggctctccggcgacgggcgtcgcgtcggtgtcgtcgatgctcatctgtcctccctcgtggagctgggagcgccgctgggggcgccacgcataccagcatgggttctccacctttgcgggagcttaggctcctgtgggaggttcgctggaggatgaccgagcgcgcatgagctggacgttcgcgagcgcggcttgcgcaagctcggcctccatgcgcgttcgtcgggcggcgatcacgaggcgcttcgtggcacgctgggcctcggtgggagcggcgagaaattgggcggccacggcatcgacgcgtcgggcgagctcggcgtcgtccgccacgacgtcgtcgaggatgccgtacgctcgcgcttcgttcgcgtcgagctcgcctgcccccagggcgagggcgagggcacggtgcgtaccgacgacctctgggagcaggctgagtcctccgagatcggcgacgataccgaagcgcacctccggcagtgagcaacgcacccaccgcgtcccgatgcgaacgtcgcacgcgagcgcgagctcgaggcccgcaccgatgcaggcgccgtcgatggcggcgatggtggggatctcaagcgtggcgagcgcgaggaacccgcgctggagcatgccgatcgtctcgggacttggggtagcgccgagacctcgaagcagatcgagatcgatccctgcggagaagtgcttgccgctcccgcgcacgacgacgcaggcggcggcggcatcggacccgatctcggccaggagatccgcgaggtcgccgaagtcctccatgccgagggcgttcgccttggtggggttcgcgatcgtgatggtgcgcagcggtcccgaggtctccatcgtcagcatggcccgaccgtagctgacccaggcgaccttctgggttcacctgggccctacgatggagaggaggtggccaagggaggcgagtcagcggtggtccgaatcttcgatcgcgaggtcgcctgggagctcccctcgcgcagcagcgcccacgcggacgtcgtcgcggcgctggagccggcgacggagaagctcgaggcgtggcgctacagcccgatcgatgacgtctctgtcgcgtcgtacgccgcggtggcgaccgagacgatcgacctcggtgctgcccgcgcgctgctcggcgccgcgggtcggtcggggggagcagatgtcgtcgtcgggccgcgaggtctcgtcgctgcgcatgaggtcgagggctccgccgtggcgggcgatcgtggggccgatgagctgatcacgctcgacgaggagcccttcgcgacgctcgcgaacctgttggccccggagcgagtcgagcttcgcctcgacggtgcagccgaggccgcactcatcgtgggcgggagcggtcaccagagcgcagcctttgcctggatcaagatccacatcaccgccccgacgaccttgtggctcgtggacggagctggcccggagacgctcgcgagcgcgctcgtcgaggtcgaggtcgccgacggggtgcacgcctcgctgcgtcatctctcgatggggggtgcgggcagcatcggtttcctccagctgcgtacgcgtcttggggccgacgccgatctcgtcgttgccgaggtcgctgcccaagggggctaccaccgcacgcgcagcgacgtccacctcaccggcgaacgcgcgcgcgtgcgcatccgctcggccttcgtcgctgggagcggtgaagtggaggagtttcggacgttcgtcgtccacgcagcgccgcgcaccgcgagcgacctgctctacaagggcgcactgaccggttctggaacctcggtgtactccggcctgatcacgatcgagcccgctggtcatggatccgatgcgttccagaccaaccgaaacctgttgctctcgcccgaggcgcgcgcagagtcggttccgaacctcgacatccaggtcagcgatgtgcgctgctcgcacgcctcgacggtgggtccgctcgaggccgagctcgtgttcgcactcgaggccaagggcatcgaccccgatcgggcgcagcggatcctcgccgacggcttcttcgccgacatcgcggatctgtcggagggcgagcgcgcactcgttcggcgagctttggaggaacgatggctgtcgtaggtcgtgtggaggacttcgtcgacgcgaagccgcgtgccgtcgaggtcgacggtcacccggtgtgtgtggtgaggatcggcgatcggttcttcgcggtcgacgacatctgctcccatgcgcactatcggctctccgagggcgatgtctacgaagaggagctcgagatcgagtgctggaagcacggctcgaccttctcgttgctcgacgggcggccccagtcactgccggcgacgcgaccgatcggggtccatcgcatcagcgttcgtgaggacggctcggtcgaggtcgaactcggaggggacaagtgaccacgcccgcactcgtcatcgaagacctggtcgtcgaggtcgccgaacgtgaggtgctccacggcgtgagcctggcggtggagcccggcacgacggtcgcgatcatgggtcccaacggatcgggcaagtcgacgctggtgcgcacgatcttcgggcgaccgggctacgtccggcgccgtggggtgatccgcgtcggcggggtcgacgtgagcgaggcgccgacgtacgagcgcgcacgagcgggtctcgcgctcatcgagcaagacccggtcgaggtccctggcgtcgcacccacgacggtcgtcgccgagggcctggccgctcgtggtgaggacgcggcgcgcgcggtcgccgtgctcgagcgcgaggccgaggcggtgtcgctggatcgtgcgctcctcgatcgttggtacaacgtggagctctccggcggcgagcagaagaagctcgagaccgcgatcgccgcgtcgctccccgggcacgtcgtggtcggcgacgagatcgactccgggctcgacgtggacgcgctgcgaacggtcgctcgccggctcgagagtctgcgctcagaggggcgaggcttgcttctcgtcacccactacccacggcttttgacgcacgtcgcccccgacgtggtgatcgtgcttgtccagggtcgcattgccgagacgggagggatggaactcgccgagcgcgtcgaggctgaaggctaccgcgcctacggggtcgaggagggtccgctcagctgagctcgagcgcacgctcgagctcgtgtcggcgctcgacgacgtcttcggcgacgtcgaggaggacgaatccctcgaggcgcccgtcgcgatagtacgcgaacgtcgagtccgagcgttgctcctcgtcggcgtccgctcccggggtgccgagcacttggatgaggtgtccgtgttggtcgctccagccgaacgggacgtctcgccacggctcgtggccaccgaggaggttgcgggcggcgagctgaccttgggtggccgcggtctcgaagtgctcgctccgcacggggcgcccccaccccgggtgatgccaggtcgcgacgtcgccggcggcggcgatgccgtcctcgatccgtccgtaggcgtcgcacacgaggccaagtcccgcgacggctgggacggcgtcgctgatccagtcggtggcggggcgcacccccaacccgacgaccaccgtgtcggcgccgatgcgcgtgccgtcgtcgagagcgaccccgtcgtcgtcgaccgcgagcgcccggtggccggtgacgacggtgacgccgttcgcctcgtgccacgcaaggaccgtggtggctgctcgcgggccgagggctcgagggaggatccgctcggctgcctccacgaccgtgacccgacagccgcgttcgcgggccgtcgcggcgagctcgagcccgatgaagccagcaccgagggtcacgagccggtgacctggtaccagacgatcgcgaagccggagggcgtcgtcgagtgtgcgcagggtgagcgcgttcgggtggcgcaggggcgctgggtggagtggtgccgcccccgtcgcgatgacgaggagatcgaagccgatcggtccggcggtcgtcgcgaccgtacgctcgtcgaggtcgatgccctcggcgcgcacactcggccggtgggtgtaggcccccgacggggtgcgcagccgggttcgctccggtgcgacgtgaccagcgaggagacccttcgacagcggagggcgttgatacggcgggtgcggttcgtcaccgatgaccacgatgtcgaggtccgcatcgcgacgtctggcctcgagggcagcgcgatggcccgcgagcgaggccccgacgacgacgagacgcgtcatcgtgatcgtcggtcctagtcgacgatcgtgatggcttgcgtggggcaggctcgagccgcctggtcgaccagcgcgcgcaggtcctcggacggtgtctcgtcgagcacgtagaggtaaccgtcgtcacggacctcgaagatcgcgggtgcgaccgcttggcacaccgcgttggactggcacttgtcgaagtcgacctcgatgcgcattggctagctccctccctcggcccttcccaggctaccgaccccgtgggcgctcgtgccctggcgatggccgagtttgtcctatctcgataggggaaagcgggccggctatgctgaatgcgtggcaactcctgtactcgaggtcgacgacctgtgggtcgaggctgaaggcaccccgatcctgcgtggtctgtcgctggtgatccgaccaggcgagctgcacgtgatcatggggccgaacggctcgggcaagtcgagcttcgcgaacgtgctgatgggcaatccggtctatcacatcaccaagggcacgattcgctatcaaggggtcgatgtgagcgagctccccgtcgacgagcgggccaaggccggcatcttcctcgccttccaagatcccgaggccatcagcggcgtgtcggtcgtgcagttcctgcgtcaagccttgagtgctcggcggggccgggaagtgtcggtcctcgaggttcgttttgcgctcgccgagtggctcgagcgcctcgggctcgacccgtcgttcgcgcagcgccatctcaacgagggattctccggtggtgagcgcaagcgcaacgaggtgatccagctcgccatgctcgagccggagctcgccgtgctcgacgagaccgactcggggctcgatgtcgacgcgttgcgcatcgtcgccgacggcatcacgttggtgcgacaccaacatcccgagatggcgacggtcatgatcacccactaccagcgcatcctctcgctgctcgagccgacccacacccacatcctcgtggacggtcgactggttgcctccggcggtcccgaactcgccgagcaggtcgagcgcgagggataccagcagttccgagaggcggaggcgcttcgatgacagcgacacgtggccttgggctcgacgtcgaggagctgcgtaaggacttcccgatcttcgccgagcgcggtgcgggcttccactacctcgactcggcggcctcggcccagaggccgagtgcggtgctcgaggcgatggacgcctactaccgttcccaccacgccaacgtccaccgcggcgtctacggcctcgccgaggacgccaccgatcgctacgagcgcgcacgccgagccatcggccgcttcgtcaacgcccccgacccggagcgcgaggtggtgttcacgaagaacgccaccgaagcgctcaatctcgtcgcgcagggtctcggccgggtgctcctcggacccggtcgcgccgtcgtcctgacggagatggagcaccatgccaacttggtcccgtggatgatcctgcaggagcagctcgggttcgagctgcgctacctgcccttcgatggtgacggccagctggtgctcgacgacgcggagcggatcctcgacggcgccgccatcctcagcgtcaccgcgatgtcgaacgtgctcgggacgctgaacccgatcccccatctcgccgagctcgcgcacggagcaggtgccgtcgtggtcgtggacgcagcgcagtatgcgccgcaccatccgatcgacgtgcaggcctggggcgtcgatctcgttgcgatgaccggacacaagatgctcggccctacgggcatcggcgcgctgtgggggcggctcgagctgctcgagcagatgacgccgttcctcggtggcggcgacatgatcctcgacgtgacgctggaggggttcgtgccgaacgaggtgccgtacaagttcgaggccggtacgcccccgatcgccgaggccatcgggtgggaggtcgccatcgactacctccgcgaccgtgtcgggttcgaggcactcgccgcccacgagcgctcgctgaccgcctatgccctcggtagcttggctgatggcctcggggagcgcattcggatcttcggcccccgcgacccggagcgtcgaggcggcgtgatctcgttcgagctccagggcgtgcatccccacgacgtcgcccaagtgctcgatcgtcacggagtgtgcgtgcgtgcgggacaccactgcgccaagcctctcatgcgagagatcggccaggccgcgaccgcccgtgcgtcgctgtatctctacaacgaccgtgctgacatcgacgctctcgtcatggcactccaagacgcctggcagcgcttcaacgactaggagacctcatggacgacctcgaggacctgtatcgagagatcatcctcgatcactacaagcacccacgcaaccagggcgtgctcgacgatcccgacgcgatccgagaggagggcttcaatccgctctgcggtgacgagatcaagctctcgatcctggtcaagggcgaccggctcgccgacatccgcgtcgatgggcatggctgttccatctcgcgctcgtcggcctcgctcatgagcgaggcggtcaaggggaaggacctcgccgaggtcgatcgcatcatcgagcgtttcaaggcgatggtcgtcggcggtgagggagctgctgaggggctcgattcgctgcgcacgctcggtgaactcgcggcgctccagggcgtcgtgaagttcccggtgcgtgtgaagtgcgcgacgttgccgtggaactcgctccagaacgcacttgccacggctcgagctcgcggaggcgagtagcacccccacgagctcgatgcggtggggaggtgcgccgtcgcgggccttcgcgatcggcatctcgaggacctgcgtcggcgtctgacgcttggtgcgagcctctccgtgtggccggctcacaatggctgtggcggagtcagacccgtacgagcttcgcgcgttggcgagccacccgaacgatccggcgggaacctcatcggaactgcccctgccctgccacgacgatgggccagggtgtgcgcggcgcgtgcgctcgtcgcgagttcgggagatgtcgatgtggccatgcggcggatcctcgtcggctggacccggatgtttgccgcggccgacgtctctcgcgcccagcgggacctgtcatcggtcgggcgaggaggtcgggctcggggtgacggtcgagtcggttgcggggcgggccggcggtcgggtgcgaaggtacgcgcggacgctctctcacagagcacgcagtgcggagtcccacgccgacgcccacgccttcttcgccgcgagccatcgctgcagcgctctggtatctggccgcgctcggccctcagacttcgagccctcgtcgtcacgtggcgtcgcgccggcgggaccctcgcccagctctggcgtcgtcgtggccccgtcctccgtgcgcgccagttcgagccatgcccgcttgcgtcgctcgcactcgtgccagaggtcgtgacactcgggtgcctggcagcgctcgcgatcgagcatgaggttcgcgaactcgtccctcactgcgcgcgtcagccgctccgggccgacagcgtcgatcaaggcttgccattccatggacgctgtgatgaccgcatcgatcgaggcgtcggctcccaggtccgtcgccacggccaccgctgcgtacgctcgcagccatgtctcacgccatcgggaggggagttccagcgacgatcgggacctccgcatctcagagcgtcgtaggagcatcgcgagcagctcgttcacggcttccctggggtcactgatgtctgtcactgcaaggtactgctcgatcgcatctcggcgaacacaggagggccaacgtcggttctcagctcgcacggtgcacctgcctgatggatcggtcggtcgctgcggtcgagcgtcgttccgtcacggtggctctctctgcacgagctcgcgagtcatcgacgaccacggctggaccgctcgtgacgcagcactcttcgtcgtgcgcccagcaggcatgcgcccggtcggctcggcctgcctcgacgaccacgggtgcccttgctgggcgtgatgacggcgtcgagatgcccgagcccggcgaggctgatcgtgcccaggaaaccatgctttctcgtcgggtggccaaacgccggcagcgctcgatcgggatgcgggcgttgaggacgccctcgcctatcagccgcctgatcggtacccggtctttcacgacgatcaccctccatggtcgggcgttcacctctcaccggtgaagtcgttcgctcgtcgaacggcgtcgaccccccgacgacctcgcgtcgtcgtccaaggaggacgggatctgtcgagccgtgcgtggcgcatccgctgcatcgacgttgcgacctccgctggagatgcgggtgctctggcatctggcgtttcctgtcgtgagtgcacgctctcacgccttcatggcgaccgagatcaaaggggggcgagctgggttcgcccgagcgggcgtgcccgtccttggctggcgagtcagggggccgtcagttgccaatggcgtcccccgtcggtcgtgtgcagcagcgtgctgcatccatcgtgacagtccagtgactgtagccagcccgtcgtgggcgagacgaacacggccgagaaaccctggtgcaagagggacgggatgggcacgcgctcgacggaaccggtcgtgcgatgcacccggacgaggaacgagaacgacggcgtggcataggggctgagtgtggcccagaccgtcgtgggcgacgcgtagtcgatcgcgtcgatgtcgttggcgccgacgctgaggttcgtccaggagttcccgtcgttgctggtgtaggcgagaacgtcatcggaaggcggggcgccggtcgccgcggttgcgccgaggggacgcgtcgagccgatccacacgctctgggcggagagcgggtcgatggcgagcgggatcgtggacccggtgtggtgtagcgcggtcggcctgatcgggtcggtgatgggggagagatacgtcgcaccggcaccgaacccggtcgcggctgtggtctcgagggcgactccggtcccgttggcgacgaccgcagcgactgcgttggcgatcgacgagggcaccatgagggatggtcgctcaccggcacgatcaactgtgacgagctgaaggactccttcgggcgtctgcactgcgatcacgagcgccctctgccgcgcggtcgtaccgatcacgtgagcgttcgggcttgcgaggagcttcgagagcgccggagaactccatctcgtcgatccgaccagcacctcgagctggccgcttggcccgaccccgacgataccgaggcttccttgcgcgttgaagagtgagctgaccatcacgtcgggaaacgatcgcgtccagccggttcctggactgtagcgatagatgcctcgctcggagaccgcgacgacgctgccgttcgagagcgtgcgaaagttgtcgaactcgacaccgtgtgtcatgaaccaatgcggctggttggagacgaacgacggtgtcggcgtcgtagcaaggagcgggggcgacgcagggaagttggctccaggggtcggctggaagccgacgacgaggctcgatccgacgacctggaggctatcgggaaagacgccatcgagctgagggcccgggctcgagattgcctggaaggtggccgatccctgcgtctgggcaaagtatgcagtttcgccctgcgaggggctcgtcaccaggagatacgagctctgccgaccgaagtcgaagctcgcggcggttccagggtatcgaagtgccagcgtctcgagcaggtgccaggtcctgccaccatcggtcgtggcctcgacggtggttccttgcgctgcgctgagcaccacgtagccccgcgctggcgtcacgaagccgacgccgatgatcgtcgggcctgacgagaagtgatggagcaggcgaaagcgcgttccctggtcgaccatcgcgtagagatcgccgctctgcagtgaggcgacgaagccgtcgttgcggtcgaggacgtcgaggagagggtctggccctggaagccgtgcgaggtaggagaacgcgccgtctcggtaccggagcagcaccgggttccctccagtggccgatgtcgaggccagatagacggtaccggtagcggtgatcgagctttggaggatgtcgagcggaagctgctcgacagccttggtggctgtggttttgctcgccaccgcgggtcgcgaagcgatcgcgccacagcccgcgagggcgagtgacagggcgagcagcgggaggatctccttccgcggccacgagcgggatgttcgccccatcgcgtctcgaccactcgttggggaactcatgggttcatggtagctcacagtgcactcccggattgggggtccgcgaccagcgatgctcggtcgagttggggttcaaggtcgcgctcggtcgtgcccggggagacgccatgagcgtgcggggctcggtgtccctggcggcggagcgcccgggtggccacaggcacgttcctccaagtgcggcaccagcgagcgccttctcgtgtgtcgtcgcgaacggcctcgacagcctcgtccaccgggtctgccgcttgatgaaaccgacaggacgatcccatcgtgctggtcaatgtggccacaagggtgttcgtgccagcgcgcgctggctgtcgagcgggtcgtcgtcggacctgccgtcgccagtgcaagaaccgcacgagcggccaacccacggtgagctgtgcgcatccacccgcggatctcgctgtagttgatgagatgcatatagtatatggttgacatggagcgcatcatgaacccgtacaccccgggtgctggggatcgcccaccggtgctcgtcggtcgtgagcgccagctcgccctcgcagaggccatgcgccagcgcatcgaacacggcttctcggcaccaccgacgttcttcgtgggtctccggggagtcggcaagacagtgctgctccgggagatcgctgaccagtttcgacggcatggctggctggttccctacgcggaggcccgccgaggtgcttcggtggctcggatgctggtgacctacgtgcacgaagccgagaactctgcgcccgtgaagggacgccttcgtgaggctctggcccagttggtgcgccgcggtggttcagtggaggctcttggcgtgggggcgacgctggggccagagaccgtcgactcgacgacacgcgctgcccaggatctcgagcacatgcttcgcagccttggtgaggcggccaagagcgacagggtgggcgtggccatgctcatcgacgaggtccagactctctcgtccgagaccgtccgggagctcatctgggtcgtccagaaacttcgccaggacctacccatcgctctcatcggcgcagggctcccgcaccttgccagcgtcctcgccagcgcggtcacctacgccgaccgcttccgctacgagagtacggacaacctcgatgacacggacgtacgagctgcggtgcgtgggcccgctcacgagcgcctggtcgagtggagcgacgacgcactcgacctgttgtgcacgatcgccaagggctacccgtacgccgtgcagctgtgtgcctacgaagcctgggagcaggcggctcgcccgggcgaccctcggcagtgggtcgcgatgccgttgtcggcccagtgggcggtctcggagttcggggagcgcgttggacccccgtcggtcgagggccagcaggtgcatgccatcactcgctcgcacctcgatgccgcgatgccgcgcatcatcgaccagatgcgcgcgggcctgttccgctcacgctatgacgggctgaccccgaagcagttcgcctacgtcgaggccatgcttgcggagctcgagcccgactcgacggctcccgtctcggccatcgcccagcgcctccgcgcgtcgctgagtgcgctgtctcccgtgcgcgatgccctcattaggaagggtgtcatctatgcgccggggcgcggccgggtcgcctttgccgtaccctggttcgcgagcttcctggcagaggagatcgttgcgaccgagccgagcagctatgaagcgatccttcccgggcttcgtgctcgcggcgtcgacctcgagcctccaggcggttccaccggtgcccctcgatcgccgactccacctctgcagtcctctgactaaggatccgtaccgctcgattcgacgggtgtcgcggccgcgcggaggcatctgtctcgttcggccttgcgatggtggtcgcgtacagtcgggagtcgagcaacagtggagagaacaggtgatcgatgccgagaccgggcggctcggccccgtacgggtcgtcgtcgctcccgacaagttccgtggttcgctgacggcggccgcagcagcgcgcgcgatgagcaagggcatccggagccagatccctgactgttccgtcgtcgaggtgccgatggccgacgggggtgagggcacgctcgaggccctcgaggcggcagggtttcgcgtgcgaggcccggtgctcgtccatggaccctacggtcgccgcgtgcaggctcggtgggtccggcgcggacccatcgccgtggtgcaagcagccgaggctgtgggtcgtcgggccgtagggtcggatcggctgcgagcccccgacgccacgacgcgtggcgtcggtgagctcatctcggccgctctcgaaccaggcgtgcgcgaggtcgtcgtgagcctgggcggctcggtcacgaccgacggcggcgccggcatgttggccgcgctcggcgtcgagatcgccgatgcgctggggagacctgttggcgatgggggcgcggcactcgagcatgcagcctcggtgtcggtcgctcgggtggacccgcgcctccgggcggtgcgcatcgtcggcgccgtcgatgtcacgaacccgctgctggggccagatggggcagcacgcctcttcgcgccgcagaagggagcctcgccggtcgaggtcgaccagctcgaacgcgccctctcgcacttcgcggacgtcgttgccggttccctcggacgcgacgctcgcgcgttggccggcgcaggcgctgccggcggtaccggctttgcgctcgctggcgtgctcgacgcgatgctggtgagcggcgcttcgctggtgggtgagctcacgggctgctggagcgcgctcgatggggcatcgctcgtcgtgaccggggagggttcgctcgacgcgcagtcgctgcttggcaaggtgccgatcgaggtggcgcgccgagcgcgagctgctcacgtgccctgtgtcgccatcgtcgggcgttgcgagctcgaagcagccgacctcgccgaggccgggctcggcgaggtggtggcactggtcgactgggccaacgatgccaccgaggcgcagcgccgagctgcggcgctcatcgcgatgctctcggcgcgcctcgctcgacgctggtgcgggtagctgcgcgttggcgcggccgcctcgtcactcgccgatgtagctcatgacgtgcttgatacgcgtatagtcctcgaagccgtacatcgacaggtccttgccgtagcccgagtgcttgaagcctccgtggggcatctcggccacgatcgggatgtgcgtgttgatccagaccgcgccgaagtcgaggtcgcgagcgacgcgcatggctcgagcatggtcgcgtgtccagacgctcgatgcgagcccgtactcgacgtcgttggcgaggcgcatggcttcggcctcgtcctggaagctctggaccgtgatgatggggccgaagcattccgaacgcaccagctcgtcctcttggcggaggccggcaaccacggtcggctcgaagaagaaccctggccggtcaacgcggttgccacccgtggtgatctgggcgtagctggggaggcgctccacgagcccgcggatgcgctcgagctggttggggttgttcagagggccgaagtagacgtcctcctcgtccggggcccccaccttggtcgcggcggcctgtgcggtgagggcggcgaggaaggcgtcgtgcgcgctcgcctcgacgaggacgcgcgcggcggcggtgcagtcttggcccgcattgaagtagccggctccggcgatgcccgccgcggccttctcgaggtctgcatccccgaagacgacgaccggcgcgttgccgccgagctcgaggtgcacccgcttgatgtcctgggcggccgcgagagcgacttcgcgcccagcgcgcaccgatcccgtgatcgcgaccagctggggggtcgggtgggcgacgaggcgtcggccagtgtcgcgatcgccgaggaccacgttgaagacccccggtgggaagatctcaccgatgagttcggcgaggagcgtcgtcgacgcgggcgtcgtgtcggatggcttgagcaccagggtgttgccggccgccagcgcagggccgatcttccagatcgccatcatcagcggatagttccacggtgtgaccgcggcgcagacgccgatgggctcgcggcggatgaaggaggtgtgatcggccatgtactcggccgccgaacgaccctcgaggttgcgcgcggccgcggcgaagaagcggatctggtcgacgctcggcgggatctcctcgctgagcgtcagcgctcgcggcttgccggtgttgcggacctctgcctcgacgaggtcgtcggcgtgcgcctcgatcgcatcggcgaggcggaacagcagcaaggaccgctcggacggcgtcgtgcggcgccacgtctcgaacgcgttggcagcggcgcgcatggcggtgtcgacatcgacctcgtcggacgcagggctgtgaccgtagacgagacccgtcgatggatcgacgatgtcgagcgtctggtcggcgtgggcgtcgacgaacttgccgtcgatgaagttgcggaacaccgtcgtcatggcatcctcctgggtgtcgatggtggctgtccagtgaggggacgcttctagtcaactacatctgagccgcgcttgcaaccgattgcgtcaactttccatggcaattctgcgctttctgttgacgaagccaccaaaatcggtaagaatggtggcgcacgtcggttcctgggtcgtaccgggtcggggagccgacgtgggtggcgttcgggttgcacccagcggtcgcacacgaacgaactcggaacggagggaggtccatggcgcagcgtcgtgagccgtctgtgcgggccttccccatgattcgtggccagggcttcctcactgccgatcgagccgagcgcaacggggatggggagcgggcgcccgtccagctcgatgccatctcgaagcagttgatctccctgctgcaggtggatggacgcgcgtcctatgcggcgctcgccaagcaggtcgggctcagcgaggctgcggttcgccagcgtgtccagcgtctcgtcgagtcccaggtcatgcagatcgtcgccgtcacggacccgaagatggtcgggtttcgtcgtcaggcgatggtgggcatccaggccgtcggcgatctcgaggcgttggcatcgcagttggcggcgattcccgaggtcatctacgtcgtgatcgcagccggcagcttcgacctgctggtcgaggtggtctgtgaggacgacgatcatctgctgcacctgttgaacaccgagattcgtccactcgagggcgtgcgatcgtcggaggtgttcgtgtatctccggctggagaagcagacctacagctggggaactcgctagggacggtgagtccgtgtccgtcgcgtcgaggcgcacaccatcgaggtcgacaatgaagttcgacggtacgcgagtcggagcaagaagggaaggaagaggatgagcgagcagcacgacctgtcggacgtggcccgtcggcacctgtggatgcacttcacccgcatggcgtcgtacgacgagcacgaggtgccggtgatggtccggggccagggcccctacgtgtgggattcgaagggcaagcgctacctcgatgggctcgctggcctgttcgtggtccaggtagggcacggtcgtaccgagcttgcggaggccgcctcgaagcaggcgagcgagcttgcctacttcccgttgtggagctacgcccaccagccagcggtcgaactcgccgagcgccttgcggcattggcccccggtgacatcaaccgcgtgttcttcacgaccggtggctctgaggccgtcgaatctgcatggaagctcgcgcggcagtacttcaagctcaccgggcagccgaccaagacgaaggtgatctcgcggaacctcgcctaccacggcacctcgatgggtgcgttgtcgatcaccggcctaccggggatcaagaccccgttcgagcccttggtccccgggtctatcaaggtggacaacaccaaccattaccgctgtgtgcactgcagtgcggccgagacctgttcgctcgcgtgtgctgacgacatcgagcagcgaatcctgatggagggccccgagaccgtcgcggcggtgttcctcgagcccgtccagaacgcgggcgggtgcttcacgccggcgccggggtacttcgagcgggttcgggagatctgcgaccgctacgacgtgttgctcgtctcggacgaggtcatcactgggttcggacgactcggcgagtggttcggcgcgatccgctacgactaccagcccgacatcatcacctgcgccaaggggatgacgtctgggtactccccgatcggggcgatgctcgtgtcggaccggttgatggagccgttcttgcatgacacgacgacgttcctccacgggatcacgttcgctggacatccggtctcggcggcggtcgggctcgccaacctcgacatcttcgagcgcgaaggtctcctcgaccacgtccgtcgcaacgagccgctgttccgggcacagctcgacaccctgctcgatctgccgatcgtcggtgagattcgcggtgctggttacttctacggcatcgaactcgtcaaggatcgcgccacgcgcgagaccttcgacgacgacgaatccgagcgactgctgcgtggtatcctcaccccgacgctcttcgagctcggcctcatctgtcgagcggacgatcggggcgatccggtcgtgcagctctcgccgccactcgttgcgggcccggagcagttcgaggagatcgtcgcgatcttgcgggaggcgttcgagcgcgcttgggctgcgctgtgatcgatggcccctcggtggcccaattgtgtggcgaccgaggggccgatgcgactcactgggattcgacggggtctcgcctactacgcacgtgctgagctcgcggatgagccgtacgcgccccgggcgttgctcgggagcggatggcgagagtatccgcacgcggcagcgctcgcgctcgacgagctggtgctcgaacccgccccgcgcacgctgatccacgcggtcgatctcaccatcgctgcccccaaggacgtctcggtcgtctggggtctcgccgccgagccctttgccgaggccgtggccgaggcccatcgaggcgcggtggccgacgtcgtcacgtggctcgagcgccttgacctcgcccgtgtggtggacggggaggcggtccccgccagcggcgtgcgcggggtcggcgcgcaccatcgcttgtcgcgcgctggtgagccccacctgcacacccacgtcgtcctcgccaacgcgatcgaggtcggcgggcaggtagcgcccctcgaccatgggcgcctgcggcgagtgttgccggccctcgagctcgggtatcgggtcgagcttgctgctcggttgcgtcgtctcggtctcgtcgtggacggcgatggcctcgggcgatgggcggtccgcggcctcgatcgtcgggtggccgatgccttctcgaccaggcgcagcgaggtgctcgcccaggcgggctcgaccgcctcggcccgagctcgtcaggtggcggcactcgcatctcgacgagggtgggccgagggacccgtcgacctagtgaacaggcgcgagcgatggcgcgaggcggcacgacgcgagcgtcgcgacgggcccggcgagcgcggtgcggtcgctgcgaccgcccaggccaaccgtcatggagagccgatccgtatcgccgacccgttcttcgcggagttctcctggcaggcccgcgctgtgctcgatgccggccagggcctcggcgacctggtggcagcgagcctccgagcggccgtcggaccggctcgggcgcgcgggttgctcatcggcgctcggatccgggctgcggggagcgagctcgccctcgatggttcgctcgtgcgtcgctacggagcgctgccgctggccgatcgactggcgctcgcgggcatcgacctcacgcgccccatcgtcgaggtgtcgagtcgcgatgccgtgcggatggcggacgagctgcggcgtgcgaccgggcgagagcacgtgcgcgtggtcgcacggagcgatgccgaggccgccctgctccagcgcctcggggcgttccgcgatggccgccatcccgcccgggtcgtcgtggatgccgtccatcgtgccccgagtgacctgcgtgccctcgtgacgagtccggaacggaaccttctcgtcgaggtgcgtcgtcggcccgtcgtgccgtctcgatcctccctgtcgctccagcgtgacggtcgtcgcatcgagctctgcgccgatctcgagaccgcgctcgaacgctgcggcgcctccgtcgccgaggtgcttgggcgcggtgaggacgtgtggccggtggcggtcgtcccggacactgcgtacgcacggcagctccgacgcgtggtggcacgtgcgttcggggtcgatccgcgctccccggttcctggagagccggtcctcgtgccacggactgggcgaggccgcgtcgtcgacgtgtcgcgcgatcgggtgacggtcgagacggggggcgcccggatcgacgtcgccgcgagcgaggtggtaccgctcgccatcgcgaccgaggggagggctccgatcgccttggggcccgacctccagcggggggtcgaggtgtctgtagtcgtggcgccggagctcgagcggttcgtcgcgacttgccgagcgctcgggatggatccgcggcggatcgaggctgctccgccacgcgaactgctgaccgatccgaccgcccgagcgctgtggcgtcaagcccgcgggttgcatcgctcactgctcgggcggctcgagctcggcgagcggactcgtgaggtcgatctcccgggtctcgaccggggccggtggcgttgaggagtcttgcgaggcccctgcgatggcggtagcctcgtctcagagccgttgctctggtgcctggggagaggtcgatggttggcgtcgtcaccgcgtcgtcattgctcgaggtgacaccgccctacggcggcgtcatcgtgctcatgctcggcgtgcttgcctattgggtcggggtgccgaggttggcgcgtacgttgagcatgtccccgaagcgggttcgtctccgcgacgtcgcgacgcggcggcagcgactcgcgtggagtgcggcgcttgcgatcgcgatcgtcgacgagtcctggcccgtgctcgagctcgccagacgcatctcgctggtggcctatctcctccacaacctggtcatcgtgctcgtggtcgtcccactggcgctgctcgggttgccggggtgggtcgtctttcgcctcactgagcgtcgatgggtggacgccgtcttgtcgctcattgcccgcccgctggtggcgaccgtgctgttctgtggcgtcacgatcctgtcgatgctctcgcccatcgttgaggcacaagcgcgatccctggtggtcttcgtctacctccaggtcgtgctcgtcatcgcgggtgtcgcgctgtgggtaccggccctgcgcctgcaaccgggcgtggagaagctgtcgaccggcggtcgggttctgttcctcttcgctcagagtctgattccgtcgttccccgccgtggcgctgatcttcgcgaagcactcgttctatccgttgttcgcacgcaacgtccacatcgtcttcggggtgtcgggcgtcggcgaccagcaacttgccggtgcgttgtcgaagatcctcaccctggggatcctttggaccacggccgttgttatattggcgagggcccagacccgcgaagatcgcggggacgacccggagcccatcacctggctcgacgtcgagcgagagctgcgccgtagctcgtccgggtagccctcgggccagaaccgtgaggagcacgcgtgcagcttcgcaacgtggcgatcatcgcccacgtcgaccatggcaagacgaccctcgtcgacgccctcttgcgccaggcgggagcgttccgcgagggcgccgagaccgaggagcgcatcctcgactccatggatctcgagcgcgagcgggggatcaccatcttgtcgaaggcgaccgcgatcccgttcggcgacgtcatcgtcaacctcgtcgacacgcccggtcacgcggacttcggtggtgaggtcgagcgagcgctctacctggccgacggcgcggtcctgttggtcgacgccgcggagggcccgctcccgcagacccgcttcgtcctggccaaggccatcgagcgcggcctcgcgctcgtcgtcgtgatcaacaaggtcgaccggcaggatgcgcgcccgcacgaggtgctcgacgaggtgctcgaactgttgctcgagctcggtggtcccgacgtggatctcgacgtcccggtggtctacgcctcgggacgcgcggggcgggccgacctcgagttgcccatgcggagcgaggacctcacgccgctcatcgagacgatcctcaagcacgtgccggctcccgatgccgatcccgacggcccgctgcgcgcccaggtgctcaacctcgacgcctcgacctatctcggcagactcgccctcgttcgcgtgcacgccggtcgactgcgccggggccaaagcgtggctcgggtcggcgtcgacgggcgcgtgagcactttgcgcctcggcgagctgttccggatgcacttcctcgagcgcgtgcccaccgacgaggtcatcgcgggcgacatcgccatcgtcgcaggtgtcgaggacatcggcatcggcgagtcgctgtgcgaccccaacgatccggagccgctcgcgccggtgcacgtcgacgagccggcgatcgccatgacgttcagcgtgaacacctcgccgctcgccggacgggagggcaccaagctcacggcgcgcctcttggcgcagcgcttggcacaggagatcgtgggcaacgtctcgatccaggttcgccagacggagcgcagtgatgcgttcgaggtccagggccggggggagctcgcgctcggggtcttgatcgagctgatgcggcgtgagggcttcgagctcaccatctcgaagccccgcgtcctcacgaagctggtcgacggcgaagtgtacgaaccctacgagcgcctcgaggtcgaggtgccagaggatctcttcggagcgctcacgcaggtcctctcaccgcgaagggccgaactcgtgacgctggagcactcccagagcggctgggtgcacacggtctattggatcccggccagaggcttgctcggcgcgcgaggcgagctgctcacgcagacacgcggccaagcggtcatccatcactccgccgatggctacggaccgtgggtcggcccgatccgcccccgggtcgcggggagcctcgtcgccgaccgggctggtgtggccacgacgtacgcgttgctgtcgttgcaggaccgtggcacgctgttcatcggcccgggtgacgaggtctacgagggcatggtcatcgggctcaacgcgcgtccaggtgacatggacgtgaatccgaccaaggagcgcaaggtgacgaacatgcgctcgtcgaccgccgaggaactcgtccgtctgaccccgccacgacgcttgacgctcgatagtgccttggagctcatcggcgacgacgagtgcgtcgaggtgacgccgaaggcggtgcgagtgcgcaaggtccagctcgtcgggagggagcgcgccaaggcgcgccgatcaggcgagatcggggggacggaggcgtcgtagcgggagctcccgcctggtgagtggccgggtggcccccaggcggtacacctcccggacgaggtgggcggaaggtccgggcacctcgaacagcacgacgcagtacggcgctcgtgacctgggcacaccgagggtcggcccgacacgaccgggcacctcggcgaggccgcggaagtgggccttcgctggtgcgtggacgagcgccgcctcgagtggacgcacacagttggccgcggacgtcccgccggcggagcgcgctccaccacaggcgcagagcgcggccgcgagcaccaggctcgtcacgagctcacgtcgtggcattggttggcctcctggcgatccagaagtaggccgcccatccgatcggcagccagatccagtagctggcgagtcgatagaggatgacggctgcgagcatgggcaccggcgctcctccgaaggccacgagcgcgacggtgatggatccctcgacgacgccgagcccgcctggcgtgatggggaggttcgtcgcgagggcaccgacgacgtaggcactggccgcggccgccacggacacgtgggcatcgacggcggcgagcgcgacgaggagcgcgccgaagtcgaaggcccagttgccagccccgaggccaatggaggcgccgagccggcgcggtgggatgcgcagcggctgcagacggcgtgcactcgcggcgaggcgtcgccatcgcacgcgggtggcgagacgggtgaggagctcggcgacccaggccgacaggcgctcgagctgccacagggcgagcgcggcggcgatgccgacggcgacgatcagcgcatcgtcgagcgacgagagcacgctggacgcgggtgcgtgcaccacgagcgcgagtgcgaacagggcgatcagggtacccatcgcgaccaggttggaggcggcgatgaccgaggcggcggcgaggacgtcgacgtcggcgtcgtggagctgggcgaccacccagacggcgctcacaccggcgccgaaggggatcgagttggtgatcgacagggctgcgagcgagatcgcgaggaaccggacccacccgagtcgcgttccgctcgggaggaggacgtaggtcatgagcgcccacgccgtgtcgctggccgcctccaggacgaacgcgatggcaccgaggacggcgttcgcgtggaggacgatggcgaccgatcccgagagctgggcgcgctgggaggcgagtgcccaggctgcgaccgcgatcccgacgagaccgaccaggagccgccagtggtggcgaacgcgcgccagtcgggccggtggagccatcgctcgcgcaggctagtgcggcgcaggctggccgtagacttggccggcggtgccggggcggcacctcgggcgttgggagggcggcacgagcgagttcgacgtcatcgtggtcggggctggcgctgccgggctggcagcggcgtcttacctgcactacgcaggcttcgaggtggtcgtggtcgaggccgaggcaacggcgggcggtcggctccgcaccgacaccgtcgacggctaccggctcgatcgtggcttccacgtcgtcctcgagggctacccggagcttcgccggctcctcgcgccagggaccaccggcctcgttgggctcttccccggtgtcgcactgctcgcgcccggcgcgccggttcgagtcctcgccgatccgcgccgcgtccccgcgaccgtcgcgactaccgcccgcgagctctggcatctgcgtgggatcccgcgcgctcgccggctcgtcgagctcgtcacgcgtgccgatccgtcggtcgcggatctcgtcggggcgctgcccgagccgctcggtcgtcggctcgccgggcccttcgctcgtggggtcctgctcgcacccgagctcgacgtgcccctgtggcgtgcaggcgaggtggtgcgtgggttctggcgtggccgtgtcggcctgccacaggggggcatcgccaccctcgcggacatcctcgctcgggacctcgagggtcggatcaggaccgcgtcgccggtcgccgccgtcgagtccggtggcgtcgtgctggagagcggggagcgtctcggggcaggcgaggtcatcgtggccgccggtcccgaggccagcgctcggctcctcggggcccccaggctcaccgatggccttcgttggcgagcccagggctatgcgcacctgcgggtcgcgggacccgtgctcgagctcccggtcgtcgggctcggtcccatggacgagccgatctggaccgtctgtgaggtgggggccgcggacccgctgcgagcgccgatggatcgggacgacacgctcgtgacggtgagcttcgacccgacgctcgatccggcggacgtgcagagggcggcggccacgttggtgcccgcgctcggatcggccgagctgctcgcgatcgacgtggtggctcaggcgctcccagcgcttcgacgtgcgcctgcggttcgcatcgcccggggcgtcacgctcgcgggcgactggaccgcatctccgagtctcgacggcgcactcggatccgggcggcgcgcggcggaggcagcggcccgtgcgctgcgaggagcggggagtgaggatcgatgatgcgtgaggtcgaggttcccatcgaggcggcgagttcgggctcggtcagtgcccggatgcgctaccgcgatggccgtcgcgtgatgtgggtcgcctcgcgtcccaccacgcgccgtggggcgctctctgagcgcgacggccatcggatcgcgcgcgcggccgacctcgcgaaccggctcgggatccccctcgtgctcgagctgtcgacctcgggagcgaagatcaccgacggggtctcggcgctgcacggatgggggatcgcggcgagcgcgttggcacgctgctccgggcgcatcccgatcctcgccggtctcgtggggcccgccgtctcgggaccggccctgctgctcggggtcgccgactgggtggtcgtcgcccccgatgccttcgcgttcttgtcgggaccccaagccgtccgcgaggtcaccggcctcgacgtgtcgaaccagacgctcggtggctcgcaggtgctcctcgcccggtctggggtcgccttcgaggctgccgacgatcgtcggggggtcgaagaggcgatctggagtgtgctcgactacctcccggactccaccgatgaggtagcccgacgcatccaccccatcgatcccgatccgatcgacctcgatcggctgattccggacacgccgacggcggcctacgacgtccgcgacgtggtgcggggcatcgtcgacgagggttcgttccacgagctgagacaggcgtgggcgaatcagctcgtcgtcgggttcggccgcatcgagggccgcgcggtggggatcgtcgcgaaccagcccatgatcatggccgggacgctcgacatccaggcggcccagaagggcgcccgtttcgttcgtctctgtgacagcttcaacctgcccgtcatcacgatcgtcgacacgccgggctttctcccgggcaaggacgtcgagtggcgggggatgattcgccacggtgcagaactggcgttctcgtacgcggcgtgccagacaccgcgggtgtgtctcatcgtgcgcaaggcctacggcggtgcctacatcgtgatggactccaaggggatgggcaacgacgtcaccctcgcgtggccgtcggcggagatcgcggtcatgggggcccaaggtgccgtggagatcttgcaccgtcgtgccgacgaggaagcgcgcgccgcggccaaggccgagtacgaggaggtctacctgaccccgtggatcgcggccgagcgaggctacgtcgatgaggtgatcgagccgtccgagactcgttcgcgcatcgctcgcgcagtcgagctcctcgtgaccaagcaggagcacctgcggcccgccaagcacgccaactcgcccctgtgagtcgccgtggtcgacgtcgcactcgagcgcctcgtgaacgtcgtcacgcttctcgcggagcaccccacgccgctcgagcgcgacgagatcgtccgcaccgtgccggggttcccggctagtgacgctgcgagcgcgcgcgcgttcgaacgcgtcaaggaaacggcgcgcagtctcggcatcgagatcgagaccgtcacgttgcccggacgcagtcgtgtgggctatcggctccggcccacgacctggcagctcgaactcgacgacgccgaggtggcggcgctcgaggcggccctgggtgcggtgtgggtcgccggcgtcgagcccggcctcgcccgcatcgggctcgcggtgggggcggtgcccgcgcgtgggcgacggtcctcgctgctcgatgcgcccccggccatcgtgaccgcgatcgccgagcgcgccgtcatcgagatcggctatcgcggtgagcgtcgtcgcctcgccccggtcggcatcggcgcgagatgggggcacgcctacctcgtcgccgccgacgacgacggggtgatcaagacctttcgcgtcgatcgcatcgacgagccgatcgtggtgctggaggcccaccacgagatcgcgccggtcccgatcgacgaggtgctgcctcggcaccctcgcgagctcgtcatcgaccgcccggtccaggtcaccgtccaaggtccgccggagaggctcgcggccgtgggtgccgacccggagacgggttcccttcgtgcggccaatctcgacgtggtcctggccgacgtgctcctgcacgacctcgcgttggtcgggccccaactggcgcgcgagcgcttggcggatcgcctcgcgacggccgagcgggcgctcgccgcgacgccgaccgcgaaggtgcctcgggccggcgtcgagcgcacgaacctcgcgactcgctacgccatgctccagaccatgctcagggtgctcggcgagcggggtcgagcaccgctgtcggagttggcggcggtggcgggcacgacgcgagagctcgccgccgaactgctcgagacggcctcgctgtgcgggttgccgccgtactcgccggacgtcttgctcgaggtcctcgtcgacgaccccgacggcgaggtcgaggcgcggctcgagcgaacgccgccacggggttcgctcgcgatcgaggaggccgtgagcgtgggggcgaccctcgaggcgcttcgtgaggcactcggcggcaccttgccgccggtgctcgatcggctgcgtgcgcgcatcgccgagggtctcggtgtcgtgccgcggctcgtcaccgagcctggcgagcgtgcgtcgctcgtgaccgtgcacgaggcgatcgtgctcggcgcgtgcctgcgctttcgctatgccccgatcggtgcgccgagtggcgagcgccgtgtgcgccctcgtgaggtccacgcgctcgatggcgtctggtacctcgacgcggtgacgagcgacgggaggatccgcacgttccgcctcgatcgcatgagcgagctcgtggtcgaggcgggttgtgacatcgaggagtcggatcgatcgcctgcgacgacgaccgtctcgttcgtcgtcgacgtgccacgagccctcgaaccgctcgcggagtacctcctcgggtccgctgccgaggcggttcagggcggcgtgctcgtgcgagcgcactcgatcggatgggccgcccgggtcgtggtcgcactcggcgccacgccggtcgctggacccgcgacgctcttcgacgaggcgcgcgccgtgctcgccgcggcgcggcgacggctcgaggccgaccgtgacgactgagcctgctcgtcgccccgacgctcgagcggcgctggcgcacggcgcgcgcgtggtcctctcgacgcgcgacgaggcgttcggggtgcatgcggtcctcgtcaacgccttcgtgatcggcggcgatcctctcgaggtcgccgtcctcgcgcgcacgacgtcgcgcaaggtcgcgaacctccgacgcgacgggcgctgcgcgctctgtctcgtcgaagggacgagctacgtcactctggtcgggttggcgcgcgtcgacgccgatccaggcgcggtgacgcgggccgagcgcgccttcgccgaggcgttcggccggccgccacggccagcacccgagggctcgcgcgtgctggtcgccgttcgggtccagcgcgtgctcgccgacggtcctcggcggccggttcccgaaggccggtaggctcatcctcggccgatgtcgtcgtgaggcgggaggtagcgtggccaggggcacgagctcgctcgagcaacggggcgacgcatcgtcgtctgcgtcgagagacctggcgctccgactgatcgcgagcctcctgccgatcaagagcgtgctcggcgggcgagccgccctcggcgactgcggggagcaggcagcggggctcaccccgcgccacgtccacctcttggtggaggtgctggtgcgcggtcccctcagcgtgagcagtctcgccgagatcgcaggcgccaatctcgcctcggcgtcggtcgcggccagccaactcgaagccgctggtctcgtcgtgcgtaccgaggatccggtcgatcatcgtcgcacgctcgtgcgggccctgccgggcgccgaggcgttcgtggcggcgttccttgccacacgcgctgctgcgctcgagcatgcgctcgcccaactcgagcctggccacgcggagcagctcgtcgaactcctcgacgagctcgccaaggcactacgggtttcgatccgcgaggctcgcacgcccctgtcggcgcgatcgccccaggtcgacgagtgaatggttactgaaacgaaacaaagtagggctcgacgggtacgcgcggcgggtggctagggtgcactcgacgatgccatgtcggaacatgtggatggcgcgcgcggttgggtcactcgcgcagagcttcgagccgttcggccatgagctggggaggacagcgtgagtcgcttctttgatgccttgggccactgggtggtcaagctccggtggttcatcgtggtcgcgtggatcgccgccctcgtcgcgtcggtgtcgttgttgccatcgctcggttcggtggtgcagaacaacttccagaacttcctcccagcccagtcgccctcgctgcgtgctgcggcgctcgccaatcgcatccagaacgtcaacgagtcgctcgtcgtcatcgtcgtcgatcggccgaccgcgccgctcacgagcaccgatgcgacgtacgtggcgcgtctcgtccatgaggtgcgacacgtgccgagggtgctgaccgtggcggtgggcgcgatctcgcccacccgacaggcggagcagatcgaggtgctctcgagtcgatcgcagttctccgacacgggcacgaaggcgttggtggacgccatcgacggcgtcatcgcctcgagtcatcctccggctggccttgcggtgcacccggccggtgcggtcgccacggcggtagcccaggcgggccagaacaacacgaacgcgtccaacacccagctgttctcggtgctcttcatcctcgtgctgctgttcctcgtctttcggtcggtcctcgcgccgttcatcaccctcatcccggcgttcctcgtctcggtgttggccggcccgatcgtcgctcgcttgacgagcgtgctccactaccaggtgtccaacatcacccagctcctcatgatcgtcttgatcctcggagccgggaccgactacgggctgttcctcgtgttccgtactcgcgaggagctccagcgcggcttctcgggtgccgaggcggtgcagcgggcgatcgcgcgcgtcggtgagtcggtgagcttctcagcgttcacggtgatcgcggcggtgctgtcgttgatcacggcgacgttcggcttctacaaggggctcgggtggccgctcgcgatcgccgtgttcatcatgctcctcgccggcctcacgctgcagccagcactgctcgccatcttcgggcgcgctgcgttctggccgagccggccgcatggtcggggggtccgcgtgggctggtgggggcgcgtcgcccagcgcgtggtccagcgcccggccctcaccctcatcgtgggcgtcgtgttcttcggagccctcgcggcttttgcgcctcagaatgccccgtcaggattcgcgaccaccaccaccgcgccggcgggaacgagtgccgcggcgggcaacgccgccttgagccgctacttcccgcacgccagctacaaccccacggagctcgtgttccgcttccgcacgcccatctgggaccacctctcgacgctcgagaccctccagagcgccgtgagccgctcgcccctcttcacgcaggtgacctcgccgctcgctccggctggcttcccgatctcggtgacggagctcagtgcactgcacgcccgcctcggcgatcccgccaagctcccaccgacgccgatcggcggcatctcgcccgtcgtgtactcgcagtatcggtcgctgaagaacctgatcggaccgactgggcgcaccgtcgtcgtcgaggcgagcctcacggctggcgcacccgggtcgacgcccgcgatcaacgcggttcccgcgattcgcaccttcaccacccagctcgcccatcgcgtcggtgcaacgacgagcggggtcgctggcgaggcgccggcgtcctacgacgtctcgagcgcgtcgaaccacgacctcacgcacatcgtgccgatcgtcatcgtcatcatcgcgctgctgctcgccctcgtgctgcgctcggtcgtggcgccgctgttcctcgtggtctcggtggcgctgtcctacttcgcagccctcggcctcgctgtgatcgtcttcatgaagttcgatcatcagagtggactcatcttcgtcctgccgttcatgctgttcttgttcttgctcgcgctaggggaggactacaacatcctcgtcatgacgaggatccgtgaggaggcgcacgatctgtcgatgcgcgaggcggtcgtgcgcgccatcggcgcgaccgggaccaccgtcacgtcggccggcgtcgtcctcgcgggaaccttcgcggtcctcgcctttgcgtcgctcgggcaggccgagatcgaggagatcggcttcgggctggcgctcggcgtgctcatggacacgttcctcgtccgcacgctcctcgtgccgagctccgtggtgctgatcggtcgactggcctggtggccatccaggctcgctcgttcgggtcacctcgaggtgccgccgccgcgtgacgaggtcgatcgggtcggcctcgaggctgaggtgcgtgggacgctcgagcacgacgacgcctgagcggggcactgtgggttgggttcacgcctcgatcgacgcacccaccggcgtcgcgagcatcgtgctggatcggccggagcgccgtaacgccctcaacctgacgctgtggcgccggctcgcagaggtggcgcgcgaggtcgcggccgaccccgccgtccgggtcgtcgtgatcgagggtgccgggggtcacttctgtgccggagccgacgtcagcgagttcggtgatgcgcgagtcggggaggccacgctgacctacgatgcggcgacggaggccgccgcggccgccatcgaggcgatctcggtgcccaccgtcgcgctggtcgagggggcctgcctgggtggaggggtgtcgatcgccctcgctgccgacgtcgtgctcgctgccgcgagcgctcggttcggcgtcccggcggcgtcgttgggcacgctgtatcccgagggggcgctgggtcggctcgtgcgtcgcgtcggcgatcgacgcgctcgctggttgctgctcggggccgagcgcatcggcgccgtggaggcggtcacgatcgggcttgccgagcgggtggtcgacgatcgcgcgagtgggtacgagctcgtcgtccagatggcaaccctgtcgtcgatgacgcagcaagcgaccaagcgggtgctcgccgatcagcgtgtgcacggggagcttgctcggatcgtgttcgctgcccaggactatgctgagggccgccgcgcctttggcgagcggcgagcgccgcgcttcatgagttcgtgggaggcacgtcgggcgctcgaggggggatcggggtctctcgaggacccgtgagagaggggggaccgtgcgggttccgttgaccatccgcgacttcttgcgtcgcgctgtcgaggtgttccccgagcgcgtcgcggtcatcgacgagccgggcgtggtcggatcgctcgggacgctcacctaccgcgagttcgacgcgcgcgtgcggggtcttgcgagcgcgctcgcggcccgggggatcggggtcggtgatcgtgtcgggatcgtctcgcccaatgcggcgaagttcctcatcgcctactggggcgtgtcgggctacggccgtgtcctcgtccccatcaactaccggctcagtcgggacgaggtcgcctacatcgtcgagcactccggcacctcgctcctgctcgtcgacccggagttcgccgagacgttcgctggcgtcggcggtgtcgagaccatcgtgctcgacggggtcgacgacgctgcgctcttcgcggcagcggcggcggatgagccggggcctgcgtgggagccggacgaggacgcgacggcgtcgatcaactacacctcgggcaccacgtcgcgtccgaagggcgtggagctcacgcaccgcaactgctgggtgaacgcgacggtgttcggttggcacctcggcgtcaacgatcgcgacgtgctcatgcataccctgcccatgttccacgcgaacgggtggggcatgccgtacgccgccaccggcatgggcgcgacgcacgtcgtcgtgcgcaagatcgtcggcgaggagatcctccagcgggtctcggagcacggtgtgacgctcgcgtgtggcgcaccggcggtctgggccgcggtcctcgatgccgctgccgtgcgacgtgaccgtggtgagtcggtccccggacgggaccaggtccgcatcgtggtcgcgggtgcgccgccgccctcgcgcacggtcgagcgggtcgagacggagctcggctggcagttcaaccagatctacggcctcacggagacctcccccgtgctcacggtgaatcgacgtccgaaggagtgggacgatctcccgatggcggaggtcgccaagcggctcgccaaggccgggacccctgcgatcggcgtcgagctgcgtactgacgccgacggcgaggtcctcgcgcgttccaacgtcgtcttcaagggctactggcgccaacctgaggagacggccgccgcactcgagggtggctggttccacaccggtgacggtggcgtcaaggccggtggttacctgacgatcatggatcgcaagaaggacgtcatcatctcgggcggcgagaacgtctcgtcgatcgaggtcgaagacgtgctcttccagcatccggcggtcgccgaggttgcggtcatcggggtaccggacgccaagtggggcgagaccgtgaaggcgctcgtggtcgtgaaggacggccagacggtcagtgccgaggagcttcgggagttctgtcgagagcggctcgcgcactacaagtgcccgaccagcgtggagttccgcagcgagctcccgcgaacggcgacgggcaagctgcagaagtacaagctgcgccagccctactgggaggggttcgagcggcaggtgaactagagatcgtcgaggagtcggaagtcctcgacgagcggtatagcggcatcgagccgctcggccgcgcgggacgccgcggtccgtaggcgcgcgacgagcgtcgccgtggggtcgtccgccgccgtgacgccgtaggtggtgcggtactggctctcgtggcacgcgaggagctcggccttgcgtgcgatggcctcgtcggtcgtgggttcggcgtgatccggcgctggcgactcgtacagggccaggtagcgcggtcggtgggccgcgtggaaccccggctgccacgtgggttcgcgggcgtcggcgagcgcctggaaggtcgcggttgcgaccgcgcgatggtccggatggaggcggcccgggtggtcgggatcgtggacgagcaccacgtcagggcggcaagcgcggatggcggcggcgatctgccacgcgaggagcgcgacgtcgcgaaggcgcccgtcggggtgaccgaggaggcggaggtctgcgccgaggagcgctgctgcacgtgccgcttcgcgggcccgggtcgctgcgagctcggcgccgtcgatcgtcgtgtcccaggtgccgtggcgtccgtcgcttgcaacgaggatggtgatcgcacagccgtcgtcggcccagcgcgccagggtcgcgcccgccccgagttcgacgtcgtcggggtgggcgccgatggcgagcgcacgagccggggtggcaaggggggcctcgtggcgcaggtgcgcgccttggagggctgcggtgacgccggcggcttggcgagccggggtcggttgctcgttcgtcgtcatggcgatggtgccttcgcgcggtcgatcggcgggcacggtgcgtccggccagtggagggctgggtcgagcgcggtgagggtccgggcgaggtcgaggtcgtcgtccgtgtcgatgtcgagcaggaagcgcgtgccgaggagctgcacgcgtccgtagcgctcccgtagcgcgctcatgtgtcggcggagggaatcggggccaaaggcgaaggggaacgcggccgctggctcggggagccacagcgccacggtcccggtgagatgatggtcgggtgcgacggcaccgacgtcgccgaggtcggtggggagtgcgaagaacgggaggtcggccgggaccacgaggacgcgaccgtcgaggcccgccacggtctcgccgatggcagcgttcagctcgcgaccacgttggtgctcgatcgcgagcccgaggtctgcggccagctcctcgacgctcgggtcttcggcgaggacgaggacggaggccggctgcgaggcgctcgcgatgtgcgtgacgcacgcgcgaacgaaggctctgcgctcgtcgcggctgagtgtgtcggcgaggcgggacttcgcccgctcgagggagcgctggatgacgacgacgaccgatggctgcactggtggccgagtgtaggctcgctcggcgcatgctccaccagccatcgggtgatcggctcgtcgggatcgacgaggtgggtcgcggtgcctgggccggtcccgtggtcgtcggtgccgcgcgtggatcggtggcagccgccgccgccatcctcgcgcatccgcgcgggggggtgcgcgattcgaaggccctctcgcctgcggcgcgcgaggcggcactcggcgcgctcgaggcggcgggtctcgagctcacggtgggttcggcgagtgctcgcgagatcgacaagctcggactcacgggggccttgcgtcttgctgcgcaccgtgcgctcggtgcagcgagcgagctcgaggtcctgctggatgggcgtgttccctacgtcgaggccggtcgtgtgcactgtatcgtcggaggggatcgccgccacccgctcatcgccgcagcctcgatcgtcgcgaaggtgcggcgtgacgcgttcatggtggcgctggacgagctcgctgctggctacggattcgcccgtcacaagggctatggcaccgccgagcatcggcgtgcgctctcagagcacggagtgacaccgtggcatcggcgcagcttcgggccgatcggtgggatggttgagcacgggtgatcggcccctggcggagcacgccgagggcgcgcgccggggtgtcgctggtgtgcgacgcgctccgctgtggcgatatctgcgagtctgggggcgggaagggcccgtcgtaggcagtcctgtcgcgtggtgcgggtgaagcggtcgatgtgaccttcccgttggcgacgagcggcgagagctcgcagatcgtggccttggagcatgccgtcgtcatggcccggccacccgaggcgccctcccgggacgcagcgcttggcccttccctgcgtggggttgttcgtgcacctcgaccgaggaccggagctacgagcgtgcgaccgacgaatccgccgctcgatgtcggggtgcgtcgtgcccatgtcccacaaggttgtcccggagcacagccggactggtcgctgtcgtccgggcgctggtgaccaccttggcgagtgtgctcgtcgtgcgcgcctgggctgcgcgaagaccgagagcccacagcgcatcgagctcacggatggccagatggcgcacagcgcacggacgtgccgcgctcggcttgctcgtgcggaactgtggcgacgaggtcctgatgccgccggtcggctctgggcagtcggaagctagatctacggcgatgcagtcagcctcccgcccgaggagtgcgtctcgtggagggagctccctgcgctgcaaggctcgctccgcaagcccctctggccgagatcctcgcagaacggaggactcctgccatgggccagccagtccagtcgcgtgggtgaggtgcttgtcctggagcctcctaggctcgcggggcgatggagcgccgcagcctcgccgccctcggggtgttgtcagtgatctggggctgctcgttcctgttcatcaaggtcggtcttgccacgttctcgccggacctgatcgcgttcgtgcgaacgacactcggcgcctcggtcgtcctcgcaacggcgcgccttcgtgggtgggcgcttcctcgaggatggcggctctgggccaagctcgcggtcgcggcgctcgtctcgaacaccttgccgttcatcctctttggctacggcgaacagcacgtgagcgcggtgctcgcaggattcatcaacgcgacgacgccgatgttcacgttcccgctcgccgtcgcgctcaaactcgagcgcgtgtcggtcgggcgtatcgcgggtcttgccgtcgggatcgtcggcgtcggtgcggtcgtcgggatcgggaccggggcgatcagcggcgcgtcaggtgtcggggtgctcgcctgtcttgctgcggctgcgctctatgcggtcggcttcgtctacgtccgcatgacactgggactgaccggcgccaatcgcaccggcctcgctggaggccagctcgccatggccgcgctcgagaccggcgtcgtggttctcgtcatgcggcagggcatcgggaccgtgcatccgctcgcgctcgccgccgtggcgaccttgggtgtcgctggtaccggcatcgcctacatcgtcaacttcgcgctgattcatcgatctggggtcgtcggcgcctcgctcacgaccctcacgatgaccgtcgtgtcgacggtcgccggcgtggtcgtgctcggagaaccgcttcgctggtaccaaccgatcggcgcactcgccatcctcgtcggtgcgtggctcgtccagggcgcgcgtcccgtctcgaccaggctggtgccggcgaccgagtgaccaggggaggtccgacgggagctcgtcgtgtgggaggcgggcacgtctcgaacctgggctgcggtggacgggagcgtagcggtcgatgacgatcgggcgctgatcgagtggcggcgagtcttcggcaggggcggtgtctaggagtggtgctctacgtagcgagcgatacgcaggtgggtcgcctggcgccgacgaccatcggccagcgacctcggtgagtatccagggaccggttgtcggtcggcgatcgcggcgaggcgagttcccgtgtccatcgcgtgctgccaagcccgagcctgaccgagtgcggtgtaggcgagcgcgacgccagcggcgagagcaacgacgacgagaccggtccgtaggagcgacccgctgcggcgggccagcgcgccgcggaggtcgtggcccgagctgtgcaacgagcgcttggagtaggcaaaggtatggatgaagaggagcaccagccagatcccggcgagcaggaagtgcgcaggcgcgaggaaggtgtcggagaacgacgtcggcccggcgaacgtgagctcggcacctgagaggacgacgagcacggtgaccacgacgagcaggggagcgagcaaccggagcgggagccacggtgcactgcgtacgtgcgccggcgagctcgagcggtagaaggaggcgaagcgccacgtcgcgagcccgagcttcagtacgagcatcgggatcaggacgaccccgatgacgatgtgccagaagagcgcgatgcgcaggtcgagcgctgtgaggacctcgagcgcgctcaggacgagcaatgcaacgccgccgagcgcaactcccctcgcgaccgcgatcgctcggggcgactcgcgcgctcgttcctcgtcgagacggtcgaacgacgcgtgatcgaagaggtgttcgaagagcgagttctcctcgctgtagagcacacgacctcccaggcacgaacgtcccagcggcgcgatcgagcgacagagacgtccttggttcaagtatacggtctgggcaggtgtcgcgtcgggatcaaccctcggcgggcggtcgcaggtcgatcgtgaaggtcaagatgccgtcctcaagcttggccgtggcgtcggcaagtagcgagaagtcgaagtagtcgagttcggcctgctcgcggaagcgacggcgctccgggccctcgacgggtgggagcggccgctgtcgtacggcttcggcgcgttggcgaaagcgttcgacgatcgcggtcggatcgaagctcgcggcctcgtcgctcggcatgagacctcctcgtggtcggtgtcgacacggctctggaccacggcagcgaacctgcgggcatgccgggccgtggtggcgcgttagaccagtctacgaggggcgctgcgaatcggaaggcagcggccctcgtggcctgcagagtagactggcgtgggcgcctgccgaggcagggccactgcacggctcgcgggcgagcacggtgccagcggccgaagggccgcgcgaggagagagcgggagtggctcgtgaagaaggggcgtcatcgccggtacgaggaggcccgcaaggccaagcgtgggcttgcggcgccgctggttcgttgtgacgagtgcggaggcgatgcggttcacggccacgcatcgtggtgccgggcctatctcctcgaggaggagctgttcgctggccacgtcgatgacgacggtgagccagagccgtcggcgtggatcgagggggagcgcggggccgagtgagcgagccgcacgcggttccacccgagtcgtcggagatcgtctattcactgatcgaagacatcgacggcattgagatcgcggcgcgctatcggcgcggcgacgatcccctccttgtgtatctccacggatggggtcggtcgttggcggacttcgcgccgtacctcggccgaggtccatggtcggccgtggcactcgacctgcctgggttcggtcgttcgacgccaccgcttcgaccgatgggcgcgcggggctacgcggagttgctccgagagccgctcgccagcttgcggcgacgcctgcaggcctcacgcatgatcctcgtgggccactcgttcggcggacggatcgcggccgagttcgccggactcgcgaccgacgcggacgccctggcaggcgtggtgatcgtggcgagtccactgctgcgccctcagggtggtcggcctgcgctcggctatcgcgtggtgcgatcgctgcacgctgcccatctcgtgcccgccacggcgctcgagtgggcacgcgggcgttggggatcgaccgactaccgccaggcgaccggggtcatgcgcgacgtgctcgttcggacggtgaacgagcaacaccttggtgcgctcgagcgtgctcgggttcccgtcgagttggtgtggggtgcgctcgatacggcgtgtccggttccgctcgccgagcgcgtcgcggcgcgcgtcgcgggagcgaacctcgacatccgagcgggcgtgggtcacgacgtcccgcgcgacgctccggaggccgtgtggggcgcgatccatcgactcctcgggcggatcgagcctcccgtcggctgcgaggagcagctcagtgagtagcgtcgccggcactctcggaatcgtcatcgggctcgcctcctgggtgggggcgctccggtggctccgcgtcgcccaacgcgagcactacatcccgggtcgcatctggctcttcgtgcgactgtggttgcgtgagtccccggcgtccatcgtcattgcggtggtcgggttctttggggcggtgtctgcgtggagctcggcactgccgcggatccctcacctcatcgcaggagcggtcgcggcggccgcgagcatcgcggcgccgatcggcctcggtcttcgcgggcgcacgagcccgttggccctcacctggcgcctgcgtcgactggcgctcgtcgtcgtgatggtcgatctcgtcgtggtcggcgtcggtatcgcggttggcgagccgctcggtgcggccgtgagcgccggctggctctcgccgctcctcgtggatctcgcactgcgcatcaccgcgccgctcgagcgcaggctgatgggccgcttcgtcgacgaggcgacgtctcggctcaggcgtgttcgcccgcgcgtcgtcggtatcaccggatcgttcggcaagaccacgacgaagggctacgttgcggccctcgtcgaggggacgtatcgcacgctcgcgacgcccgcgtcgttcaacaaccgcgggggtctcgctcgcgccatcaatgagcatctcacatccgacgtcgaggtcttcgttgccgagatgggcatgttcggacccggcgagatcgccgagctcgtctcgtgggtcaggccggagatcagtgtcatcaccgccatcggcccggtccacctcgaacggctcggatccgaggcggccatcgtgcgagcgaagctcgaaatcgtcgagacggctcgggtggtggtgctcaacgtggactatccgcgcttggcgctggctgcgaacgcgctggagcaggagggcgcgaggcgggtcgttcgggtgtcggcgatctcgctcgaggcggacgtcgcggtcaagcccaacgacgagggcgaggtcgtcgtctacgcgcacggcgcgaagatcgccaaggcggcgctcgccgacgtcgtggccggcaacctcgcctgcgcggtcgccgtcgcgctcgagctgggggtggcgccggaggacatcgccgagcggctcggacgcatcaagccagcgcccaaccggctcgtcgccggcgtctcgccgacctcgggcgtcgaggtcctcgacgacacctacaacgcgaacccgatgggtgcgcgccgggcactcgatgcgctcggcgcgcgccgtgacggtggagggcggcgcgtggtagtgacgccgggcatgatcgagctcgggcgccgtcagtacctggagaacttcaagttcgccaaggccgcggctcaggttgcttcgcacatcatcgtcgtcggacgcaccaatcgacgagccctcgaggccggtgccgacgaggggcgggacgaacccggctcgacgctccaggagctacgatgggctcccgatcgggagcatgcggtcgcgctggtccgcgagatgctggagccgggcgacgtcgtcctgtacgagaacgaccttcccgaccactacccgtagagcgagcgcgggagcgctcacggctgacgagcagaaggaggcaacgtggccacgacgcgcgtcggcgtctgcttcggcggcccaagtcccgagcatgacatctccatcctcaccgggctgcaggcgctccgcgcgctggccgagagcggtgggtcaccggtcgcgatctactggtcgaaggaggggtcgttctaccgcgtcgagccctccctcgaggccgaggcctacgcgggcggggtcccggcgggggcgagaccgctcgagctcgtcgtcgggcgcgacggcggcttcgtcgagccgaggggcggcctgcgaccaaagcgcgagctgctcgagctcgacgtggtggtgaactgctgtcacggcggtccgggcgaggacggggcgctccagggggcgctcgatcttgcgggcgtgcgctacaccggccccagtgctcggaccgccgcactcgggatggacaaactcgcgttcgcgagcctgttgcgccaccacggcatcgcgtgcttgccgcgcgaggacgggcgccgcgtgaccttcgacggaccctacatcgccaagccgcgcttcggcggctcgtcgatcggtatcgaggtcctcgaggatcgggcccagctcgaggcacgcatgcagcgctcggagcatttccgcgacggcatggtcgtcgagccctatcgccccgacctcatggatgtacaggtagccctccggcgtttcccgaccccgaccctgtcggcgatcgagcgtccactgcgcagcgccccgggcgagcccatcctcacctatcgagagaagtaccagcccatcgggggcatggcgacggccccacgggagttgccggctgcgatcgctcccgagctcgccgagaccattcgctcccttgccctcagcgtgggcgaactcctcgattcgcggggagtcatgcgggtggattttctcgccagcaccgagggcgagtgctacgtcaacgaggtcaacaccatcccagggagcctgtcgcactacctgttcgtcgagccgaagatcccctttgcggcccagctcgaggccgacatccgcgaggcactcgagcgagcgacctatcggccgaacgtggccggggccgacggctcggtcctgcgctcggcggggtccatcgcggccaagctcgcctgaggaacacgacccctcgtcacgagtagggtgggccgctgtggcgaggggtcatccgacgaccggtctgcgggatcaacgcccgagcgtgcagcggcgcgtcgcggcgttgctcgtgtcgaacgagcgcctcgagcacgtcttccatccccactggtggcgactcatcgaggcgagcggcggtgggctcgtcgggctcgtcgtcgcggcgctcgtggctggcgtcggattcggaccatcgttgctcatcgcggccccggtcgcggtgggctcggtcctgtggatcgtgatcggggtagtgcgctggcggtccgaactcctgttgctcacggatcgccgggtcgtgttcacccgaggagtcttcgcccgccgcacgagcgagatcccactgaagcacgtgaacgacgtctccaccgagcaggggctcatcgggaggttgctcgacttcggcagggttcgtatcgtctcgggcaacgccaacggacaagaggtcgtgacctacctccacgggccggcgcgccttcgccaggagatttcgcgactgactcaagcgagcgagtcgacgccgactccaacggcgacatcgaccggggggagcctcgtcgagcagatccagatgctcgcgttcttgcatcgcatgggcgagatcagcgacgacgagttccagcgcgccaaggagcaggtgctctggggcgacggcgcgcgagagtccgaaggggacgtcgaaggaggaccgtgaccatactcgacccgatcgaggcgcgatggcgccgcaaccttgctgcgtgggccatcccacccgagatcgcgcgccacggcgacgcgtcgccgtggcggctcgatccggcgatgttcctgcccgatcccgacgcaccgctctcgccgtcgcatcgggcgacgcgtgcgttgctcgagcgcgccgatgaggggagcctgctcgacgtgggctccggggcgggagccgccttctggccggtcgtcgagtccgcgcggcgggtgatcgccctcgacgagcacgctggcatgatcgaggccctgctcgccgaggcgaggcgccacccgaccgtcctcgtcgagacccgggtgggacggctcgaggagctgttgccgaccatggagtccgtcgacgtcgtcacgtcacaccacgtcgcctacaacgtcgccgacctcggcctctaccttggcgagttggtgcggatcgctcacgtcgggatggtcctcgaactcaccttgcaccatccccactacggctcggccgccatgttcgaggcgctctggggcgttgcgcgcccgagcgagccgagcgcagccgacgtcatcgaggccttgtgggcgctgggcctcgagcctacggtcgaggtccactcgggcacacgacgccgagacgaccccgcggcgcgtcgtgaggcgctccggcgacgcctctgcctcggcgagcaggaggtcgcgcgcctcgacgagctgcttcgcgatccgggcgagctcgccaatccgtcggtgacgatcgtggtggacctcgatgagcgcaccgcttgagctctggtgggagcgcacggggcacggcgaacggggcgacgccgtcttgctccacggcctggccggttcgagcgacgacttcccggccgagctcgatgcaaggctcgggcgtctcgggttcgggacggtgcgcatcgatcttcgtgacagcggccggtctcctcggctcgacgccgacggtctgccgcgtgtgttcgagctgctcgccggtgatcgcgacgccgcgccgtaccggctcgtcgacatggcccgcgacgtggtgcaggtgctcgagcgagcgagcgtgtcacgcgcgttgctcgtcggcgtctccttgggtggcatggtggctcagcacgtcacggtgatcgcgccggagcgcgccgcgggtctgtgtctcgtctcgagcgcgagccagcccgacctcgcgagcctcgtcgatcccacggttctcgcacccctccttcgcgcgggtctcgcggccctcgatgccggtgacggcgactcgaggggcggtgccggcgctcttcgacagctcggcgcggtcgtcgccagcgacccgtggcgtgaggcgatcgcgcagtgcgcgccggcgacgctgatcgtccacggtgccgccgatccgctcatcggggttcgtgctgcctttgacacgtgggccgagctcgagcgggcacggctcgtcgtgatcgccgagcgcggacacgaatggacgacgtcggcgtgggaccttgtgtggccgcacctggctcgcttcggtcggagcgttcgatgagtgggccgctcgctggcgttcgggtcctcgagctcggggggatcggcccggtcccctttgccggcatggtgctcggcgacctcggcgcgacggtggtacggatcgagccaccgagcggggccggactcggtgccgatgcgttggcacgaggcaagcacgtcattcgcatcgatgccaaggaccccgagggcagggcgctcatccgtgagctcgcgagccgtgcggacgtcttcgtggaggggtttcggccaggggtggtcgagcggctcggcatcggtcctggcgagttgtgcgctgcgaacgaccgcttgatctacgttcgcacgacggggttcggccagagcgggccgctcgcggagcgggcggggcacgacatcacctacctcgccatcgggggcgccctcggagcgacgggatcggcggatgcgccgccgctgcctccgctcaatctgctggccgacttcgggagcgggggcatgctgagcgtcgtcggggcgctcgccggcctcatcgagcgcgagcgcagcggtcgggggcgtgtggtggatgcggcgatggtcgacggggtcctcctcaccgagaccatggtgctcgccatgatgagagagggtgcctggcggcccatgcgggaggcgaacctgctcgacggcggggcaccgttctaccggacctaccgctgcgccgatgggcgctggatcgccgtcggcgcgctcgagccgcagttctttcacaccctgctccgcgagctcggcctcatcgagcgcttcgacccggccgcccagtacgagcgcgctcgctggggcgagctcgcgtcgctgctcgcggatgcctttggctctgcaccacgagccgtgtgggaggagcgcttcgccggtctcgatgcctgcgtcgccccggtgctcggcctcgacgagctcgcgagtgctccccagcacgtcgagcgacgctcgttcgtcgaggtcgacggccatctcgagccggcgccggctccccgattcgatggcgaagcggtcgagagtcgtccggggccctcgcgcgacgcggtcgccgcgctcgtcgcagcagggctcgagccggagcgggcgcgcgctgtcgtggggctcggcctcgtggtgtgagatgttctacctcggctatcgcgacgagcggccggtgttcgcggccccgaccagccacgtgctcgtgctcggcccgcctcgctccggcaagaccacgcggttggtcgtgccgaacgcccgtgccttccctggtgaggtggtcgtcacctcgaccaaggccgacgtcatcgaaccactcgtcgtctcgggccggaccgtgttgctctgggaccccgagggcgacgccgtcgaggcggccggcttgcggcgcgtcgcgtggagcctcgtggacgcggccaagcgctacgaagacgcggtactcggtgtcgacgcctacgtcgaggcggcactcggtcgcgcgagcggtgccgagcgccattggcacgaccgcgcccgtgcgctgctcgcacccctcgtgcgggcagcggcgaccctgggtgggaccatcgacgacgtggtcgcctgggtggaggcgcgcgacgtctccgaggcgctcggcgaactcgacctccagggggagcgtcgggcgctgagcggacttgcgagcgtgctcgcctcggaggagcgcgagcgctcggccatcttctcgacggcccacgccgcactcgctgcgtaccgactcggagaggcgcccgcgcccgagcgtttcgaccccgaacgcttcgtcgggtccggtgccgccctcgtgctggtcgccccgagtgcgagtcagcggatcctcgccccgatcgtcgtcgcgctcctcgagcagctacgacgggtgtactacgcgcgcgctcgtcgcggggaaccagggcgactcgggctcgtgctcgacgagctcgccaacgtggcacccatcccgtcgctcggctccatcctgtccgaaggggtctcgcaggggatctggctgctcgctgcggtgcaagatctcgcgcaggttcgcgagcgctggccggccctcgagcgcggactgctcacgctgttcggtaccgtggcggtgctcggcggtgtcggcgacgcggggaccctcgcggtgctgagcacgctcctcggcagcgaggacgtgctcgaggtcgcggtccacgagggcgccaggggtcgctcgaggacggttcggcgaacgcggcaagcgagactcgaaccggccgcgctccgcagcttgccccgtgggtcggcgctgatcgtggagttggcgggatcgagcgggatggtcgcgttgcgaggtgacccgccgctctgaggggctactcggccgggggcggatcgaggacctccgggaagtcgcgctaccatgccttcgtgccgttcttgctgcggatcctcggtcgggtccgcgcgtctcaggcgcggctgctcgccacgctggccgtcgcgagcgtgctcgctggggcggtagcgttctcgctcgccgagcacgtctcgctggggatcggcctctactgggcgatcacgacggcgacgacggtgggctatggggacgtcacgccccacaacaccgcggggcgcatcatcgccgtcgcggtgatgctcacggcgatcccgctcgcgggcggcgtgttcgccgtcgtcgcggcccagatcaccgcgagtcgcctgggtaggctgctcaccgtgaccattgcggagtcggatacgggattcgtcgcgctcgtcggttcgcaccgagccctcggccgtatcgccgaagagctggttcgagcgggcgagcgggttcgcatcgtcgcctcccagccgatcgcgggtctcgggatccgcgccgagcagatccaggccgatccgaccgacgagggatcgctccggcgtgtccacctcgagcgagcatcgcgcatcatcgtcgcaggcagcgacgacgccgagtcgctgctcgtcgcggtcctcgtccgcgagctcgcgccgacggtgccggtgctcgtcgcggcggcatcggccaaggtccgcgaggcgctcggtgggctcggcgtccaagcgagcatcgcggtcgatgagctgctcgcccacacgctggccaaaggggccgagacgccgcacgccgggaacctgctgctcgagctcgtggcgagcgagcgcgtgcggctcgtcgaactcccggtgaccgatgcgctggtggggatgaccctcgacgacgcgggcgatcgactgggggggctcgtcatcggtcgcgtacgcggcgatcgggtcgagctcgccgtcgggatcggctccgagtcgcttgccgctggcgatcgcgtcgtggtggtgagcgagcgtcagccctccgctccgagcgaacctggcgcgtagaagcgctgccagttcgccgtcgagggcgcgacgagaccggtggggccttcaccgaagaggcgcaagatgttgcgcgtcatggtggtgaggatcggagcgggacagccgctcgtgtccgccccacacggagcgagcgctgggatccagttgttcgtgccgctctcgaagacccccgccttcgaggtggggctcgtcacgtaggtcgtgtcggcgtagtaatgcgccccggagaagccgatcacgaccggtgagtgggcgaggatctcgacgcccggtgggttcggccgcgcagggatgtagccgtcgaagtcggtgaagagcacgttgggcaccgtggcaccgttcgtgaggccggtgcccgcatacagccacgacgatgcgtccgtcacgacgagcgggaaatgctgggtgttgttgaaaccgatgtaggagtccccgacgatctcggaggccggtgcgtccgccggggcttgtccccaccagttctgggtgacacgggcgttgtcgacgccatagagcgggtcctcctgcgggtcgcgatagttgacgacctcgaggttgggtccgagcgggctcgcggcgaggcggaccttgcggaggatggggctcgccccgaagaacaccaggttgacccctcgtccctcggcctggagcaccgcctcgcgcatgcgcagcgaccactcctcgtcgtggccgagcgagaggagaacgcgatggttggtgagcagggctccgtgggtggccagggtgatgtcggtccagtaggtcacgtcgaggccgtggcgctccatgagctcgatgagggggagttcgttggtgatgaaggtcgccgcgccgttgccgtagccgtagggccggtcgaacgagactacgcgtgagcgatcaggaggggggtagcccggcgcggtcgacgcgccctgctggtagaggtcgtagccaccgaaggggttgaagacctgccaggtgaagaccgcgttcatgaccacgtaggcggccttcgacgatggatcccagaccgtgagggggacgtagctcgcagctccgttggaggcgaccagcttgaggaggtagtcgccctgcacgaaggcgggggtgatcgcgaactgggtcgctcgttgccaggagcactgcaccatgtagaggggcgcactcacgggacaggcgggctcgacgtggccggcgaggaccccagagtgccacaccaggcgagcgccggtcccgtggtaccagcccatccggaacgcctcgacggtgaacgtgggcgcgttcgtcgacacgtacaggtcgaccatttggccgagacgggcttggggacggttggagtagccctcgatgaaggtgttggcgggttggaggccgatccgccacgccgtggtaccgggcttgtcgttctcctggatcacccagcgagcctcgacgccccaggggccgaggaaggtggccggctgcgcatgtcgtcggcgatgtggcgtggtcggcgtggtgtggggggccgtccgtggatgggcaacgagcgcgatcgcgccaccgacgagcgccgcgatgaccacgacgatcgtcgcgatgacgaacggattgcgccctgctgatcgcgggcgtcgatccgagcggctgtgcatcccaggcatgcaacctccccggggctcccctggggggccaaggctagccgagccaacctgtggggccctcggcgcctcaggtggcgggtatggccatgagtcgcttgaggacctcgggcccgagaccggtgacgatgatcgaggggtcgtcctcgacgtcgccgcgctcgagccggtagtgcacgaggaggcgttcgcgcccctcgacgagggcgatgctggtgccgacctcccgatagccgaccttctcgctcacgcgacggctcgcgaggttgtcggcgtgggcggtggtctcggcccgagcggcgccgaggtggcgaaaggcgagcgtgagcaccgcgcggcgcatccaggtgccgatgccgcgtccctgcgcagctgcggtgagccatgagcccgtcgagacggtggcaaggctcggccaccctcgggcgaggacgaggtcctggacgccgatcggcccctcggtcgggtggaaaacgacgaagggcagcgttgcgatcggcgtcgcctcgttcgcaccgacggtccggagccagtggcgaacgacacggctcgccacttcgtcagcgctgccccgggtccacgcggtcgagaagggcatggcgtcaggtgcgtggatgccctcaccggctcgctcggcgaggcgggcgagttcgtccatggtgggggatgcgagtgtgacgacgggggtgcggatcgccacgccgagctccggcgcgaagtgcaccaggggatggttcggatcgatgggcacgtcgccagcctagggtacggctaggttgaggctcgggaggaggcgacatgctcatcggagtcactgccggcctgatcggtgaggcaaagccgcgctacgtcggtctgcacgacggctatctccgtggcctcgcgcgagcaggcgcggccgcggtcgtgtggccgagcacgctcggggtcggcgatccggccgacgtggcggcacgggccaaggagctcgtccagagcgtcgcagggatcgtgctcaccggtggcggcgacgtcgggcccgagcgctatggcgagtctgcgcgcaccgagcggctctacggcgtcgagccggcgcgtgacgagctcgagatcgcgttggtccacgcggcgctcgatgcgggtgtcgcgctgctcgcggtgtgtcggggagtgcagatcctgaacgtggccctcggcggcacgctggtccaggacctcgaggaggcgggctatcgtcgccacagcgtgcccgagcacgagtacgacgtcgcccacgacgtgctcgtcgagccagacagcgtgctcgcgagcctggtcggaacgcactacggcgtcaactcgctccaccaccaagcggtggagcgtccggccgaaggggcccgcgtcgtcgctcgctccgaggacggggtcatcgaggcgctcgagggacgggggttcctcgcggtccagtggcatccggagcgcatgctcgacagcgatgagcgggctcaaggcttgttcgagtggctggtcgctcacgggagccggtcatgagtctgcgagccgtgatcttcgacgtcgacggtacgctcgccgagaccgaacgcgacgggcatcgagtcgcctacaaccaggcgttcgcgcagttcggtctcgacattcactggagcgtcgaggagtacgggcggtggctccaggtcgctggcggcaaggagcgggtcgaggcctacctcgccgagcatcccgacgccgctcccaacggggtcgatctcgatgcgctccacgaggccaagaacgccgcctacgccgcgatcgtcgccgctggcggcatctcgttgcggcctggagtgcgtcgactgctcgacgagctcgcgagcgcgaaggtcgccgtggcggcggcgtcgacgacgacgttccccagcctcgacgcgctgttacgagccgagctcgggccggactggcaggatcgtttcgccgcgctcgccctcggcgacgtggtggtgcgcaagaagcccgatccggggatctaccactgggcgctcggtgcgctcgggtcaagctacgacacggtcgtcgcgatcgaggacaaccgtaacggtttgctcgccgccaagggtgcgggccttgcggtggtggtgacccgatctctctatgcgaaggacgaggatctgcacgaggcggacgtgctcgccagctcgctcggagagccagcgtcccccgcaacgatcgttgtcgacggcgccccgcacgagggtgtcgtggacctcgcactgctggagcgactcgtcgagcgtgggtaggtgcgcagcgcgcgagcagcgcgcgtggctgctcgggtcgtgaggggccggctgcggatcgctggatgcctgggtgtctcacccaggcggtgtgcgtgccgactgcaagggtggcacgggctcgtgggccttgtcatgctggctgttctcgtggtcgggtggatgctccggcctcggcgcgtcgtggtcgacggcctctccatgcgcccggccctcgaacctggcgatcgtctcgtcgtggggcccgggcgcgctcgggtggggaggatcgtcgtcgtcgacttaggcggtggacggcccctcgccgtcaagcgcgttgcggctcgagtacgaggtgccgtgtgggtggtcggggacgatctcgctcactcgaccgattcgcggagcctcggatggatcgcacgaggacgcatccacggcgtggtctggtggcgctacgggccgagcgatcggcggggccgggtcgcgcctgcgccatccagcgactccacagctgggctaccaaccatccccagcacgattacctaaggtgaagatcaccaaccccccacacccatccaacgaggcccgcagctgcgggcctcgttggcgttgcgggccagcgtggatgcccgactcctacgcactccacaggttccgtgcctgccatccccagagcacgggcctaggttgaccattacaacccccccacacccacccgaggaggcccgcagctgcgggcctcctcggcgtctggcgacgatgtctcctggcgacgatgctgcgtgcgggtgtgactgttgtgaccagatcggactcttgacggctcgggcgagtagctgactcgcaggtggcgtccgagcggagagagcccctcgatcaccccgatcgtcgcctctcgaggaggttgtggacgagagcgccggcgagtccggcgccggcgaaggcgcccgcggctccgatgacgagcaggagtggcccggcgccggctccgagcccagcgatggcggcgctgacgcgagctgcgccaaggaccggtccgttggtggcgacgacggcgaggtccacgagccagccgatgagccccgcaagaccggcgagccacccgcccaccacgaggccgagggcagccccgacgacgatcgagagccaccacgcgccgacgaggttgccgagggcacagatgacgatgcccgcagcgaagatgacgatgcccgcagcgaaggggagggggcgacgcgtcatcgcaggcccaccaaggtccaggtcgcgatgggatgggtcaggctcgcggtggtgaagctgaggtagcgaccgttccaccacagcgggatcaggttctcgtaccacgcagacagggggttctcgctctcgccaccagggaggatgccgagcgacgctcgtccgaaggcgacgatcatcctccagctcggtccttgctccgacaagagcccgccgtcggcggcgttgacggtccaggcgtcgccggacgatccgcgtggcccgtaggcgagcgaggccacgcccgtcagcgaggggaactcgcggcggtggatgcgacgccactgccaatggccgacgctcccgaggtggctggtgagccaggtcgcggtctgggcgagggcggccgtggcgatcgcagagggtgaggggtgaggatcgccgggcgtcgcgatcgcggtgggtgtcatggtcccggtgtcgatcgcctggaggtcctcgagcagtggatcgttgagctggttgatgacaaggatgctgcccgtgggttggtcgagccgagcgctgcgccagagcggaccgaacaggtcacggatgtcatagccgagccaggtccaccagacgctcgccgcttgcgacgaggctcccatctggtcgttccaggaggcgaggaggtggagcgccgcggctgcactcgtgccaggcgcggcgtgggcgtggtgcacgatccacggtacgagctgggtggcgaggtagtccgtgaccgaggtttgcaggtgctcgaccgcacgcacaccgagatgcggggtagtcgagagtacatgggcgatctcgtcggctcgaaagccgttcgcgtagaagtcggcactcgtgccgaggtagtaggggtagccaggacccacggggcgctggttcgccgagaagacgaagcctcgtgccgggttgttggactccgggacggcatcgaaggggatggcaccgatgggctgttcggtgccgttgccgttcatcacgagccaggggatggcgcgacggaactggaggtattccccggctgcgatgatgccgatctgcccttgggcatcggcgaaggcgaagttctgcgcgggtgccttccatccgcgaagtgcctgttcgaactcgccgagcgtctgcgccttgatggccttgaggagggccgggaagtccagcgagacctggtcgccgagccagtccaccgcgacgggggtgccgcggagcgagatcactgggccatcgacggtgaccggcaccgtgatggtcaccggctggcctccgtggatggcgatggtgtagtgccggtaggtgtaggggcgccacgtgccgtcgaagcgataggcgccggggtgtgagggggaggtggtcatgcggtagaagtacgtcgcctgtgtctcggcgtcggtgaggctccacgcggtcgtcggggtgcgcccgatcaggacgatgggcaggcctggcgccgcgacccctgcgaagtggtagccaggtgcattggcactcagccagagccagatcgacgggagtgtctggggcaggtgcgggtcgccagcgaggatcggcgcgccggtcgtggtgtgcgtggctgcgatggcccagttgttcgagtcaccggcttggtggcgggcccacgcgggcacgccgctccaggcccgctcgatgctgccaagggccgatgtgagttggtgtgagacggggaccggcgggtcgagcggcgtgatgccgcttgccggatagggcccggtgtcgaaggggctctggggatcggcggcgagcgtggggaacaatgccttcacgcgagcgagcccgaggcgcgcgaccgcacgcgtgaggtcgacgggctgctgggtgtagtcgagctcttcggcgaggaactcttggacgagcatgctgtcgacgggctgccagggcgctggcgtcgtaccgaggaggaggtagggcgtcgacagggcatgatgggcgatctcccagctgcgtgcggcgttcacgccggccgtgaactcgtcgaggatcgcgcgatcggcgggaggcagcgccgcgaggttcgcctcggccgcggctcgcaccccgaggcgtagctggaactcgtccgatgcaaggtaggtgtgtccgagcagcgctgcgagcgtgccgcccgcctctcgtcgcagcaggtccatctcgaacaggcgtgtacgaccctcggcataccccatcgcgtaccagaggctcgcatcgctcgtggcactgaccccgatgaaacccgtcgacgtaaagccgatccgcgcggtgcccgggaccgccatctggaacgaggccgacgtgggcatccctgcccgtgtggcgagggcgagtacccctgtcgagggatcgagcacgctgccgagcgcgggaacgcccgcgaccccaaccgcctcgatgccgacgaccccagcgagcacgaccgctgccgcaacgacgcgtccgatccgcacgtgacctccccccgcgtgcgacagtagcagtcgaacgccaagggggctcgtcagctcacgagctcggtagcaggggtcccgacgccgcgttcgggtgtgcgcattcttgctggagggctcggacgaggtggtcctcgctcacccgtcccacctcgccgagggtcgcagcgagcggctgataaccgctgttcgcgccggccgcgatgttggcgaggggttcggcacgttcgaggagcacctcggcttgcgaggcgagcgcgctgcgcgtcgcacccgaggccgtgttcgcccgttgccagagggcgatggaggagcgcacgagtcggcacgccgctgtcgcgttcgatccggcgctcgcgccgcaggccgcaaggagcgctccaccggcgaccgcgaccgccgctaggcgcagtgccttggtgggtcccacgagcccagcctaccgagacctgctggcggtgctgggccccgggtaggctcggacccatggcgaccctgttcggtccttcatcggcggtgtgggtgctccatggtgatgctgccggcctgatcgggggtttgcgcgcactcgcggtccaagcgctcgagcctcgagcactcgcgggcgtcgatcagttctcgaggttccagaacgatcccgatcgccgactggccgagaccgtcgacttcgtcgacgtcatcacctacggcacgctcgaggaggtcgacgccgccatcgagagggtccgacggctccatgagggggtgcgcggcgtcgaccctgtctcggggatgcccttcgacgcgaacgaccccgagcttctcgccttcgtgcacgattcgctcgtcgcctcggtcagcgtggcgtatcgaaccttgcaccctggcgctccgacgtcactgctggatacctacaccaccgagatgcggcgcttcgccgagcgcatgggcgcggacctcggtctcgtgccagccgacttcgcggggtgcgtccgtctcgtcgagtcgtggccgaccctgaccgtgtcgcccgccttccgccgcgcgttcgaggtcctcgaggcgctgcacgtcgaggggcccgtgcagatggtgtggccagccgtgatgcactgggttcgccactcgctgcccacgtgggtgcgggtcgcgctcgaggtggaggaggatccggtcggtgatgcggtcgcgtgggtcctgctcgagctcgccacgcggatcgggcgggtgatcgtgccgccgtcgcctcggcgtctcgcggcgctcggggtcgcctaggtggacgacgccctcttcgcgacggacttcgacggcacgctcctcgactcgaccggcgagccggtccgacggagcgcggacgccttcgccgcggcccgacgcgggggcctcgccgtcgtcccggtcacggcgcgagggccgcggtcgtcgctcgcgatcgcgcggacgttgcacctcgggcctgtgtgcgtctgttcgaacggcgtgctggggctcgacgtgcgcacgggtgacgtcatctggcgccacggtctcccgccgggcagcgtcgccgagatcatctctgcggtggcgagggagatccccgaggctcggttcgccgtcgagacgcgggagcagttcctcgtggaaccggcgttcttcgagccgcagtggcgacggttcgcggtcgcgacggtcgtcgctcggcggggcctcgccgccgccgaggtcctcaaggtcgtcgtgcgcgcgccccaccggcgtggggacgagctgcagggtcaactgcgtggcgtccttggaggcctgtcgctgatcccgggctccagcgactggctcgacatcatcgcccatggggtgtcgaagggctcaggcatcggtctcggtgccgaggtcctcggcgtcgacctcgagcgggtgggtgctgtcggcgaccatctcaacgacgtcgcgatgttccatacggtgggccgcgcttacgcggtcgccgacggtcatccgcgcgccttggaagcggcggatgagatcgtgtccgcctgtggtgacggtggggccggcgaggcgctcaggcgcttcgttgacaccattgacctgccaatgtctcagcgccttccaaggcgcgaacggtagcgtgacgccgaacaggagggtgttcgggtgctgtcgcgcatgatcgatacgatgctcgccgatcgctcaccggctgaggagtacggcgcatcgcggcgagtgcgggccgtggcgcgcatcatgtcgctgctcggggtcgtcctcttcgtcggcctcgccatcgagggtgtcaccattctcttcatcggtcagctgatctccatccacatcctgatcggcatggtgctcatcccggtgatgggctacaagatcatcgtcgccacgtatcgttttgcgatgtactacctgggtgtgagcgatttcaagcgcgccggacctcccgagccgctgcttcgtgccatcgggccgttcgtggtgctctcgacgatcgtgctgatggggtcgggtgtggtgctcgcgctgctgcctcctcagtcggtcgaggtcgcgacgtggcgagcactacatcaagagtccttcatcgtgtggtttgcgttgatgaccatccacgtgctcgcctatgcgcgacgagccttcgggaccgcgaaggacgacgtaacggagcggcgctatcggtcgctcgtgggtcggcgagggcggctcgtgagcgtcgtcatcgcgctcgcgctcggcgtcgtgcttgccgtcgtgatgatccctgcgatcggcccgtggtcgcactacctcgcatcgttgggcgttcgctgagcggcgcctagcgtggagacgtgccagaagccgctggtggtgtcgaccaactcctgacgctcgcgagggaaaccgccgaggcctgtctcgcaagtgtcgaggcgacctcgaccgactggtcgtccacgggggatcgtcggggacagcatcgcggtgacgtcgttgcggaccaggcagcgctcgaactgctcgatcgcccctggctcaacgtcgtttcggaggagtcgggggtgctcgatcgaggagccgcgctgacggcgatcgtcgatcccatcgatggctcgaccaacgcgtcgcggggtctcttcccgtgggcgagttcggttgcgatcgcggacgacaagggccctctggtgggggtcgtgagcctgtgccgaggcggcgggacctactgggccgtgcgcggggcgggagctcgcagggatcggcggccggtcagctcgagtgccgcatcgagcgtgcgcggcaagctcgtcgcctgcaacgggacgccacgggcgtggctcgggtggggacagttgcgcgcgtttggctcggcagcctctgagctggccttcgtcgcagaaggcagtatcgacgctctggtggacttctcggaagggcttgcgatctgggacatcgcagctggcgtcctcatcgcgcgtgaggccggcgcggctgtcgtgagggcgaacggtaacgaggtggacctcagcccgacggcgccgcgacagcgaatcgtcgctggagcgtcgacttcgctcgcgaccgagcttgtcgccgcccttgctggggtcggcttggagcggcgatgacgctggcatgggtcgatcgggacgacgatctcgccctcgcgctcgacgcgatccgtcgttatcaggccgaacttggcgaggacctgtgcttccaagcacctgacgacacgatcgaagctctgcgtgggcattacggtcctcctggcggtgtggcgctgtggttcgacgggggacgggcggtcggcgtggtgtgcgtgcgcaagctcgacgagcatcgagccgagctgaagcggctgtgggtcgtgcccgagtatcggggtcgcggttggggccgagcgctcgtggaggcggcgctcgagcgcgcgcgggcagctggctttcgcgagatcgtcctcgattcgctcgatcgtttgcagcctgcactcgagctctatcgaagccttggattcgtctcggtcgagccgtacacgaccaatccgcttcccggagccgtcttcctcggccgtacgcttttcgagcgctagggtgaccaagccgagctcgtgcgaagacgttgcggctggctctctcctcgcaaccaggtcaacaggccgagatgttgggcggatccgaccggtgccgcgtggcggacaagggaccgacttcttgggcgaagcgtggagcgctccgcgcgcgaatcgagcgatgcgtcgtcgatcggcgtgagctcaggtcgcttcgtgagcgcagctggctctcggaggacgtcgaggaggaccgtcggagcgaggctgaggtggctgatgaggatgtcatccgcacgcgcgagctctgcttcgaggaccgtcagtgttcgtcgtgcgaggcgtgcgcagggcgccgttcgcgccaccggaactgatgccgtgtctccagctgggcttggcaggagggttcacgtgactggcgccccaatggggagctggcgatggacgctcattgtcggagcgtgtcgcgcactcggtcgaggcgatgcgcggcggtggagactggcggcacgacggacgcacctgccaacgattcctcgagtgcatccggggagcgtggcaccgacggtgtgccaatacgaatccatcatgaactgagcccttccatgtccacgatgttcgtgctcgcgagcggcgagtgcttacgacgaaggttcttcgagtagttgttgtacgtctcggctctgccattcgccgtaggtgatgcccagtccctcaactttccagctggtgcgtccattgtcagcgcggcccgctaccatcgatgatgctgccgaaggggaggaaaacacgcagttacgggtgaaggtacgagtcgtgccgtcggggctcagcgccagtgttccatcgtccacgagcctctggtgcagcggcttgtaggagctatcgtctgcgccttgccaatccttccgcgcggtcgagccagccaggaccgtgaactcgccgtcgatctcctgcgcggtcgcactgatacccgcgcgcttcagggtgtagtgcaacaatggcgatgccgggtagggcgcttcgatcgtcgcctgaccggcatgatcggctgccgccatgaccgaacggctcgcagttgatcggaggaggttgactccgaggaccggcagcacgatcatggcttgggctatgaagtactccatgtccgagacatcggcttcgggtagttggggcggtggcggcgcggtggcattgtccaaagctgctcgatgtgcctgttgagcgagcgtgatcagtcgtgactcgaggtagcgggcgtgagccttcgtgaggtttgtgtccttgctcgtcaggacgatgactcggtcccagaagtccttgccgccttggctctcggggcgagcatgttgggcgagccgcttgctgacgtcgtcgccctcgccgatgtaggcgacggtgcctccgagacgcttgggatcgtcccccagcaagatgtagatgccggttcgccccgtctcgggtcggcgaagaaggttcgccaggtccgagcggggtgcagcgacgacgtgccccgtccagttcatgatctcggcggtgagtaaccctcctggcgtcccgtcggccaagaagatgcgaatcgacttcccggcggtcacgtgagggcctcgtgtgctggttgtcgagtacgtcgtgcaagcagtgtctgggcgaacacgaccggtagcgtagcattcctcgcgctctgtgaggaggtggcgtgatcggctgagatggtgagcaatgacgccgtgtcggtgcgtgcgatacggccgctcgtggttcactgtggcatggccggcgaccggtgcggtgcgtgcggtgggtatcgcgcgtgcgcagcgtcgcagtgcatgaggggcccgacgacgacatcgcggcgtcgcccaggagtcagaagttctccgcgctcagcctcatcagcgctcgacgggaccagcgagcagtagcgtgaggaggtcgggtctcacgttgagggtgggctcggtttctttgtccggccagagcctgtcgagcaaacgaggcaagcccgtagggctgagatccgcgagaaggagctcaggtggacgaatcaatctttgtcattggatcagacggtaggctcacttcaatccagaagaatacctatgaacgtgaggctgaactccagcagcttatcaaggatcatccggaactcatacctgcgatgggtggtagcggagaaggcgaacccatccgctggctactggtgcgacgggaagcggggataccgcgagaggatggcggctcagattggtgggccatcgaccacatcctcgttgatcaattcgcaatcccaaccttcgtcgaggtgaagcgagcaagcgacacgagggttcgtcgtgaggttgtagctcagatgctcgactacgttgccaatgctaccgtttattggcagcccggcaccctcgaggggtggttcaatgctcagcatgacgatcccgagcagcggctcttggatttcttggacggatcggaactcagctccggcaagttctggtcgagagtcgacgacaacctccggtctggtcgagtaaggtgtgtcttcgtcgccgattctgttccagactcactgattcgtctcgtcgagttcttgaacgaacacctgcgacgtaccgaggtgtacgccgtcgagttgcctcagtatgtaagcaccgaccaactccctggagtgagggtcattgtcccaagggtgatcggcgataccgtccgtgcgagtgcgaacaagcgggagggacaatcggttccgaagcggcagtgggatgaggagagtttccttgccgccctccgagagcgtagcgatgcggccagcgtgacactctctcgtgagatcctcgaatgggcacgcgcccatggtgtccgagtgatctacggtaatggcaaggttgatgcttcaatgatgctcgtcgtcggacccaagccgaacgggtatgtctttgcgacggtctggagttatggctcgatcgagatcgatctccagtacatgaggcgttcgccagcgtttcgggaagacgagagtcgacgagaggtgatccgcagactgaatcacattccaggtgtcgcgatcgacgagttccgttactcccggcgtccgaatgttccgctaactgtgttcgctggggatccggcgcgaaacgagctcttcgatatcctctcttggatcgtggagcagctgagatctcctcttctgtagagacgcgccgtcgcgagctgtcaggtagtgaggcgagccacccttgtgtggtggtttgatggcaagtgttctgcagggcgggtcacgtcgggtccgttgcttgcggatcaaggcaagccggctgcctcgataggacggcggatggctcggactttcgctctggcgggcgctgccgtcggagatcccagaacgggccgacataggagcgaacccgtacgcaggtcgacgtggtgagggtccgaggaagaggacagagctctgtggtgggcgctaagggactcgaacccctgacctgctggttgtaagccagctgctctgaccacctgagctaagcgcccgagagacgtcagcgtagcgggcgttcgggttcggaggcggagtgccgggggcggtgtcccacccgagtgagcgccgtggcgatcacgctcgcgacgacgagggcgacgccgatgcccatcgatagcgaagccactgcgagtccgagcgccaccgagaccaccgccgcaaccaccggctccaaggtcccgatgatgttcgcctggagcgcgacgacgcggtcgagcgcggtgagatacagggcgaagggcagtgcggtcccagcgatcgcgacgaatgcgacctctgcccagccggtcccatcgagcgagcgaggccacgccatgatcaggaccggggccatggggatcgcgccgagcacgaacgcccgtgtcacgacgcgcggggccggctcggctctatacaggggcgctggcgcgaggttgtagagcgcggtgaccactgcggaagcaagcccccatgcgatggcggtgagaccgacgtgctcacccgggctgatgccgacgaccaagccgaccccgccgacggcggcgatcacgatcacgacctcgatcaggctgggtcgttgccaggcgcggagggttccccagagcaggatcaacacggggctcgtgaactgcagcagcgtcgcggtcacggccgagccggtcgcgaccgcgaggaagtaggtcgcttggacgccgagcaggccgaccagcgcgaacacgaggagccgacctcggagcgctcgggggccgaggctgaagctgtgccggatcgggtcgtgacggagggcctgccaggcgaccagcaacgctgccgagacgatgatcctgctcgcgaccagccacagcgcggtgacgtcggtcgtgtcgaacaggcgctgcgcgacgacaccggagatcccccacagcgtcgcggcagcgaccacgctggccagcgctcgacggtcttcggtcgtcacgaccccaaggctaggtcgtgggtatggacgcttgcctcgcgtgccgtacgatagggcgagccggacgaggaggaaggatgccccaaccgagcgcgtcgttctcggtgacggtgcgagtcgagctcgacgatcctcgagggatcgccgaggtgacccgcgttctcaccgagcgtggtgcggtgatcactgcgctcgacacgatcgagtcgcgcgcgggccacctcgtggtcgacgtgacctgcaacgcggtcgacgaggtccatgccgacgaactccacaaggcgctcgatgccctcgagggtacgagggtgcgcgcgatgagcgatcgcaccctcctgctccacctcggtggcgtcctccaagtggcctcgaaagtcccgcttcgcacgcgtgacgacctgtcgatggcctacaccccgggcgtggctcgagtctcggaggcgattcgcaacgatcctgctgccgcgcgcaacctcaccattcggcgtaacgccgtcgcggtcgtcacggacggatcggcggtcctcgggctcggcaacattggtccggcggctgcgttgccggtgatggaaggcaaggcgatcctgttcaagcgcttcgccgacgtcgacgcttggccgctctgtctcgcgacacaggatccggacgagatcgtgcgggccgtcgagatcatcgccccggtcttcggcggcatcaacctcgaggacatcgccgctccgcgatgcttcgagatcgagcgccggcttcgcgagcggctcgatatcccagtgttccacgacgaccagcacggtacggcgatcgtggtgctcgcggcactgctgaacgcgttgcgcgtcgtgggcaagcggctcgaggacgtgcggatcgtcatcgtcggactcggtgcggcgggggtggcgatcgcccgactgctgctggccgagggcgtgcgcgatctcatcgccgtcgacgtcgacggcatcgtgactccagacgatcccggcctcgatccggctcgacgtgagatcgccgaggcctcgaatcctcgcaacatccgtggtgacctccctgaggcgatggagggtgccgacgccgtgatcggagtctcacgacgcggcgtgctgaaggcggagcacctcgagcgcatggcgccgcgttcggtcgtgttcgccctcgccaaccctgaaccagaggtggatccagagatcgcgcgccgcttcgccgaggtcgtcgcgaccggtcggagcgacgagccgaaccagatcaacaatgtgctcgtgttccctggcttcttccgcggcctcctcgacgcgaacgcgcgcgagatcacgctcgccatggagcgagccgccgcgcacgcgctggcggccatcgtggcgcccgacgagctctcaccggcctacatcgtcccaacggtgttcaacccgagggtggcccccgccatcgcgaaggcggtggccggggcgatcacggacagctaaagcgttcgacgcccttcgatgccgcgaaggcgagccgtggcgtgccgttcgtgagtcgaaagcccagcgacaccatctcgctgggcggattgtcggaggcctggaggttcggatcagtgaggccgacgaccgtgaagccctggttcggggacgtaaaggtcgggttggagctctcgcatccgaccgtcgcgatgaccgggcctgcgatggtgtacggcgtactcgtggtcgtcccgggcggactcgggatcgcctcggcgtggcggaggccgctcagcaccgtctcgaagtagaagatggtgttcggcggatccttgacgagcggtgatggcggcaccgaggcgaggatcgcgacgagctggggcccggccgtacctggtttgaaggcgtacacgccgttcgggacgttgccgaccatgttggcacacgacgccgaaacgatggcgagtggtgtcgtgccggtcacgtagccgacgaccgttccctgctgcgtgggcgggccgctcaatgggtggcagtgcggggccaaccccgggtaggtgagcttcgaccacgctacgtctgcgaacgcagcctcggccgctcggtcggacggtgtgaggacgaccggggcctcgcgaggggcgcgaggggtgggacgtgcgctgatgccgacgctcgactggccacaggccgcgagcgccacactcgtgcctaggaggctgatcaccgctcggctcctgcgtcgattcatggtgcatgtcagcgtagtcaacgggtgctgagcgagcgcgaggctcccgggtgcgcgacccgaccatgggcctggctcggctaccgggcgaattggaggggagtgcctgcgacaggtgccgatcggcggtagcctgggcccagatggttgtgcctgcaccagagacacgagcgagaggctggagtccgagcgagccgcggtggcggatcgacgagttcctcgccgagaacgtgcagcttcgacccgcgacgaggcgacgctaccgcgtcgtcctttccaacatccaggctcgagcggcgtcgctcggggcggcatcgccggctcagctggacgctcacgtgttgcggcggctccttgccgctcctgggtcgaacgggccgtacgcgccggcgactcgcgatctcgagcgggtcgtgctgcggcgctacctcgtttgggagggaagtgaaggggcactcgctctcgcggcgcagctcgctgcgtttgccaggcggcgcccacggcccttgccgcgcggcatcgacgagacgacgctcggatcgaccctcgacggtctcgatgctcgggcggatgcgcgtgcgatggcgatcctcgagctggcctatgcgacggggttgcgggcgagcgaactgtgtgcgctcgatcggagcgacctcggtccgggcgaccggtggctggtcgtgcgggccggcaagggaggtcggacccgccgggttccgatcggcgaggctgcccggacggcgctccgggcctacctcgccacgcgcgacgacgatgccccggcactgttgctcggagcccgcggggctcgactctcgccgcgggggctacagcggttgacccggcgctatctcgatgtccacccgcaccagctgcgccatgccttcgccacgcacctgctcgatcacggcgccgatgtgcgatcgatccaggagctgctggggcatgcgcgactggcgactacggagatctacacccacgtgtcgcgcgagacgctgacgcgcgtctacgatgcgacgcaccctcgagcagggcgaggagaggcatgagcgacgacgaggtgatcgagtcggcgtggcgccgcttcaagcacgacggtgacctcgaggcgcgcaatcgcctgctcgagcactacgcgtccctcgttcgcttcgtcgcctcgcgcgtcgcggtcgggttaccggcgagcgtcgaccccaacgacctcgccagctacggcaccttcgggctgatcgacgcgctcgagaagttcgagccggagcggggcatcaagttcgagacctatgccatcacacggatcaagggcgccatcatcgacgagcttcgcgcgatcgactgggtgccgcggtcggtgcgggccaaggcgaagtcggtcgagcaggcctacgccgcgctcgaggcacggctgcatcggccccccaccgatgccgaggtcgccagcgagctcggcatgagcgaggacgaactgctggcgatctactccaagatctcgttcctcggactcgtcggtctcgacgaggtggtgatgtcgggcgagcgcggtgagggtatgacgctcggggacacgcttgccgatcgtcgtcaatcggccggtggcgcattcgaggagcaggagcgccgtcgcatgctcgccgattccatcaatcagctggccgatcgcgagaagaccgtcctcgtgctctactactacgaaggtttcaccctggcggagatcggccggatcctcggcgtgaccgagagtcggatctgtcagatccactccaaggccgttctggctctgcgaggcaagctcggcgacctgatcggctagggagccttgccgaggcgcctaagctgtggggccgcacgttcgtcgtcgatactcgggcactcgaacccacggtcggccacctgagccgcatggagtgcccgctgatccaaccgttgggaggttgaaccgtggctgagcgcccgttggtaacgatgtcgcagctgctcgaggccggtgtccacttcggtcaccaaactcgtcgctggaacccgaagatgcgtgagcacatctacgagcggcgtgggggcatccacctcatcgacctacgtcacaccctggagggcatcgatcgctcgttccgcttcgttcgcgatctcagtgctcgtggcggcaccatcttgttcgtcggtacgaagaagcaagcccaagacgccgtgagtcagtacgcgcgccttgctggggttccctacgtgagccaccgctggctcggcgggatgctgacgaacttcggcacgatctcgcggcgcgtcgcgaagatggcagagtacgagcgcatgcgtgaccagggcgacttcgaggcgatgccgaagaaggaggcgcttctcttgtcgcgcgagctcgccaagctggagctcaaccttggaggcattcgcaacctgacgcgcttgcccgatgcgatcttcgtgatcgatacgcccaaggagcacatcgcggtcaccgaggcgaatcggctcggaatcccggtggtggccgtggtggacaccaacgccgaccccgacctcgtgacctacccgatgcccgggaacgacgacgcgatccgcgcgtgcgagctgttcacccgcttgatggcgaccgccgtcatcgaaggccggcagcgtcagcaggccaagccggctgcctagagaccgcggccacgaacgaaggaggagaccaggtggtcagtgcgagcgatgtgcaggccctgcgccgtgcgacgggcgcaggcatgctcgatgccaagaaggcgctcgaggaggccgatggcgacgtcgagcgagcgacgcgcctgttgcgagaacgaggcctcgcctcggctgccaagcgcgtcgatcgagacaacgccgagggagcggttgcgctgtcgctgctcgaggaccgggcgggtgcgatcgtcgagcttcgctgcgagacggatttcgtcgccaaggcgcaggatttcgtcaacaccgccaacgagctggcggcgaccgtcgcgaccgatggggagcaggccgttgccaagttcgagagcatcatcgaagacttgcgcctgagcctcaaggagaacattgcgctcggtcgggtggtgcacttcgcggccggtgacggcgacgtcgtctcgggttatctccacgtccaggcagaccgcggcgtgaacgccgtgctcgttcagctgcacggcggcacggccgagctcgcccacgacatcgcactgcacatcgccttcgcccggccgcggtacctgtcgcgcgccgacgtcccagccgaggaggtcgagcgcgagcgtgagaccttcgaggtgcaggcgcgcaacagtggcaagcccgaggctgcgctcgccaagatcgtcgagggtcgcctcgacggcttcttcaaggagatctgcctgctcgaccaggccttcgtgaaggacgagaagcgcaagatccacgacgtgctcgcaggtgcgtcagtcgttcggtttgcgcaggtggagatcggtcgctgatcgtgggggcctcctggcgacgggtgctgctgaagatctccggcgagtcgctggccggcgaggatcgagctcaatcgatcgacccggcgatcttgcagcagctcgccgaggaactcgtcgagctgcgcacggtgcacggcgtcgaggtcgccgtcgtcgtcggcggcgggaacttgtggcgcgggaccgacggtacccagatcggcatcgatccgccgacgtcggacaacatgggcatgctcgccacggtgatgaacgcgcttgcgctgcagagcgcgatcgagcggctcggtcagccggtgcggctccagagcgccatcacgatggccgagctcgcagagccctacattcgccgtcgggcggtgcggcacctcgagaaggggcgcatcgtcgtgttcgccgccggcaccggcaatccgttcttcaccactgacaccgcagccgcgctgcgggccgccgagatcggcgcgagcgtcgtgctgaagggcacgcactcgggtgtgagcgggatttattcgtccgatccccgggtcgacccgtcggcggtgcagctggagcgggtcggctacatggaggtcatcgagcgcaacctcgccgtgatggacatgaccgctatcaccttgtgcaaggagcgggccatcaaggtcgtcgtcttcgacgtctcgttgcggggtaacatcacgaaggcctggcgtggccagatcggaacgttggtggagtaatggctgatccagtcgatatcgatgcggagcttgcggccttcgaggatcgcatggccaaggcagtgcgccacaccgaggaggagttcgcgaccgtccgtacgggtcgggcgcaggcggccctgctcgatgggatcgtcgtcgagtactacggcgagcgcgttccgttgcggcagttggcgtcggtgacgacgcccgatccccacagcctgctcatcgcgccctatgaccgcaacgcgatgggcgccatggagcgagccattcgcgattcagacctcggcgtcaacccgacgaacgatggctcggtgatccgtatcgcgatcgcgccgctcacggaggagcgtcgtcgagagctcgtcaaggtggtgcgcaagcgcgccgaggaggggcgggtggcgatccgaggcgtgcgccggcaggccaagcagcacttcgagtcgctccagcgccaaggctcgctcacgacggacgacctcgccgacatcgagcgcagtctcgatcgcctgacggcccgctttgtgggcgagctggatcgagcgctcgaggtcaaggagcacgacctcctcgaggtctaggccggccggtgagcgaacacgacgaccgggccccgcagtcggagcctacgagcgagcctcgaggcctgtcgcccgagcccgaacgacagcgagagcgcggggcccacgcagggcctgagaacggtacgcctcgcgagggcgcgagttcgacggatgcgggcgtgacagaacccctcgcatccgcggtgccacctggccccgttcggtcgtcgggccgtgacgaggggagcgacgacgacaccgtggccctccccgattggcgagagccaccgaccggtgacgttcctcgggtcctcgaagaactctcgggcatcccggtgcgcgatctcggaggacctcgtaccggtgagttgccctcgatcgacgacgaaacagttccgtggtcgccaccgtcctcgacccaaggtgagcgatccaagctcgacgacgacgcgcgtccacgccgagaaccgtccgaggctgcgactccccgagcgcctcgccatcatcggcgcaggcgcgatggcggcgagggcgaggccacgactcaggacgcgggcgtcgagcggcgcacggcggccggctcgcgtcgtcgagggggcgttcgcggcgcgacgcccggcgacgagcgatcccacggcggccccgcccggtccaaggcgctcagcaccctcaccggcattgcgctcgctgcgatcgtggtcgtagccctcgtcctggggcggatcccgttgctcgtcgtcgtcgcgctcgcgctcgagctggctgcttcggaggccttcagcgtgctgcaccgcggcgggctcctcgaggcgcgcttcctcgggctcgccggggtcggggcactcatcggagtcgcttacgcctacggtccggccggtgatggcggcgtcgtcgttgcagctttcgtcctgggcgcagcgtggtatgtcctcggaccactgcggcgtcctgcctacgaggggctctcgcacacgctgggcgtggttgtgtgggtcgggctccttggctcctatgcagcggtcctgctccgaccggcgacgttccacgggcacggcgagctcgtcctcgtcgtcgccatcgcgacgacggtggccgacgacaccgcggctttcttcgtcggatcggtgctcggtcgccatcggctggcgccgcggatctcgcccaacaagacgatcgaagggcttatcggcggtacggtcgcagccatcgtggccggcgcgctgctcgggatgatcgccccgctcagcgtcgtggaaggagcgatactcggactggtcgtcgcggtggtggctccgctcggcgatctgctcgagagtgccttcaagcgccagtttcatgtcaaggactcgggggcgctgctgcctggccacggaggggttctcgatcgcatcgacgcgatgctcgtcgtgctcccagccagctactacctcttcgcggtgatgcatctcaggtagcctgcctaggctgactgtcgtgccgagcgtcgccatcgccggggtcaccggttccgtcggccgccaagccggtgcggtcgtctctcgcgacccggaacgttttcatgtcgagaccatcgtcgctgggagcgatgcgggcgggctcatcgagctcgccaaggagctacgccctcgggtcgtcggtctcgcggtcggtggtgaccgcgagcgagtgcgccagagcctcgatgcgtccgtggaggtggtcgtcggtcgcgaagcgctcgaggcgagcgcagcggccgacatcgtcgtgaacgccgtgagcggcttcgcgggtctcgccgtgactcgagctgcgctgctcgctggacgcaggctcgcgctggcgaacaaggagtcgctggttgcagcgggggaccttgtggccggatggctcgacggtggcgacggcgaactcgtgccggtggactccgagcactctgccatcttccagtgcctcggaggctcgcgcgatggcgcagaccgtgtcgcgtcgctggtgctcacgagctctggcggacccttccgtacgcgatcggcggaggcgctgcgtgacgtgagcctggaggaggcgctcgcccacccgacgtggtcgatggggccgaagatcaccgtggactcgtcgaccctgttcaacaagggcctcgaggtcatcgaggcacactacctcttcgaggttccctacgaccgaatcgaggtggtggtgcatcccgagagtgtcgtgcactcgatggtgcgctttcgggacgggtcggtgatcgcgcagctgtcggagccgaccatggagttgcccgtggcggtggcgctctatcaccccgagcgcgcgccgtacgcgatcggctcgctcgatctcacccgacctcggtcgttcggcttcgagcccgtcgacgacgctcggttccccgcgttgcgcctcgcctatgacgccggtcgactcggaggggccgcaccgtgttggttgaacgcagcgaacgaggtcgcggtggccgcgtttctcggaggtgcgctgcgctggatcgacatctatcgcgtggtcgcctcgacgctggagcggttcgagccgacgacgttcgcatccgaggaggacgtcatcgaggccgatgcgaccgcgcgtgaccacgctcgacgcatcgtggaggaggtaactcgtggctgaggagatggaggcgccaaccctccaggaggctcgaagcttctccggtcgcaggctcgccgagctcgtcgtcgtgctcgtcgccatcatcgcgatcgcccagcacgcccatgcactcggcaccctcgccgtcgtggcggcgatcgtcgcgatggtcgtgctgcacgaacttgggcactacctggtcgcgcggtggtcgcgcatggaggtgaccgagttcttcgtcgggttcgggccgcggatcttctcgtggcaccgcaaggggatcgagtacggcctgaaggcgatcctcgtcggtggctacgtccgcatcaccggcatgacgagcgcggaagaggtcccgcccgagcgtgaggcgcgcacctatcgctcgtcgaccttcccccgacgagtcgcggtcagcgtggcgggctcggtcatgcacttcgtcgtggcatttggcatgctgtggtacctgttcagtggggtcgggacctacgcgagtcggggcgtggtcatcgagggggtcgcacacatcccaggggtggtgaccccggccgagcggatcggactgcgtgctggcgatacgatcctcgccgtcgacgggcatcggaaccctacccttgctgccttcgcgtcgtcgatctctcaccatcccggcacccctgtgcgcctcgttgtcgagacgcccggcggtcgagtcgtctcgcgcacggcggtgccgatccccgcgaccatggtggcgagatacgatgcggcctatcactccctgggttcccaaggcgtgctcggcgtggtggttgcgcctccagtcgaacgatccagtctcgtcggtggggtcgtgccgtcggcgcgcgcgctctggtcgctcgctggtgcgagcgtgagtgggctcgtgtcgcacttcacgccccatgggatcgcgacctacgtgtcggaggtgacgcacccctcggcgaaccccacctcggcaaagtccgcgtctcgcttcgagtcccccgtggggatcgtgcagctcgcgtccgacgcggtcgcggccggaaccggcgccgtgctcgagctcctcgtgctgatcaacgtcttcgtcgggatcttcaacatggtgccgttgctgccgctcgacggcggacacgtcgccatcgcgatctacgaacgcatccgatcgcggcgaggtcgtgcgtaccacgccgatgtcctcaagctgatgccgatcacctacgctgtgatagcggtgatcctctttctgggtgtcaccgcgctgtatctggacatcacgcatccggtgcccaacccgttctcgtagcgaggaggagagcaatggcgcgtcctcagatcgccctcgccccacgacggcccacccgccaggtcatggttgggtcggtacctgtcggcggaggggcgcccatctcggtgcagtcgatgacgaccacccagaccgccgacgtcgagggcaccctgacgcagatctacgccctcgccgctgctggcgcagacatcgttcgggtgacgtgcaacacccgtgacgcagccgatgggctcgcgcgcatcgtgccccgctcgcccgtgccgatcgtcgcggacatccacttccacgtggagatggccctcgcggcactcgatgcaggggtggccgccctcaggctcaaccccggcaacctgcgcaagcgcgaggagatccagctggtggcgcgcgaggcgaaggatcgcgccatcccgatccgcatcggcgtcaacgccggttcgttgcacccggagtttgcggagcgcttcgggggcgcaactccggaggcactcgtggagagcgcgctctacgagctcgcgctcttcgaggaggtcggtttcgacgacgtcgcgttctcggtgaaggcctccaacgtgccgctgatgatcgcggcctatcggctgctcgccgagcgtaccgatcatcccttgcaccttggcgtgaccgaggccgggccgccgccggcggggctcgtgaaggccaccgccggcatcgcgacgctgctcgccgagggcatcggtgacacgattcgctactcgctcaccgctgaccccgtcgaggaggcgcgggcaggacggcagttgctcgaggcactcggcctgcgagaacgcaagaacctcgacctcatcgcgtgtccgagctgcgggcgcgcccaggtggacgtgatcgggatcgccaaggacgcccaggcacggctcgaggagctcggcctgccgatccaggtggccgtcatgggttgcgtggtgaatggtccgggagaagccagggaggcggatctcggtattgcgggcggtcggcacaagggacatctgttcatccgtgggcagatcgtgcgggtggtccccgagcaggagatggttgacgcgctcgtcgaggaagccaagcgactcgttgccgagggcgtcgaggcacggctcgcggccgcagctcccggagcggccgaggaggcagcccgcgatcgcatggccgaactcggtggcgaggagggctcggccaagcgctagccttgggcgccatgcgcgcctccgacctcgtcttcgccacccaacgggaggacccacgcgacgccgaggtcgcctcgcaccgtctgctcgtacgcggtggctacatgcgggcgctggcgagtggggtctggagcctgttgcccctcggctttcgggtcctcgagcgcatcggcgcgatcgtggccgaggagttcgaccgcgcgggcggcaaccagctgctccttccggcgctgcacccggtggagctctggcaggagaccggtcgcaacgtcaccatggacgacgtgctcatgcgggtggattcgaagctcggctccttggtgctcggtccgacgcacgaggaggcggtcatcgccgccgtcgggccggacctcgcgagctaccggagcctgccagccttcgtctaccagatccagaccaagttccgtgacgagccgagagcgcggttcggcttgatgcgcacccgtgagttcgtcatggccgacggctacacgttcgatgtggaccgcgagcacatgcgtgtctcctaccagcgcgtctacgaggcttacctgcgcgtgtatcgccgactgggcttgaaggccgtgccggtcgaggcggacgcgggcgcgatcggcggggacgtgaaccacgagttcatggtgccctcggccatcggggaggatcacttcgcgtcctgtcgtgcgtgcgggtaccaggccaacgtggaggcggctcggcgtggccgggggcccgatcgagtgctgccccccatcgagcagccgagggtgtatgcgacgccgggggctccaggggtgcgcgaggcgatcgcggcactgcgcgccgagggggcacccgtcgacgatgacgggatgctcaagtgcatggtcgcctacgacgacgcgggccggacgacgctcgtgctcgtgcccgggcagcgcagcgtgaggctgccacggggttggcggcttgccggtgaggaagcgttccggcccgaaggtccgttcttcctcggctacgtggggccggtcgggatgcgagaagccggcgtgcggatcgtcgccgacccgatgatccgagagcgtccgtggtgggcgaccggtaacaacgccgagggcgagcacgtcgtcggtgtgcgcgtcggcgtggacttcgaggtcgacgactggatcgaggtggtcgaggtcgtcgacggggatccctgcccgcgctgtggcgctcccctggcgctggttcgcgcggtcgaggtggggcacaccttccaactcgggcagctctattcgtcgcgcatgagccgggggaccttcgtcggcgaggacggggcgacccatccgttctggatgggctgctacggcatcggcgtgagtcgtctcatcgccgtcatcgccgaggagtaccagcgagacggtggcctggcgtggccgctcgagatcgccccgttccaggtcgccgtcgtgcctgccggcagcagtgacgacgtcgcggcgaccgctgcgaacatcgccgaagagctcgaacggatggggcgccgggtgctgctcgaggatcgggggctgagcttcggcgtggcggccagggatcaagaactcgtcggtgcgcccctgtgggtggtcgtcggtgcgcgttcgctggcgcgtggcgaggtcgagcttcgcaaccgcgtcgatgggcggacgctcaccgttcagcttcgcgatgtggcccaggcggtcgacgccgaggccggtcgcatcggcgagcgcgccgactgagcgctatactccctccgggctcgttgcaggggccggggtgacgtgggcttcggcccacgttttttcgtcacctgcgcggctcgctcggcgaggggaggggacatggcggacagccacgcactatggacggcgctcgacgagcgactcgccggtgcggcgctccaggtcgccgacctcgtggtgcggccaggttccgtcgcggtcttcgtcgaacacgacgatgcgagcgcgccgagcctggacgaactcgagcaggtgtcacgggacgtggtcaccgtcgttcgctccgagcttggagacgtggcggtcgaggtgtcgagcccgggcctggaacggcgactgcgcaggatcgagcaggcgcgtgccgtgctcggccgaagcgtcgcgatccgacgcgagggcggtcggctcgggggtgtgctcgtgggggtcgagggcgacgagctgatcgtcgaggtcgacggcgagccgcagcgcatcgcgtggggcgaggtgcgcgaggcccagacgacgtggtcgttggggaccgatggtgcagacgagctggatccggagcgcagcgggaggaacgatggccgttgagaacccagaggtgatggacgcgctcgaggtgatcgctcgggagaagggcctgtcggtcgagacgctcctcgagtcgctcgccaacgcgctcgctgccgcctacaagcggcggcccggcgctgccgaggaggcctacgtcgagatcgatcccgcgagcgggacgatccgggtgatctgccaggagctcgacgagaacggtaccgtcgttcgcgagtgggaggacacgcctcgcgacttcgggcgcatcgcggcccaggctgccaagcaggtcatgctgcagaagatccgcgaggccgaacgcgagcagaagtacgaggagtacgccgggcgcgagggggacgtggtcacggggatcgtgtcccagatcgacccgcggttcacgctgctcgacctcggcaagatcgaggcgatcatgccgcactccgagagcccgtcgaacgagcgctactcggtgaaccagcgtttgaaggcctacatcgtcgaggtgcgacggtccatcaagggtccacagatcgtcgtgtcgagaacgcaccccggcttggtccggcgcctcttcgaggtggaggtgcccgagatcgcgagtggtgtcgtcgaggtcaaggccatcgcgcgcgagcctggtcatcggaccaagatcgcggtgtggtcgaacgatcgctcggtcgatccggtcggagcctgtgtcggtgctcggggatcacgcgtccacaccgtggtgaacgagctcttgggggagaaggtcgacatcgtcccgttctccgaggatctcgcggagttcgtcgagcgggcgatcgtaccagcgcacgccctctctgcgaccgtcgagggtcgcgatgcgctcgtggtcgtgcctgacgatcagctgtcgctcgccatcggccgcgagggccagaacgcgcgccttgccgctcgtctcaccggcacccacctcgagattcggccccagagcgaggtcgagggccgccaggagggtcagccatagcgcccccgcaacggatgtgcgtgggttgtcgggcccggcgttctgcgtcggacctcgtgcgggtgcacgtggtggaggggcgcctcgcggtcggggcggggcctgggcgcggtgcgtggatctgtccgcgggaggcgtgcctcgagcgcgcgctcgcgcatggacggctccgacgagcgctgcgactcgccccgtcggacggcgagctcgtcgacgagggcgtgcgccaggcctggcgagcggcgatcgctgggcacggcgcgtcgagcgcctaggctcgaagtgactcacgtagtgctgtcggcgctcgtgggcagacaggtgcgcgggcgtgggtccgcatcggttcggaggcaagggcaaccagttggcgcgcaagctcagagtgtacgaaatcgcgaaggaactcggtctctccaacaaggaggcgctggatctgtgcctcgcgttgggcgtggacgtgaagaaccactcctcgagcgtcgaggaggcccatgcagaccggatccgacgtcgcgcgcagcgagatcatctcggcatctacgccgaggcaacgaccccccaggtggccccgccgagcgcgccgaccacgccaccgagcgttcgtgagcccgagccggtggcggctcccgagatatcggagccggtcgtggcgagcgcacccgagcggcgccccgacctcgccgcggtgatcgccgaagaggcggccaagcgcgaagaggccgagcaggctgccatcgagaacgcgggtcgagcgccggagcaggcggcgccgcgacgtcagggcccgctctcgccatcggggaatccgatcccaccacccccgggcgggcgaccgctgtcgccgtcgggtaagccgatccctccgccaccacgtccacaaggtccacgcgacggacgcggccgaccggctcgcgaggggtccgggcgccctgtgggcgggtcgcgtccgggtgccgggcgccccggaaccggtggcgggcgccccccgatggggggtgggatccggccgccggcccgcggtggcggcggcgtcagcacgccccgattcgggggcgcagccggtgcgttcgctggccgtcccggtggcggtcggggccgtggcgtgcgtccgaacaagagtcggcggcgcatctcgcgcaaggagttcgaggagctcgagccgacccgagcgacggcctatgtcccgtcgaacgatccggtccctgactacgaggtcatcatcgagcggggctcgacggcccaagaggttgcccccaagctcaaccgctcgccgggcgacctcgtgcgcttcttgctcatgcagggcgagatggtcacggcgacccagagcctcaccgacgagatgatcgagctgtacgcggcggagctgggcgcgaaggtgcgcctcgtcgatcccgggcaagagcaagaagcgcagctcgccgccaagtatctcgatgtcgatgagaccctcgatccgacggccgaggtggtccgccctcccgtcgtcacggtcatggggcacgtcgaccacggcaagacgttgctgctcgatcgcattcgccacacgaacgtcgtggcgggcgaggccggtggcatcacccagcacatcggtgcctaccaggtcgatgtcgaggggggtcgcatcaccttcatcgacacccctggtcacgaggccttcacggcgatgcgtgcgcgtggcgcgagcgtcacggacatcgtcatcttggtcgtcgcggccgacgacggtgtcatgccccagaccgtggaggccatcaaccacgccaaggcggcgggcgtgccgatcatcgtcgcgatcaacaagatcgaccgtcctgacgcggatccgaatcgggtcatgcagcagctctccgagcacggcctcgtgcccgaggcctggggtggcgacaccatcacggtgcaggtgtcggcgctgcagagtctcgggatcgacgagctgctcgagcaggtgctcgtgctggccgaggtcctcgagctgcgtgccaacccgacgggtcgggctcgcggtgtggtgctcgagggacacctcgacgtcggtcgtggtccggtcgcaaccgtgttggtgcagggcggcaccctgcacgtcggtgatcccgtggtcgccggccaggcatggggcaaggccaaggcgctcatcagcgatcggggagagaaggtctccgatgccggcccgtcgacgccggtccaggtcctcgggttctcggaggtgccgagcgcgggtgatccgttccgcgtgacggccgagatctcgcacgccagggagatcggcgaagcgcgcgagcagcggctgcggttggcggcgaacgccaaccgggcggtcggcgcacagggcgtgcggctcgaggacatcttcgaacagatccaacaaggcgaggtccctaccctcaacctcatcgtcaaggccgacgtccagggcagcctcgaggcgctctcggatgcgctcgcgaagctctcgcgcgacgaggtgcgactcgagatcatccacaaggccgtcggtgggatcaccgagaacgacgtcacgctcgcggcggcgtcgcacgcactcatcatcgggttcaacgtccggccggatcgccgagcgcgtgaggccgccgaggtccgtcacgtggagatccgtacctacgagatcatctaccaggtgatcgaggacatcgaggcggccgtggtcggcatgctcaagccggagttcgaggaggtggtcgtcggcgaggccgaggttcgcgaggtcttccggatcccgcgcgtcggtgccgtcgcagggtgctacgtgcgcaacggaaccttgacccgtggtggccgcgtgcgattcctccgagacggggtcgtgctgtggaaggggacgatctcctcgctgcgccgcttcaaggaggacgtgcgcgaggtccaggccgggttcgagtgcggcgttgggctctccgatttccaggacctccatgcaggcgacatcatcgaggcgttcgagctgcgtgaaatcccgcgggggtgagcgtgggcagacgcgcaacccatccgtacgcgcggaccgaacgggtcgccgccgtcctccaagaggtgatcgctgaggcgctggagcgcctcgtcgatcgcgacgagcggctcgccttcgtcacggtgacccacgtcgtcgtgagcagcgatctgcgccacgccgacgtgctgatcgcgtcgggaacggcggagacgctcgaggcgctggacgacgctcgcggagagctccagcgtgcggtggcacgggaggtgcgcctcaagcgcacgcccgccctgcgcttcggccttgacgcgcaacttgccgccgtcgaggagctcgaggcggtgttccgccgcgtccacgaggcagcgacggatgatccagggcatctacctcgtcgataagccgagcggcccgacctcccacgacgtcgtggctcgagctcggcgtgcgttcggcacgcggcgcgtcggtcacgccgggacgctcgatccgatggcgagcggactgctcgtgctcggtgtcgatcgcgcgacccggctgctccgctacctcgaggcccagacgaagcgctatcgggccgtcgcgctcctcggcgttgcgaccgataccgacgatctcgacggtgtcgtcgtcgatcggcgaccggtcgaggagccgacccgcgaggccgtggtgacggcgtgccgtcgcttcgtgccgggttacgaccaggtgccaccggcctacagcgcgctgcacctcgacggcgagcgtgcctacgtgcgggctcgccggggtgaggacgtcacgttgcctcgtcggcgggttcgcatcgacgagatcgaggtgggtgcgatctggcgcgatggcggcccaggggagccccagggcgttcgcgtcgagctcaccgtcacctgtggccccggaacctacctccgctcgctggtacgtgacctcggtgaggcgctcggcacgcccgcgacgctcgcgtcgcttcggcgcgagcgtgtcggtcggctggaggtcgcccaggcggtggggctcgaggacctcgagcgagcgacaccggtcccgcttccgctggcgctcgctggtctcggccgtgtcgaactcgacggggtcgacgccacgaggttcctccatggtcagcgcatcgaggcgccgtcgggtctcgacgagggcgacgtgctcgtcggtgccgagggttcgtggttgggggtggcgagctgtgacggccacgtgctcgcaccgcgcgtggtgctcgtcgatgcgggagttgcgcgggcatgatcgtggttcgagagctcgatgaccctgccttcgtcgtccccagttccgtcgtgaccatcgggaccttcgatggtctgcacctcggacaccagcgactcatccgcgtcgcacgcgacgtcgcgcgtcgagcacgcctgcccttggtcgtggtgagtttcgatcgccaccccctgcgcttgctcgcacccgagcgagtgccgccgctcatcatgacgccactgcagcgcgatcgtgtgctcgcgtctcagggcgtcggcgtgctgtatctgctgcacttcggacccgaacgcgctcagcaggcgcccgcgtccttcgccgccgaggtgctcgcgtccaggctcggtgcgacccacgtcgtcgtcggcgccaacttcaccttcggtgcccgaggggcgggtcgccctgccgacctcgtcgccatgggtcgcgacctcggcttctcggtcgacgtcgaggagttggtcgacgacgacggcgaggtggtgtcctcgagtcggatccgtgcgacggtcgcctcgggggacctcgtcgaggcctcgcgcctgctgggccgtgcttacgcggtcgaaggtgtcgtcgtcgcgggggatggccgcggtcgagaactcggcttcccgacggccaacgtcgtcgtctcttcgtcctatgcgagtccgcccgatggcgtctatgccggatgggcgtggaacgactcgggtcgctgggctgctgcgatctcgctcgggacgaggccgacgttctacccgaccgacggcctccggctcctcgaggtccacctgctggacgccgacgtcgacctctatggtcagtcgttggaggtggcgttcgactcccggctccgagggcaagtcgccttcgcgggtgtggaggagctgatcgcgcagatgcacgccgacgtcgccgaggtccgtgtgcgcgtgggagacctcgagggcaggtaggctactgcctggctgtagcatcatcacgtacgcctggagcgtccaggcacgacacacgaagggacagtgaccaacccatgggttccaaggcggagacgatcgcgaagttcgggcgcagcgagcacgacaccggttcaccggaggttcaagtcgcgctgctgaccgagcgcatcgcccacctgaccgagcatctgaaggttcacaagggtgatcaccacacccgtcgcggcctcatgatgatgatcggtcgccgccgccgactgctcaactacctgcgttcgcaggacgtcgagcggtatcggaccctgatcgcggaactcggcatccgccgctaggcgccgcacgagcgacgaggcgactgcagccggtccctgtctctcccacaaggagcatccatgtcattcatctcggttgagcgtcagctgaccggggtaccctcgccgttgcgcttcgagacgggcaagcttgccctccaggccaacggagctgtggtcgcgcgcctcggcggcaccaccgtgctcgtgaccgccactggggccaagcacgtgcgcgagggtatcgacttctttccgttgaccgtcgacgtcgaagagcgcatgtacgccgcgggcaagatccccggttcgttcttccgccgcgagggtcgtgccacggaccaggcgatcctgacggcacgcctcatcgaccgtccactgcgaccatcgttcgccgatggctttcgcaacgaggtgcacgtggtggcgaccgtgctcggtgccgacctcgtcaatccacacgacgtgctcgccatcaacgcggcctcggccgcgctcatggtgtcggggctgcccttcgaggggccgatcggcgcggtgcgcgtcgcgctcgcagccgatgggagctggattccgttcccgacgttccagcagggcgatgcctcgagcttcgagctcgtcgtcgccgggcgcaagacctcggacggtaccgacatcgcgatcatgatggtcgaggcgggtggcaccgaggcgacctggggcgcattcgaggcgaacgccgccatcccgaccgaagcgacggtcgcggaggggctcgtcgctgcgaagcagtggatccgcgagagcatcgagctgcaagaggagctggtcgccaagctcgatcatcggccgacctttgcgtggacgccgatgcgcgactacgaagaggacgtgctcgtccgcgtgaacgaggtcggtcgcgagcgactggccgcggccaacgcgcacaccgacaaggtgacgcgccaagatgccctcgacgccgctggcgatgccatctgggctgaactcgccgacgagttccccgagcgcgagcgagaggtgcgggctgcgatccgtcgggtcaccaaggagatcgtgcgcgagcgcatcacgcgcgagggcgtgcggatcgacggacgcgacacgacgaccatccgtccgctcctcatcgaagtgggactcatcccgacggcgcatggttcgggcctcttccagcggggcgagacccaagtgctcaacatctgcacgctcggcatgccgcgcatgaaccagcaactcgacaccctcggggtcgacgaggaaaagcgctacatgcaccactacaacatgccgccgtttgcgaccggcgagacgggcttcatgcgaggacccaagcgtcgcgagatcggtcatggcctgctcgccgagcgcgcgctcgtgccggtgctgccgccggagtccgagttcccgtatgcccttcgcctcgtgtcggaggtgctgagttccaacggttcgacctccatggcgtccgtgtgcggctcgacgttgtcgctgatggacgcgggcgtgccgatccgggcggccgtggggggcatcgcgatgggcctcatcgcccacgacggtgtctacacgaccctgacggacattctgggtgccgaggatgccttcggtgacatggacttcaaggtggcaggtacccgggagttcgtgaccgcactgcagctcgacaccaagatcgacgggatcccctcggaggtgctcgcggccgccctcgagcaggcgcgccaggcccgcgtgtcgatcctcgatcagatgctcgccgtcatcccggcgccgcgttcggaggtggccgagaccgctccgcggctcatcaccttccaggtgccgctcgacaaggtcggtgagatcatcggcccgaagggcaagaccatcaacacgctgcagcaagagacgggtgccgacgtctcgatcgacgacgacggcgtggtcggaaccgtggtcatcggtgcgcgtgacatcgaggcagcgcgcgaggcggagcggcggatccagctgatcctcaacccgccgcaggccaccctcggcgaggtctacgagggcaaggtcgtcggcatgaccaagttcggcgccttcgtcaacgtcctccccggcaaggatggcctcgtgcacatctcgaagctcggacgcggcaagcgcgtcgagcgcgtcgaagacgtcctcgagatgggccaggtgctcaaggtgcgcgtcgacgacatcgatccgtcgggcaagctctcgctctcgatcgtcgacgacgagaacggtgagactccagcccacgctggcgcgtcccatgccggctcgtcgcacgccggcgcgtcgcggacctcggggcgtgagggctccgatcgtcgccatcggcgtgacgagcgccccggcaacgaccgtcgtggatcgtcgtcggctccggccaacgccgtgtcgttcgaggaccgcttcgagtcggagatccagcgcgaactcggcgacctccagtaggtgagccccttcggggcgactcgtcgtgtgtccgagcgccggccagcagcagctggccggcgctctggcgtctgggggcgccatcggcggcagtaccgatcatgacgttctcgcggagggcagcgactggggtgtgggacgggcacggtcctctcgggtgggtccgctagggtccagcccatggcccctcccatcgaccacccggttctcgacgtcgccctcgccgcgctcgatgcggggaggcaggccctgtggcgcacggattcgcgagcggtgctggcgacgaagtcgagccggtcggacccggtgaccgcgacggatcgagcgatcgagcgcgccgtgcgagatgccatcctcggcgtgcgtccccacgatctcgtcgtcggcgaggagttcggttcggccggtgagccggggcggctcaggtggctcgtcgacccgatcgacggcacggtcaacttcacctacgcgatcccgtatgcagccatctcgatcgccgcgctcgacgcatccggcgcactggtgggggtggtgtgggaccttgggtcagacgagacgttcatcgcggttcgcgggcagggcgcctggctcggcgacacacgcctcgccgtgcgaccatcggtgccgctggccgacgccctcgtcggcaccggcttcgcctacgacgcttcggtccgcgccgtccagggccgagtgctggcggcgatgatcgatcaggtgcgcgacgtgcgccgcttcggggcggctgcgctcgatctgtgctggacggcggctggcaggttggatgcctacttcgagaccggcttgaagccatgggacgaggctgccggtgctttggtggtgcgcgaggcgggaggcctcgtggcgaccgacctcgtgggcatcggcgacgacgcgctgaccgttgcgggtccgccagggctgttcgaagagctcagcgagcgcctcggcgaggttctcgccgacgtcagagggccggtcggggacgtgtccgcctcctaggctttgcgccatgcgtgtcggggtcctcggtgctggcggtcgagtcggtcaggtgctgtgtcgggagattctggaccagccggacctcgagctcgccgtcgccgtcgatccgaggttggccggcatcgacctcggtcaggtgatcggtcggccggccggtggcttggtggtcgtgggcgacctcgaggcgtgcctgcgtgctggggtggacgccgtcgtggacttctcggtcgcggaggctgcgcgacccgcactcgtgcgcctggccgaggccgccatcccggctgtggtcgggacgaccggcttcacgcccgaggacatcgaggtcatcggtcgggcgtacgaggcgtccggagccggctgcatcatcgcggccaatttctcgatcggtgccgtcctgctcgagcgctgcgtgcgcctcgtggcaccgtacgtggactcgatcgagatcgtcgaggcgcaccacagtgccaagcgcgacgctccttcgggaacctcccgcgagctcgctcgggtggctcgtgaggctcgcgaggcagccgaggcggggcccctcgtcgcggatccgaccacgcacgaggtcctcgctggcgcacgaggtgcgctcgggcctggcgacatccgcatccatgcgctgcgcgtcgagggtgcgatcgcccatcacgaggtgatcttcggccttcgcggacaaacgctggccgtgcgtcacgatacgctggatcgcagttcgttcgtccccggtgtgctgctcgcgctgcgccgtgtcggtgaggttcgggggctggtgctcgggatcgacgagctgctctgagaggaacgggaggttggccgtggcaccaacggtggcgttcggaccggagatcacggcgatggcgacgccatttggcaccgatggcgcgctcgacctcgcggccgcagagcgcgttgccagatggctcgtggaccagggatcgagcgcgatcgtcgtgaccggctcgacgggtgagtcggcaacgctcagcgacgacgaacgggccacgctgtggcgggtggttgcagccgcggtcgacgtgccggtcatcgcgggggcgaccaccaacgacacggcgcactcgctccggctcgtcgacgccgccgagcgggccggggccaagggaatccttgccgtcgttccctactacaaccgtcctccccaggccggtctcgtgcgtcacttcggccagatcgcccgagcgacgagcttgcccgtgctgctctacgacgtgcccgcgcgcaccgggcgtcgactcgagcccgagacgacgcgtgagctcgctcggacgtcgacgaacgtggtcggcctgaaggatgcctccggcgacctcgcggcagctgccgcactggtggccgaggcgcccgatgggttcgtgctctactgcggcgacgatgccctcgtcttgccctacctcgcgatcggggcggtgggcgtggtctcggttgcgggtcactgggccggcccgctccagcgggtgatgatcgaggctgcgcgctcgggggactgggagcgagcccggcggctgaacgcggcgctcgaggcgtcctatcgcttcgagaaccagctcgcctacccgaaccccatcccgaccaaggcgatgctcgccgcattgggtcttgccgagccggtctgtcgatcgccgctcatcgatccgacgcccacgctgatcgacgaggcgcgcagcgtcctcgccgatctccacgcacaggccgacaaggaaggcatcgagcttcgtgtcaaggcctgagctgcacattcgcttcctcggagggctgggtgagatcggccgcaacgccgcactcgtgagtgtggacggacggggggtgctcatcgacttcggcgtgatgttccccaaggccgacatgccgggggtcgacctcgtgctgccgaacctcgcgggcctcgacgacgtcgagctcgaggcggtgatcgtcacccacggtcacgaggatcacatcggcggcttgcccttcttgctcgccgagcatcgtgtgccggtgtggggctccgaggtgaccctgggcttcgttcgcaatcgactgcgcgagcacgacctcggggatgtggaccttcgcatcctcgccgatggggcgcgcgtgtcggtggggtccttcgaggccgaagccatcccggtgacccactcgatccctggtgccgtcgccgtcgcgctcacgacgccagccggggtcgtgctccataccggggacttcaagatcgaccacaccccgctcgatggtcgtcacatggggctcgctcgtatcgcggcgctcggttctgatcctgggatccgcgtgctgctgtcggactcgacgaacgccgacgaagacgggtatgcccgttcggagcgagcggtcggaccggcgctcgaggacctgttcaaccgccacggcgcggctcgtgtgatcgtggcctgcttctcgtcgcacctgcaccgtatccagcaggtcgccacgctggcacgcgagcatggtcgacggctcgtgctgctcggtcgctcactccagcgcaacgtccagctcggcatcgatctcggtctgctcgatgcccgactcttcgagcgcacgctcgatccgcgcgaggtgcgcgagctcgaccccgcgagcgtggcggtgatcgcgaccggatcgcagggggagcgcatggcggcgctccaccacctcgcgttcgatcccgctcgctggttcgccgtcggtggcgacgacgtggtcgtgttctcctccgacgtgatcccgggcaacgaggcagccgtcaacttgctcgtgaaccagttcacgaggctcggcgcaaccgtcgtcacctcggcacgcgagctcgtgcacgcgaccggtcacgccaagcaggaggagctcgccctcgtcgtcgagctcgcccgccccgactacttcgtgccggtgcacggcgagtatcggcacctctccgctcacgcggcgctcgcgcaacgcaccggtgccgtcggtcgtggggtgatcctcgcccgggacggggccgaggtcgtcatcggcgacgacggtgccgagctggctgacaccccatggggcgagtacctctacgtcgacggtgtcgtcggggacgtctcgcgcggggtgctccgtgagcggcgcaacctgtcggaggagggcgtcgtgatcgtcggggtgacgctcggccccgacggggtcgcgctcggtgagcccgagctgacctcggtcgggtggatccacgacgagcgcgaggaggagctcctcgcggaggttcgggcgatgctggtcggagcgctcggtgacgagaagccgcgttccgaggacgcggtcgccgagctcatccgcacccgggtccgcgcactcgtgcgcgagcgcacgcggcgacgccccctcgtggtgcccatggtgacgaggatcgacgagggctagggcgtggctcctcgatcgcggcgcccctcatccaccaagggccgttcccatggcgcgggtgctcgtggctccggcgcgcgtgcgcgggacgcgaaggcgactcggcgacgtacgagtcccgaggcactcgcgctcggggcggtcgtcgtgggtctcgcgggcctcgtcgtcggctactcggggctcttcggggtcgtcggcacgggcgtcttcctcgcgggccgagcggcactcggtcgcgcggcgtggcttggttggctcgcggtgatcgtggcaggcctgcgcgtgctcgtgcggcgcgagcggccgagacggcgtgcgggcgtcggcctcgccctggtcgtggttgcggtcgcagcgctggttggcgaggcgatgcgggtccaccccgaagcgtctcgggcaggtgggctgttcggcggcgtggtcgctcgagccctcatggcgctcgagggtcgcaccggggcgatcgtgacgacgctcgtcgtcatggccgctggtgccgccctcgccggtgagctccgctggcacgtggtcgccgagcgggtcgccgagcgtctgcgccacgtgcccgacgaggagccgtcgaggaccacccgtgtggctcgtcagcgacccgagcgtgccgcgggctccgtcatcgaagccaccttctcggagctaccctccgatcccgtcgaagccgtccccgagcgccaccccgacctcgacgaggatgcggggatcgctgtggctgatgcgtcgtcgtccgcatcgctcggtgaacccgaagcgttcggctcgccggacgacacggcgacaccgacaccgatcgagctcgtggcgccgcgggcttcggcctgggagcgtcctcggcgatccatcctgcgccgaggcgcgcgcgccaacctcgaccgcggtgagctcatccggggaggccaagtcctccagagcgcactggccagccacggcgtcgcggtgagcgtggtcggtatgaccacgggtccgacggtgacacgctacgagctcgagttggccgagggcgtcaaggtggcgagagtgcttgccctccagcgcgacatcgcctacgccatggcctcggctgacgtgcgcatcctcgcgccgattccggggcgcagcgccatcggtatcgaagtcccgaaccgggtacgcgaagtggtgaccctcggcgacgtcctcggtgacgtgccctcgagtgctccggtgctcgccgtgccgctcggtcgcgacatcgccggtcgcagcgaggtggtcgaccttgcccgcatgccgcatctgttgatcgcgggcacgacgggttcgggcaagtcgtcgctcgtgaactcgttgctcgtctccttgctcatgcgcgacacacccgacgatctgcgcctcatcttgatcgatccgaagcgggtggagctctcgcagtacgcgggcctcccgcacctgctcacccaggtcgtggtggatcctcggcgcgcggcagccgcgttgtcgtgggcggtggccgagatggagcgacgctacgacgtgctcgcgcactggggggtgcgcgacctcgatggctatcgcgatctcgtggctcgcgtccaggggaacgccgaggccgtcggggacgatgaggacgcgcccgcgccgctgccctacatcctcgtcgtcatcgacgagctgaacgacctcatgatggctgcgccgagggaggtcgaggacgcgatctgtcggatcgcgcagaaggcgagggcggtcgggatccacctcgtggtcgcgacccagcggccctccgtggacgtcatcaccggggtgatcaagaccaacatcccgtcgcgcatcgcctttgcggtggcatcccagacggattctcgtgtcatcctcgaccagccaggtgccgagaagctcgtgggcaagggcgacctgctcctcgtcacggccgacagttcgcaaccgcaccggctccaggctccctgggtgtccgagaccgagatcgctcacgtcgtcggggcctggcgccgccaggggcgccccgagctggtgggcgagctcgagcagggcacccccggcagtcgtgagagcgtcgtcggcgacgaggacgtgctcttgcccgaggcgatccgtctcgtcgtggagtcccagagcggctcgacgtcgatgctccagcggcgactcaaggtcggcttcgcgcgcgctggtcgtctgatggacctcctcgaggcgaggggcatcgtcgggccggccgaagggtcgaaggcgcgccaggtcttggtcgggttggacgagctcgacgcgaccgccggccgcgtcgacgaccccacctctcaggttccacctagcccaccacggtaggctgctcagcatccccgctacgtgcgcgctcgtgctgtgcgcgcgtgagtggcgggtctggctgagagcggaggacagcggatggcgtcgcggaatcggaggaggctcggagcccgcagtcgaggttacggtcgacggcggagcgtgcgcctcggacgcgtcctcatcgtggtcgtggtcgtgattgtgctcgccggggtggtgcagatcgtgcgtggggtcccacagccgagctacagcgccgtggtgccggcgacggcgaccatccccggctccgcaccgaacgtgccgtggccgagcggcggcgaggcggcggcggagatcgttggcgtcggcaggatcggcacctacgggccgacgaccccgcagacgatcgcgtcggtggccaagatgatgacggccctcttgacgatccgtgatcacccgctctccctcgggcagcaagggccctccatcacgatcacgcccgaggactaccagatctacctcacggacaaggcccagaacgactcggtgatggccgtcgcgccgggcgagcagctcagcgagtaccaggccctcgaggcgctcctcatcccctcggccgacaacatggccacggtgcttgcgacgtgggacgccgggagtgagtcggccttcgtggcccagatgaaccacgaagccaaggtgctcggtctcaccgatacgcactatggcgatccgagcggtctgtcggcggcgacgtactcgaacgccagctcgcagctgcgtgtcgcgaggctcgtcatggcgaacccggtgctcgcgagcatcgtgtccaagccccaggcgacgctgccggttgcgggtgtggtctacaacgtcaatggcgaggtgacccaccacgggatcatcggcgtcaagacgggctccatcttgacgggaaacttcgcgatggcctgtgcggtgcacgtagggacatcgacctacaccgggctcggtgtcgtgctcgaccaaggcggcgtcgcaccacttgagaccgcgctccacaacggcgtgcggctcgccgagttcgaggagcagctcctccggccggtcacggtgctcagggccggtgaggaggtcgggtcgctcgcggtccccggtcacggctccgtggccgtgacggcgactcgaggggtgacgctggtcgggtggccaggcctgctcgtgcaggtcacggtccatctccaccagcacctctacggcgcggccgcgcacgccgtggtcggcagtgcaacggtcaccttgggtgaacagcgcatgacggtcccgttggtggcgagttcggcggtggcgtcgccgtcgctcctgtggcgcctgacgcatctgtaatggtcgcaccccatggcccgtggcgcttcgcacgggcgcccggctcgaccgccaacctgggccccgggttcgacgcgctcggactcgcgatcccgttcgagactcgtgtctgggcgcggccgaactcgcgcttcgtcgttcgactcgccggtaccggagggagcgagcggctcgacagcggtcacctgatcgcgcgggcactgtcgcaggtcgcccgcgagccggtggagctcgtcgtcgcctccgacatcccgctcgcacgcggcctcggctcgtcgggatcgctcgcgctcgccctcgcggccgcgctcggtgcgaccgatccgctcgccgcggcgatcgtgctcgaggggcacccggagaatgcggcggcctccgccctcgggggcgcggtggtggcggtcggagggggtggggacgagctcgtgctccggcgtgtggcgctcgatgctcggctgcggctcgtgctcgtcgtgcctgagcgtcgcctcgcgaccgccgaggcgagagcggtcgtggcgcgcaccctctcgctcgaggacgccgtcttcaacctgcagcgcgtcgccgctctcgtcgcgagcctcggtgatgtggaggcgctcgcgccgttgctcttcgaggatcgactccaccagccctggcgcgagcggctcttcccggaagccgtggtggtccgcgacgcgctcatcgaggcgggttgtcgcggtgcggcctggtctggggctgggccgagcctcgtggggttcgtcgaggaggagcgagccccccaggccgccgaggccgtccgggcttcgttggtgcgcgtcgcgatcggcgccagcgtgcacgtggtcgcccccgatctccggggcctcgtcgtcgggagcgagccgccgccaccggcactcgcggaagggcctgcggtacccttcgaggcttccggactcggctagcatggactcgatgtcctctcctcagcgcgtggccgtctatggtccgagtgcgctcgcaacaccagcgaacgcggtcagcgtggtgcggttgctgctcgccccggtcatcgtggtcgtgctgctcggggcaccggacggctgggttccgctcgcgctgtgggctggggtcgccttgtcggacaaggtcgatggcgtcctcgcacggcgccagggcgtgacccgagcgggcgcgttcctcgacccactcgccgacaaggtgctggtgttctcggtgctcggtgcgctgtggctcctccatcgggtgccggcgctgcccatcgtcatcatgggcacgcgcgagatcgccgtgagcgtctatcggacccaggtactcgccgggggccagagtctgccggctcggttgccgggcaagctgaagatgctggtgcaggtgatcgcggttggcgtggcgctcgtacccgggtttgcgctgcacgacgagagcgtggtcacgaccctgttgtggggcgccacggttctcgccgtggtgagcggcgtgcagtacttcgtcgacgcccgctcgatccagtcctgagcgcgggtcccgtggacgtctgtatcgtctcgatcggcacggagctcttgctcgggcagatcacggacacgaacgcccggctgctcgcggagcgactcgcttctgcaggacatacgagccgcctacgtgtgaccgtcggcgacaaccatgcccagatcgtgtgggcgctcgcggagggacttgcgcgggccgacgccgtcatcacgacgggtggtctcgggccgacccaggacgacatcactcgcgaggcggtggctgcggtcgcgggggtgccgctcgagcgcgacgagcgcgtcgcggcgaggatcgaggcgatctttcgcgatcgagggcgtcccatgcccgagaacaactaccgccaagcgctggtgccacgtggcgcccaggtcatcgagcagcgcaagggaaccgcccctggtctcgtcgtccccgtgggatccaagctcatcgcgtgcgtccctggcgttccctacgaggcggaggacatggtcgacgaggtgctcgccgccttcgccgctcacgatccgagcccgggcgtgctcgcatcgcgcgtgctgcggacctggggtctcggtgagtcgcgcttggccgagctcgtggccccacggttcgatgcgctgtgggggacgcccacgacgctcgcgtttctcgcctcgggcatcgagggtatcaaggtgcgtatcaccacacgcggcagcgaccccgacggcgtcagggcgaccctcgatgccgaggagcgtaccctcagagcgatcctcggcgactacgtgttcggtgtcgacgacgactcgctcgagcgggtcgtcgcgcgtgcggtcaccggccgacaggcccgagtcgcggttgccgagtccctgaccggagggatgctcgcgagtcggctggtctcggtccctggtgcctcggcgtggtttcgcggtggtgtggtcgcctacgattccgccatcaagcacgaggtgctcggggtccgggccgaacgtgtggtgagcgaggctgcggccgtcgagatggcgctcggtgcggcgcgggtgctcggcgccgacatcggggtggcgacgacgggcgtcgccgggccggatccgctcgagggcgagcccccgggaacggtctggatcggggttgcgatcgggcagcgtgccgcggcgcgtcaggtccgtctgctcggcgaccgcgagcgggtgcggacgtatgcggtcgcgagcgcgttggacctcgtgcggctcacgctggaggggtcgccccgaggtctgtcgctggaggagcactcggcatagccgatcatgcgttcgcatgtcgtcggctcgtgctacgctacgcatgtatccacgaggggaggccgtatggatcgcgacaaggcgctcgagaccgccatcgcacagatcgagaagcagttcggcaagggctccatcatgcgcatgggggagcaccccgagatggcgatcgagtccatcccgaccggcgcgatggcgctcgacctcgcgctcggcgtgggcggactgccccgtggccggatcgtcgagatctacgggccggagagctcgggcaagtcgaccctcgcactccacgtcgtcgccgaagcgcagcgtcagggaggtcggtgcgcctacatcgacgcggagcacgcactcgacccggtctatgcccaggccatcggtgtcgacgtcgaccagctgctcatcagccagcccgactacggtgagcaggccctcgagatcgcggacctgttgatccgttcgggttcgatcgacgtcgtcatcgtcgactcggtcgccgctctgacgcccaaggccgagatcgagggcgatatcggcgattcgcacgtcgggctccaggcgcgactcatgtcgcaggcgctccgcaagctcaccgccaacctctcgaagaccaacacgctcgcggtcttcatcaaccagctgcgcgagaagatcggtgtgatgtacggctcgcccgaggtcaccccgggtggtcgtgcgctcaagttctacagctcggtgcggctcgacatccggcgtgtggagtccatcaaggacggcgcggagatcgtcggctcccgtgcgcgggtgaaggtggtcaagaacaagtgtgcgccgccgttccgccaggcggagttcgacatcgcctacggcaaggggatctcgcgcgagggatcgctgctggacgttgcggtcgagatggggctcgtgaagaaggccggagcctggtacacctacgacggtgagcagctcggccaggggcgcgagaacgtcaaggccttcctcgctgcgaacccgcagctcatggccgaactcgacgtcaaggtgcgcgagcgggtggctgtggaccgtggagtcgccctgacgcacggcatcgtcgccgaggccgaggcgatcatcgaggactagcccctcctggggcggtggtcgggcgcgtagactcgtccccgcgatgccaagcagctacgtagtgcgcaccttcgggtgccagatgaacgagcacgactccgagcgcattgcgggcgtgctcgaggggctcgggctgacgcgtggcgacgatcccgcggacgcctcggtcgtggtcttcaacacctgcaccattcgggccaacgccgacgagcgtttcttcggtcaggtgaaccagctgcgagaggcacgtcgtcgcaatccgtcgatgcgcatcgtggtcgccgggtgcttggcgcaaggagaaggcgcaggactgctggagcgcgcgccccacgtcgacgtgatcgtcggcacgcaccaggttggccgcctcgctgagctcctcggtgcagccgatggggcggaggcggtggtggacgtccgtgagcccgagccgggcagcgtcggtctcgacgaccccacgccgtggggcgaggcggtgagcgaggagccctggcgagcgtgggtcacgatccaggtggggtgcgacaatcgctgcgcgttctgcatcgtgccgagggtgcgcggaccggaggcctcacgcccattcgatgcgatcgtcgccgaggtgcgcgaactggccgcacggggcgtgagcgaggtcaccttgctgggtcagaacgtgaactcgtacgggcgcgatctcgtgctcgcgatgcgtcgggccgaggacgagcgcgagcgggctcaggttgcgagtcgttcgggggtcgccttcctcggccagggcgtgcccagggtgcgtccgctgttcgcggatctcgtgcgcgcggtcggggcggtgccagggattcggcgggttcggttcacgtcgccgcaccccaaggacatgcgtaccgagaccttccaggccatggccgagaccccgacggtgtgcgagagcctgcactttccgctccagtcggggtcggatcggatccttgccgccatgcaccgcggctacagtgcggatcgcttcctcgccaagctcgccgaggctcgtgccacgatcgacgatctcgccgtctcgaccgacatcatcgtcggctttccgggcgagacagacgccgacttcgaggcgacgctcgaggtcgcggccgaggcggcgttcgatctcgcctacacgttcatctactctccccgcccgggtaccgaggcagcggccctcgtcgatcggttcgtcgacccggacgtggtgcacgagcgcttcgaccgcttggtgcgcgtcacggagcgctcggcggcagcggcccatcgtgccagggtcgggcgagacgaagagatcctcatcgaaggtccgagccgcaaggatccccggacggccaccgcgaggacgcgtcagcacaagctcgtccacattccggggctcgatgcgcgcgcgctcggggggcgctatgggcgcgcgaggatcgtcgacgcgcgggcacactatctgatcggcgagatcatcgacgtcgagcccggggagtcatcgctcgtcgtgccgtgagcgaaggtccgctcgaagaggagttcgccgcgtaccaggtctcgaccgatcccagcctcggtccacagccggaaggcaccatcggtagcctcgagtggcgtcgtgggctcgtcggcgccgtagtgcgacgagggtgcgagatcgcctggtcgatcgacgccaggcaggcttgccagggcgacggcgtgagctcggccgaccgcggtctcgtacatgccgccgaccagggcgtcgagtccttccgagcgggccctggcgaggatggcgagcgtcggctcccaaccgccgaggcgcgcgagcttgagattgagcgtcacccgtgcgccgagcgcgagcatcgtcgtgaggtcgcccggcccccgcagcgactcgtccaggcacaccggcgtgagggccgagcgagcgaactgggccaccgcgaccggatcgtcagggtcgatgggctgttcgagcagactgaagccgagccgatcgatggccgagagcgtgggatccgaggggtcgtcgaaggcaccgttcgcatcggcgacgaggtcgatcgtggtcggggtgagggtacgcgcctcggcgagcaggccgagcgacgtgtcgcgctcgatcttgagcttgatgcgccgatagccggcggcgatggcgcgctcgatcgcgccgaggacggcgtcgggctcgtcgatcccgagcgcgatccccgtcgggacggggtcgtctcggccgccgagcagcgcccagagcgggcggccggctcgacgagccgcgaggtcgtgggccgcttgcgacagggcggcgcgagccgcgcgatgcccgcgaatggtgtgcacgctccgtgcgaccgcctccggccggactctctcgaggcggggggcgagaaagcgctcgagcgcgaggagctcggtggcgagcgtctcggagtcgtaggttggctcctcgagcgcggcgagctcgccgagaccgtggacaccctcgtcgtcgacgagctcgaccagcacgcgcgccccgacgtggacgaccccatgggcgctgcggtgggggtcgcgttccagggagacgcgccagatgcgcagtccttcgctcatgcccggagcctacgtggccgacgtggctagcctgacaggagtgccgggacgtctcgcgatcgtcggcccgaccgggtcgggcaagaccagcctcgtcacgcgtgcggttcgtgacggactgctgcgcggtgtcgccgtcgtgtcggccgacgcgttcgccgtgtatcgaggactcgagatcacggcctgggctccgggtgacgatgaccgcgctgggatcgactaccacctcctcggcacggtcgacgtcgccgaggaggtctcgctcgcgtggttcctcggtgcactcagtgtgatcgaggccgagcgggccggtggcggggtccttctcgtcggcgggacgtcgctgtgggtccggagcgcggtgaacggcctcgcaccgccgccccaggcgcctggtcttcggcggtggttggaggctcgcgcgaccgatccccacggcgtcgccgcgctcgtgtccttgctcagagtcgtcgatcccgccgcggcctcggggatcgacggacccaacgcacgccgtgtggtccgcgcgctcgaggtggcgctcgcgagcggcggtgcgcgcagcgtggctggagaggcgctccgcgccacggcgccggcgcgctacgtgcagatcgggcttcgccgtggcgaagcagcgctgcgtcgggccatcgaggctcgtgtggaggcccagctcgccgcgggctggctggccgagatcgaacggatcgggccgatcgcctcgcgcacggctcgtcaggcgatcggcgttcgcgagctcaccgaggtcatcgagggccgacggacgctcgctgaagctcgagcggccatcgtccgacgcacctggcggctcgtacgacgtcagcgggcctggctcgagcgcgatccgcgcattcgctgggccgacagcgtcgacgaggccctctcggcgatcgcgggagcggtggaggaggcggcgtgaggctgaccaagctcgtcggggcgggcaacgacttcctcgtgaccaccgatccggacgagacggcgcggctcgagccgagcgtcgtcgtggccctgtgcgatcgccgcaacggcgtcggtgccgacggggtgattggtctggatgcgcacgacgccatggtgctctacaacgccgatgggtcgagggccgagatgagcgggaacggcctgcgctgtctcgggcacctcgtcaccgaggagcgaggcgtgggcgaggtggcgttcgagaccgacgctggccggcggatctatcggcgcgtcgggcgtgagggaggcagcgtcctcggggcgaccaccatgggtccggtcagcgtgcgggcgaacgagcgcggttggttcgtcgacgccggcaacccgcacgaggtgcgccagctcgcgagcccgcaggagcttgcgagcctcgacgtggcgagcctcggtcgttgcgcccaggcgcactaccctcagggggtgaacgtggagtgggccgtggtgctcgcgccggacgaggtggtgatgcgggtgttcgagcgtggcgtcggtgagacggaggcctgtggtaccggatcgacggccgtcgcggtggcgctcgcgtccgcagggctcgtcgagcgcacgtcggtgcgggtgcgcaacccgggcggggcactcacggtcgaggtcaccgagccagagcctgtcctcgtgggtccgagccgcctcgtcgcctccgtcgacgtcgacgtggaggcgcttcgcgcgtgacgctgatcgagcgctcgttccgcgagcgcatcttgctcgtcggcgtcgtccaccatggcgagcgtcgcgaagcggtcgaggactcccttgccgagctcgccgcgttggtcgacaccgcgggcgctgacgtcgtggatcgagagctcgtgcgtcgtgacgcggtggatccggcgacctacgtgggctcgggcaaggctgctgaactcgcggagcgctccgaggccctcgacgtcgacaccgtcgtctttgacgacccactctcgccggcccaacagcgcaacctcgagcggatcctcggacgcacggcgatcgaccgcacggccgtcatcctggacgtgttcgcgcagaacgcccgcagcgaggaaggacgtcgccaggtggagctcgccctgctctcgtaccggttgccacggcttcgcggtcggggggtggcgctgtcgcagcaggtcgggcgcatcgggactcgaggtcctggcgagaccaagctcgaggaggatcgtcgtcgtatccaggctcgtatggcgcaactacgccgtgagctcgaccagctcgccaggcgtcggttggtgcagcggcgagcgcggctcgcgtcgcgccaggcgcaggttgccctcgtcggctacaccaacgtcggcaagtcggccttgttgcgggcgctgtcgggtgcggacgtgctcgtcgagaaccggctgttcgccaccttggatccccggacccgtcgggtggcgctcccgggaggcgagacgatcctcgtcaccgacaccgtgggcttcatccgcaagctgccccacgagctcatcgagtcgttccgttcgacgctcgaacaggtggccgaggccgatctgctcctgcacgtcgccgacgcatccagtcctgacgtcgcggcccagatcgctgaggtcgaacgcaccctcgccgagatcggtgccgatcgcgtgccgcggctcgtcgtctacaacaaggtcgaccttcggccgatcgacacgctcgctgctggcgtccccgaaggagtcgcgatctcggccgagcacgacatcggcctcgacgacctgcgtgctgccatcgccgcggcgctcgatgcgatgcggcgtccgcgtcgctacgtggttccggctgggcggggtgacgtgctcgcgctcatccatcgcgagggtgccgtcgtgcgagaggaggtggatgcggagcgggtgctcatcgacgcggtgctcgacgatgcctccgatcggctggtccgccgggcgctcggagaggcgccacctgagccgctagggtgaggcggtgtcgcagcgcccctcccgcgtcgagctcaccgcgctcgcagccgatcggcacccgttcgtcgtcgatgcgtccatcggctcgcccgtcgatccgcccccagcgttcgtcccgcacctgctcgcgtgccagggggaggagcgtgcgtacccgccagcggcagggacgcccgcactcgtggagtcggcgacgcgctggttccacgcgctgcggggggtgacgctccccgacggcgcggtcgcgccgaccatggggtccaaggaggccatcggtacgctggcgtggttgcttcgggagcgccgacccgatcggggggtcgtgctcatccccgggcgcgcctaccccacctacgccgagggagcgcgggcggccggctgtgagatcgtgcgggtcccggacgactgctcgggtgctcctgccttcgacgccgtggctgcgtccgtgtgggatcgcacgttggtcgcgtgggtcaactcgccgtcgaatccgaccggtgcggtctatgacccggggccggtcgtcgccctcgcccgcgagcacggtgcggtgctggcctcggacgaggcctacggcgacttcgtgtggtcgggggaggccccgagcgcgctgcgcgcggggctcgagggcacgctcgcgctcgtgtcgctctcgaagcgctccaacctggccgggctgcggctcggtctcgtggcgggcgaccccatgctcgtggacgaggtggtcgcgcgccgacgcgcgctcggcctcttggcctcagggccctcccaagcagtggcggccgaggcgctcgccgacgagggtcacgtcgccgagcagcgctcgcgctacgctgggcggctgcgccgcttggcccgggtcatcgaggcggtcgccgacgtcccggtgcgcgtacccgatggcggcatctacctctgggtccgcgctcccgacgacgacggggcggcgttcgccaggtggctcgcgacgcgcctcgggatcgtcgtcgccgacggtgccgactacggcgatcgtgcgttcgtgcgcattgcggcgacggtgaaggatcgggcgatcgatgccctgtgggagcggggaggagtgcgatgaccgaggacgcgcgtgcggccagcgtgcatggcgcgttcgcacatggcgaaccgatcgataccgcggtgctcgtctcggtgttcgaggacctcgagcgcggcgcgctgcgggtggcctccgtcgactgggacgagggccgggtggtggtgcacgagtgggtcaaggaggcgatcctgctctcgttcggccactggccactcgtggagtccgaggccggcccgctcacctgggtcgatcgcatcccgctgcggcgcgatctcgccgaagcgcgggtacgtgcggtgcccggggcgatcgtgcggcgagggacctatctcggcgcgggtgtcacgctcatgccgagcttcgtgaacgtcggcgcctcggtcggtgagtcgacgatggtggacacctgggccacggtgggctcgtgtgcccagatcggcgcccgtgtccacctctcgggaggcgtgggcatcggcggggtcctcgagccgccgcaggccgctcccgtcgtggtgggtgacgacgccttcgtcggctcgcgcgcgatcgtggtcgagggctcgatcgtcgggcggggcgcggtggtggccgccggggcggtggtgaccccgacgattccgatcatcgacgtcgccaccggcgacgagcttgagcgcggcagggtgcccgactggtcggtcgttgtgcccggcacgcgagagcgccgttggcccggtgggaccttcggcctcgcggctctgctcgtgatcgcgcggctgcccgagggggagcgccacgagaaggccgcgctgaacgacctcctgcgcgcgcacggcggagccctgtgagggacccggtcgagctcgcggcggcctacctcgaggttccctccgtcaccggcgacgaggcggcgctcgctcggctcgtcggtgagcacctcgatgcggcggggcttcgagtcgaggtggtggcgggctgcgtcgtggctcgcaaccacggcggggactcctcggcgacgctgctcgtcggccatctcgacaccgttcccggtgagctccctgtcgccgtcgacgaactggtgttgcgtggacggggtgccgtcgacatgaaggcagggctcgcggtcgcggtggcgctggcgtgctcggagccctccgtgcccgtgaccgtcgtcgcctatccgggcgaggagggtccgatcacaggcaacgggctcgcgcacctcgtggccgagcgccccgaactcctcgcgggtgctcgcggcgtgctcctcgaacccacgggtgggttcctcgagctggggtgccaaggggtcgtgcgcgcgacgctccgactgcgtgggcgtcgagcccacgttgctcgagcctggatgggccgcaacgccatcgatcgggtcggcgaggcgctcgggacgcttcgcgccctggaacgtcgcgaaccccagatcggcccggtgcgctaccgcgaggcgatcgaggtcgtcggggtgcgtgggggcgttgcatggaacgtcgtgccggacctcgtcgagatcgacgtgagctatcggttcgcccccgacctcgatgctgcccgggcgcgccagcgcctcgaggaggccgtgcgtcccgtgatggacgacggtgatgacctcgaggtcgccgaggccgtgccgggcgcggtgagtgacctcggtcggttcggcgcactgcgcagcggcgcgttcggcgtgcgtgccaagctcggctggaccgacgtcgcccaactcgtcgcggcgggcgtgccggcggtgaacttcggaccgggggatccagaacttgcccacacggatcaggagatggtcgaggtggccgaggtgcgccacgtcgcccaggcgctgtggcggtggttgcacgcctaggacgatggttcgcctcttccgatggcgagtgaggccagacctcggactcgcgatgcgggtcgaggtggaggtgaggaggcccatccctgggcgaagggtcgctctcgagcacctccgatgcagtgtctgagcgcagccggtctggcccgccgtgtgctcgggcgtggtggggcaggcagatgggcgtgggcctgtggcgcccgacgccgtaggtcggggtgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggcgaggagtgccgccgtgatccgtcgtgcgccgtaggtgccagaggatgcctggtggaccgcgaccactcggttctcgaggtcgcgtcttgcacatgcccgacgcgacggtgctacctgggtgcgtcgccatcggtagtagccagcccgggagacctcgagtaagcgtgccatccgtttgatctcgaagcgagcgtactccgcctccatcagcgcgaatctctcttgcttggtggcttcgcggcgaagtacgcggctgcttttcccaggaactcgttgtccttgcgcagctcctcgagctccctgcgcagcctgatgagctcggtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcaggggaccaatgtgcgcgctggtcgggtcgaggtggcggcaggcatgaggttgcgatggccacgactggatcgagggggacgagatcgtctgtcagttgcgctgcttcgaacgcctcgagcgcgttcacggtgaccttcggcgcctcggtccccgttgcgtgctgtggaggtgctcgaggacgcgatcggcgccgtccacggcttcacgatgccggggacgcgcatcccgtgggtcgattgcgcgccgtggtgatcggtgtcgcaaccgagtccgccgttgccgtgagctcggcaccctcgtgtgagtgctcgctgctcatcgcgggcacctaggagaggggcgcgtgtcgccaggcgagccgggccagcgagggctgccgcgggtcggcaacgtgaggcgctcgagggggcgagtcggtcgagagcgccctggttcgtgtggcccggctgggtgtcggtcttctcgtgggggtgcgcgcctcgtgcggcgagctctggtgcttcccaaccgggagcgccggacgtggctgagcgttcgagagcccgcacaccgtgtcctacgggagctgcacgagcggcgggccagcaggtcacctcgtactcggccgcccgcgtgggcgagcgaggtggccgcgatggcaaggtcctcgcggcgattggcgccacgctcggaccccggccctctccgctcggtgccgaacccatcgaaggtcgcacgatgctgcgcgtccatccgagccgaccgccacacgggtgtggtcgtcctcctccttcggcgctccttcggcgttggctggcccagcaacggcggcgcgatcgcgaccgaggcgcgggtaacgttcgcccgaggccagaacgaggagggtcggagcgatgttggagggcacggtcgtgacggtgctcttcgaactgcacgctgaggggctcggctatcgcgagatcgcccgccgcacgggcatctcccgcaacacggtgcggcgctacctgcgcgacggcgcgagcgcgggacaggtcactcgtccccggcgccgctccaagctggatcccttcaagcccgagatcgatcgcctggtggcggacgggctcacctcggccccggccatcacggaacggctcaaggagctgggctacaccggcaaggtcaccatcgtgcgcgattacgtgcgtaccatccgtcagggtgcatcgcgcggggcgtgacccgcgccgccatgcgagccaagggtttcggcggtcgtcgtcgtatcgtgttcgcggaggggatggccggctcccgaagccgagtccatctcgcatgtgaggcccggcggtagggtcgtgcgggcgccatgtgcatctgtgggggatcctcgtctggtcgacaggccccggtggcgtgcggcatcgtgcgcttcgtcgggtgcacgcagcgggagggcggcagcccgaggcgttcggcttgcgggcgtggtccttgcagcagccgggtcggcgcagctcgcgtgtcgtcaacgctgtggtgcgggtgccgtcgcgctggtgcgagcgcgttcggatctcctcggatctcgtcgacgaacaccggtgctgggtcttgcgcccgtcggcgcgaggcgtcgtcggcccgacgcacaatcctcacggcgcggccggacgctctggcaccgctcaggcgatgggggcgttcatggggaactggagggcgaagcggcctcgtggcgcgtcgcatggactgctcgctgggcgatgggatcggttggcgatgtcctcgtggtcctcgagcaggtcggaacggtgcaaggcatgccgacccgtcggacacagcacctgcagcggcagggctaagccaggggcgcgagcacgtacctggacgctccttggcgagcagccggcggcctggtcagggtgcctggttggcgaactgtgcgtcgacgacctggctcattggcatcggcgtgtggtagtcgaggttgccggcgccgaggtagaccgactgcatggaggagagcaccgacgattggggtgcgagggttggggagaagacgttcggcggctccgagcgcagcagcgagagcgattcgccggtcgccttggcgatgatggcgaggttggcggcgctggtggcggccgacccttggaggtcttgcgcgcccttggcgagcgcgtcgaagaagcgttgggcggccgacgtgtggatgaagctgcccccgtagatgatgccggtgacggcgatcccaacgggagcccctgcaagcaccgtgccttggtgctgcgcgacggccgcttggaggaacggtgtcgccatgtaggccgcagcgacgccgccgttcgcgagagcggcgccttgttcggggaagttgacgttgaccaaggtgacgcgagcgagcgagaggtgtgccttctcgagcgcgagcgcggtgaggtaggcgcccgcggagccctggccacctgcgaccgcaatgcgctggccggcgagctgggagagcgaggtgatgtgagcggccgccgaacccaccaggccgttagcggcggcgcccggcgcctcctcggccatggagccaacgacgcggacgtcgaggccctggtggatggcgttgaagaggccggcgctgaagccgccgaggacgacctggacccggttcgtcgccgccagcgtgatcgcgctctggccgttggcgacgacttggaggttcaccttgatgtgctcggcggcgaagtagccgtgtgcttcggcgacgaagagcggtgcgaagagggggagcgggacataagccaccgtcaccgtggtgggggcggtcgatgaggtggtggtcgacgaggtgctcgtggtcgagccacacgctgccgctgtcaatccgagagccgctgtgagcgcgagagcgcgacgatggcgacgttgcatggatccccccttggtgcaagctgaggggatgctagcgtgcccgccgtctggtccagggcagcacgagccgttcgacgccaacgacgatcccggtcgcgacgacgccgaggagggcgatcacgacgaggccgacgtacatgtcggcaggttcgaacagctgccacgagttccagacgaggtagccgagccccgagttggccgcgacgaactccgtggccgtcacgaccaccagcgcgagcgcgaccgcgacgcgaagccccgtgaagatgccgggtgcggtcgcgggcacgagcacgtgcacgaagcggcgccagcgcgtggcgccgtaggcttgtccggcctcgaggagttctggcggtacgcgtcggacggcccccagcgtgttgagctcgacgacgaagaacgtcactgccgcgacggtgatgatcttcgcggtctcgcccaggccgaagatcaccagcagcaggggcaggagcgcgatctggggtaccgcgtagagcgcggcgaacagcggtgagagcgccgagcgcagcggacggacgaccccgagagcgaggccgacgacgaccccgaggaccgcgccgatgacgtagccgacggcaaggcgcgccgtcgtgatcccgagatcggcgccgagggtgccgttcgtggccaagctgccggcggtgcgcacgatgtcgctcggcggggtgaagatccgggtgtcgatcgcgtgtgtggaggcggcgatctgccacgccaccagcagcacgatgggggtggcgataccgagggccacgtcggcggcgcgagctcggcgagcactgcggcgtgcgccgcggacggcgagttcgctctgggtggtcacgagggggctcccatcgaggctcgcacctcggtctcgaggcgcgaccagagtgcgtggcgcagcgaggtgaacgcctcggtgtcgagcatcgcttcgtcgcgtggtcgtgggagtgggacgtcgaagacgtcggcgatgcggccgggcctcgcggtcatcgcgacgacgcgatcgccgagccagatcgcctcctcgagcgagtgcgtaacgagcaccatcgtgaccccggtctcctcgtagaggcgtgcgaggtcttgctggaccaccaggcgcgtctgggggtcgagggcgccgagcggctcgtccatgaggagcagcgcggggtcggtgacgagcgcccgagcgagcgagagccgttggcgcatgccgcccgagagttcgtctggccaggcatcggcgacgcccgcgaggccgaggcgctcgagccagcccatcgcccgccggcggcgctcggctcgtccgatccccgccatgcgcaggccgaaggcagcgttgtcgacgaccctgagccacggaaacagcgagtggtcctggaagacgaaggcgatgcgcgaccggaccgaggggtcgatctcgagcgttccggtcgtcgcggcggacaggcccccgatgatcctcagcagcgtggacttcccgcatcccgagggaccgatgatggagaggaatcccccggggggcacctcgaggtcgacgccaccgagggcctcacgcgcgcgtcctcggtcgtcgacgaagaccttgccgatcccggccgccttgacgagcgccgtcgctgtcgcgggcgcttcgtggggcgcctcgttgcgatgatcccccatggtggaggggatgctagcggacggcggcgccgtcgtaggagcgcagcacgccgacgacccttccatgcaggtggcaggtctcgttccacggcatcggcgcgagcgagggatcgtcctcgttggccccctcgagccacaccgagctcccgttgcgccgcaggatcttcaccgtgccgacgtcgtcaccgacggaggcgaccacgatgtcgccgtcagcggcgacatcgctcggggcgacgacgacgaggtcgccatcgaggatgccgacgtcgaccatcgagtggccacgcacccgcagtgcgaacgcaccgggcgcggccatggatgcgggcaccgcgaccgacgtctcgacctcgacctctggcaccacgtggtagccggctccgacctcggcgagcaccggtaccgcagccgatggcgcccgtcgggcaacgctcaggctgcgagccttcaacggtgagcgcacgaggcgtccgtcgcgttcgagtcgacgaaggtggtgctggacgcttgccggcgacttgagaccgaccgcatcggcgatctcgcgtaccgatggagcccaacctcgctcctcgacgacctgggtgacgtaggccagaatcgcctcgcgcacctcggggttctcgcgtgtcatgctgcgccctcctctcctgcagtgtactcaaacgcacgttcgcacgcaaccgatgagcgatcgcgcgttcggccaggtaggctcgctggaagagcccgagtgaggtggcgtgcgctgtcccttctgcggcaccaacgaagatcgcgtcgtcgagacgcgggtcgctgacgacggcgcggcgatccggcggcgacgcgagtgccttggttgcggtcgacgcttcacgacatttgagcgcatcaccgaggcgcgtgtcttggttcgcaagcgctcgggccagctcgagccgttcgaccgcgacaagctgcggcgcggggtgcaggctgcgctgaagaatcgccccatcggtgccctcgagatcgagcgcctgttggccgaggtcgaggaggcggtgcgggcggtcgacgaggtggagtcggcggagctcggtctgcgggtcctcgagggcctccgtcaactcgatccggtcgcctacgtgcgctttgcgagtgtgtaccagaacttcaccgatgccgacgactttcggcgcgtgctcgccgacctcggtccgaagcgcatcgcgaaggttcgccccgagggccaggcgcgatgacgttgatcctgacgaggaggtagtgatcatggcgggacgtatcgtcacggcggagctgaccatcgcagcccctgccgacacgatcttcgacgtgctagcgcgccctgcgctccatccggtgctcgacggctcgggcaccgtgcgcggtgtgctcaccggccctgagcgcctctcgctgggcgcccgcttcggcatgcggatgcgcctcgtcgtcccgtacgtgatgtggaatcgcgtcgtcgcgttcgacgagggccgcgagatcgcatgggcgcacctgggtcgccacatctggcgctaccgtctgacgccggagggtgagcagctcacgcgagtggtcgagtcgttcgagtgggacgatgcacccctgcgcctcgtgtacgagatgaccggcgtcccggagcggaacgcgctggcgatgcgcctctctctggcgcgtctcgaggcgctcgtcacgggagagaggcgggcggagggcggccagagcgcctgagtcgccctgatgccgctcctagcggactggggggagacggaggccgaccgctctgaccggctcgtccgcaccgaggaagagctcttcgacgtcggggccgcactcgcccgactcgaagcggcacgactcgcggcctcgactccactcggcgaccatgaggaggcgaagcgcaccgcgcgcgagcgcacccgggcgccctaccgaggcatgctggagcggctgctcgaacgggtcctcggcgagcgggtggaggtcgcgctcgacgaggaactcgacgttctggggatccgacgcccaggccgcggccaagggctcctcccctgagccagctgtgggccggcaccggggagcggtccgtgctctgcgtgcgtggtcgcgacccgcctgagcagggggcgtcggttctcctcgacggcgtgcttaccctctcggacgcccagcagggccgccggttcgtcgccgagctcgaggcctcgccgaggacggccaaggaatcgtcttcacggcgtaccccgatcgctacccggcatgggcccgcagggtcggaccgccgcccccgtcaaccacgccaccaccgcacggtcggggcgcctgtcccgctctgagctcgtcgaggcgatctggctcgagctcggcgtcgcgggccggctgctgccccagctgcgggaggagagcttcgtggcccaggagggggccggcgcggcctgcgctagcggtcaacaggggaatgttcactacactaagtcgaggacgtggcggggaatggctcgacgttgcggcaacgcgagctttccgtgccacagtgcgctcggggaagccgaacgggcccgtcttgggtgcggggaggagtgccgccatggccgagagtcgctcgttccgacggtccttcggacggtcgctggggtggtggctcgggttcgctgcggccgtcgtgggcgcaggtgcggggggctacgcgctcggggcgacgtcgcaaccaatgcgtagaggggcgcccagtacctcgcgcgcgcaccctcgtactacgacgacgccccctcctgcgcagtcggggtcctcggtgccgaagggcgtctcgggtggctcgcaggtgcctggcgcgacggggctctacgtggacggcggtgctggtaccccccactatgtcctcgcttggcacctcggtcccgacggcgcgatcagtggcgccgtcgactacgtgtaccaggatgggcagacctcggttgtcttcaccttcacgggccagctcgatggctccgacaccgtcgcgacgctgacgccccacacgatcccccaggggaccggctcggcctcccagccgcccgggacggtaccggccgcgatctcggcgaccctgtcgacgtcctcgatccagctcggggagtgcaccacctacctgcatttcgcgccgaacgaggctgcgtgcacattcctcgcatcctctagcctgcagtgaccggcaggccgtccgggttccctccctggaggcggcctcggccaggagctcgatgcccccccgtccctgagtgcggaccccctcaaggtcaccgagccgctcgaggccacgcacctgctggggccaggcggggttgcaactgttgagacgtaactgtgttctcacaagggatccgaatgtgtgcaggttcaattcgaccggtggtgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggcgaggagtgccgccgtgatccgtcgtgcgccgtaggtgccagaggatgcctggtggaccgcgaccactcggttctcgaggtcgcgtcttgcacatgcccgacgcgacggtgctacctgggtgcgtcgccatcggtagtagccagcccgggagacctcgagtaagcgtgccatccgtttgatctcgaagcgagcgtactccgcctccatcagcgcgaatctctcttgcttggtggcttcgcggcgaagtacgcggctgcttttcccaggaactcgttgtccttgcgcagctcctcgagctccctgcgcagcctgatgagctcggtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcatggcgaggcctactaagcgagtcgcagatccccgttactccctaggggatcgatgtgtgggaagcggcttgcgtagggtgaccgccccccaaatcgagtccactctcaatgtgagaccccatatcttcaggctgccgctcgctcgtcctctcgggcgccgatcatctcgagcgcgtagaacttccggctcctcgccgaggccgcgaggatccgcggctccggtggcgacgtcgagctcgattgagcttccccccatttgcttgacagtctgaatttaggccacggccgcctccgcacgggcccaggagagctcgtactcgacgggcggtaggtacccgaggctcgagtgcagccacagggacaacaggtgttgcgacgatcgattgcaatcacccaccacagccatcgatgccactccgcaagcggaacggcctagggacggcgtcgacgggccgcgagccgcaacttgatccgatgtccggaagcggatcctcggctgcggctgccgactcaggtggccacgacctcaaccgatggtgcaccgcggagtcggcggtcggtcgtcaccagcggtacgccgcgggagacggccagttcgatatagatcgcgtcgaccagccgaagctcttggcgacgggcccaggtcccgaggaggagatcgtggacgggatgccgctcgatcggtgctgcggccagctcgcgaagcttgacctcgacggtgcctgcatcgaggctgtctgctcgatgcaggcgtcccagggccgacaagacttctgcgtcgacgtgcgccggtgcgtgcaaggcgtgaccagcgatgcgacgccgcaccgcacgaccgagctcattgtccagcagaagatcgaccagagcggatgcgtcgacgacggcctcagccatgccgcgtcggtgcttcgtccctcgcggcgtcgagcgctgcaagcgcgcgctcatgtgacactcgcgcaatcgggctcgccagcgttgcaagccaggcatctgtcgagcgcgacgccaggcttcgccggaccgcctcctgggtcaccgcagacaaattcaagccggccttcctcgcttgtgccgcaagatcgtccggcaggtacacgttcactcgagccacaccacacaatatacacacttgcgctacggtgcgctccgcaagccgatcggtcaccgacccgactacccgcgacgcttcgcctgctacgacgacgcacgagcctggtgcgagcgcttccttcgctggtaccaccacgagcaccggtcacgtgcgggatcggactccacgccgtggccgacgcgcaccacgggcgtgccgtggagctccgagcacaccgggcagcggtgccgttgaccgcctcccagatggctcggagctcgctgacgagcaccaggtgctctgggtcctcgcttcggtctttgcggtgtcgccaggggtcgtacgcctggcgagagactcgatgactcgtgctagcgctgctatcgagaagccattggcctcctggcgggcaatcggagtggtagcggctcactgccccccctccctcaccgagtgggcgatccctcgctccgccagctcgagttccatgatgagctgtgtgacctgacggcgcagccgggtcagctcttcgcgctcggcgcctgtgagaccttcgagctcacctcggtcgatccgctcctgacgcacccagttgccaagggtctgctcattcacgccgagttcgcgggcaacgtcagcgatggttcggtgctggtcgagcaccaacgctgcggcatccttgcggaactggctcgggtaacggcctcgtcgtcgacgaacgggggcctcgcgcggtggtggattcggtgtctggctcatcccttcctcctagagcaggtgtcgctttggagggggaggccacaccgtcctgccgcactcgacgcttgagtacctaccgccgttcgagtacgagctcacctgggcccgcgaggaggtggccgaggcctcaacccagactgtcaagcaaatgggcgaaacccagagggccgtcgagggggccctggacgggcgcgcggcgtagcctggcacctgtgtccatcgacctgcgctccgatacggtgacccagcccacagacgctatgcgtcgtgccatggcctctgctcgttgtggggacgacggctacggcgaggacccgacggtccgcgaactggaggagcgtgcggcggggctcctcgggatggaggcggcgctcttcgtggcttccggcacgatggccaatcaagtggcgctgcgaaccctcacgacgccaggttcggtggtcgtggtcggggcccgggcccacctgtgccagttcgagcgtggcgcgagcgctcgtaatgcgctcgtgcagctccacaccctggccgacgacgacggagcgccgacggccgatgcggtggccgatgcggtggcgacctatcgtgcgattggggttcagccagccctcatcgcgatcgagaacacgcacatgccctcaggcggaacccctctcgatccggtgcgcaccggcgctcttgccgatgcggcgacggcgacgccgctctacatcgacggcgcacgactctggaatgcttcggtggcgctcggggtcgagccgagtgtgctcaccgagcgcgccaccgcggtgtcgacgtgcttctcgaagggtctgggggcgccgatgggttcggtcgtggccggatcggctgacctcgtcgagcgtgcgcggtgggagcgccaggcgctcggcggtcgcctgcgccaagctgggatcatcgccgccgcagccctcgtcgccctcgacgagtggcgaagcgtccttgcccgagaccatgagcgagcggccgtgctgcgcgaccgtgtggcggcagagctcggtgatgcccgcgtgcgctggggcgggacgaacatggtgctcgtcgatgccgatcgcccggtcgagatgctcgcccgccttcgtgaagcgggcgtcttggccaacgccatcggacctcggacgctgcgcttcgtcgtccatcgggatctcagcgatgccgaggtgaccgtcgccggtaccacgatcgcccaggtcgtgtcgtgatggagcctcagcgaccatgacggtagagatctacgagccggcggcgagcgtcgccctcgcctgctttgcccacccggacgacgccgaggtgctctgcggggggacgctcgcgcgactcgcggcccagggagcacgggtcgtgctggtcgtggcgacccgcggcgacaaggggctcgcgcgggtggacgacgccgaggagcgccgcaccggtgaactgctcgaagcggccgccatccttgccatcgccgacgtcgtccagctgcgctatggtgacggcgatctctccaacgacctcgagctgcgtcggcggctcgtgaccgtgctccggtccttcgctccgcagctcgtcctcggtcccgaccccacgacggtcttctacggcggacggctctacaaccatcgtgaccaccgcgagctcggctgggcactcctcgacgccgccttgccggccgcgagtcagccgggttacttccccgaagcgggcgagccgatcggaccgctcgaggtcctccttgccggttcggaggagcccaacagcgcggtcgacgtctcggcgtacctcgaacgcaaggtggaggcggtacgtcaataccggagtcgcctcggcgccgccgacggcgtcctcgccgatgcggtggtcggccgtgccgtggacgcggcgcgcagcgtcggcattccgggcgcggcggaactgtttcgcagggtcgagggcgcaggttgaggggaggggcgatggtcgagatcgaggttcgaggcccgggtcaccacgagcgcagcacactggcggctcgagcggtcgcggtgctcgcgggcgcggggctcgacgtgggtgtggtcgtcgacgttcgtccgcggctcgccgcggacatcgaggcccagctcgaggcaggtgcggcacgcgtcgtgctcactggccccggcttctcggcggtggcacgtaccggtcgtgagggcgtggaggaggcactctccgaaggcgacgtgctgatccgactgcgtgccaccgccgacgaactcggggtctacggggtcgacgatgcgctcgggcaggaatgggtccgtcgcctccgcgatgcgggtgtgccctgtatggggcctgagatcggggtctgagcgtcccggaatcggcggtggaacgggagcgttggggttttcgacgacgagccgaggcactagaatcatgacagatcaagcctcggtttggtctgtcggcgtcgaggaggacggatggcgctgaacgaagaggagcaacggattcttcaggaaatcgagcgctccttctacgagagtgaccccgccttcgccgatcgcgtccgctcggagaccgtgtaccggcatgctggacgcaacctcaagtgggcgatcgcggcgttcgtcgtgggactcgccttcaccatcctcaccttcacaacgtcggtgatcctcggcgcagtcggcttcttggtcatgctgggagccgcgtacgccttcgagcgcaacgtccgtcgtatcggtcgggcgtccctgagcgacatggcgcgctctggtcgcggcccgttcgggtccatcggtcggcgtttcaaccgcccggacgactcgcaatgagcgctgctcgcgctgcggacggggtcgttcgaggcctccgtgtgtccgtggcgcgagaggcactccgacaggtctgggcgctgaccttcggctctcgtgggaacccgtggcgcccgggagccgttcgcacgtacctcggcatgcggcacgaggcctttggggcgcgaccgtcgttgcgccagatcgtgcgctatctcgcgtgggccgcggaggagcgtcgcgcctggaggatgcggtgagcgcgcgtgtccatctgagagcggccagaggctgaggctcgcatgactgccggggtcctcgtgctcaacgcctcgtatgaggccctcggtgtcgtcagtgtcgagcgtgcggtcgggatggtggtcgacggggacgtcgacgtcgtggacgtcaccgacctcgtgctccactcgccgtcgacggcgattcgtgttccttcgatcctgcgtctccagcgctacgtgcggataccggcgacgcgtcggatcgcaccaacgcggcgcgccatcttcgcacgcgatggttatcgctgtcagtactgcggggggcctgccgagaacgtcgaccacgtcatcccgcgcagccgtggcggccgacacgtctgggagaacgtggtcgccgcgtgccgtgcctgcaacgctgccaagagcgatcggctgccggccgaggcggggatgcaccctcgacgcgagcctcgtgcgccggccgcgcgtactggttggttgctcaccgttggggtgcgtcggcccgagtgggagccgtaccttcgagcggcctggggagactcagctcgggatctcttgcttggcggcggcgacgatggccgtgagcttgctcgccgggaagagcggactcacgctcactcgcgcgctgcccggtagggcgtttgcgatggtcacgacacctcgagcggtgtcgtaggcgcgcgggacatcagtgccgaccacgaggaaggccgcccgggcacgtgggccgagccgcagtgaggtcgatgcgaggaggatctgatggttcgaggtcccgacccgcacgatctcgttgggcagcggcgctccgaccggcaggtagaagcccccgaccgagcagctcgtcgcgctcgtgttctcaaccgagacgacggcgaggtcgtcacctgtgcgggtgcgcgagagctcgatcacgcttccgtggaggaccgatgcagggcaggtcgcgtcgtaggcctggcggtgggctcgctggccgaggacgacgccgagcaccggcccgccgatgagcgcgatcgctgcgagcgcaatgggcacgcggagcgcacgaacgggcgcgcgcacgccttgtgccatgggtccctccctgtgtgtaagccccgacgagcgctcgtgcgcgacccgcatgtcgctcgccatggtcgataggctaggcccgtggagcgagtaccgcctcctgtcgtcctccccatcggcgtcgcggtcgcctctgggctcgcgcgcgtcgatcggctgccctcccgtctgcggcgatcgatcggcggcgccttgctcgtggctggggccggtctggctggttgggcggcgttgaccatggaggcgagcggaacgtccccggatcctcgcaagcccccggaggcactggtcagttctgggccgtatcggtttacgaggaacccgatctatctcggcatgctgagtgcgcaggccggcgcggcgttcatcaccgctcgcccatcgctggtgttcggggccctcgtcgcgggcgtgttcctcgaccagttcgtcattgcacgcgaggaacgtgaactcgccgagcgcttcggcgatgcctacgccgaggtcgtcgctcggacgcctcggtggctcgtgcgccggtgatctgccaccacgaatggcagtgtcaagatcgagaacaacaacagtgcgaccgggacggcgctcacgatgtaccagggccaggggccgagcagcgacagcatggtgtgctcggcgggtggtcgacgcaggaacatatagtccgcgccggttgcccagtcgatgaggccgtcgaaggccgtgtaggcgatcgagatggcaaggacacgccagggagcgctcggtcgaggatggatgccacgaccgatcgtcaggtagaaggccgccacgacgacaccgacatggccgacgaggtactcgaagaacacgaggtgggggaagcgaaccgcaaggtctggggtgatgatcgcctgcagcgtgccggcgatgccccagagccagaccacttcgacgagccagcgtcggggtacgacgcacgcgatcgcagcgatgaacgcagccgcgtcacacagcgagagcggcagattcgctgccagggaggcgtgcggtgcgagggcgacggcgaccgcgtcgctcgcggcgtccgctgcgatggcgatggcgatgatccatcccacccagtgggcggcgcgtggtgatcgacgcgaggccgcgatgccgatggcgccggcgacgccaagcacgccaaccgtggcgagatacggacctgtggtaggtgcgatcggcgtgctcatcgtggtgctcgtgccattctcgtcaccttcgatgctactcatcgtggcccttggtgtcggagaggctcgttcgcttcgccgcgctcgctttcaggcttgccgatcatgctcatgggccttcagtaggcgtcgctggtgggatgccgagggatcctccaatggctgtggtgacgccatcgccacggttagcccagcgacgggagcctgtgcgtcggttgatcgcgcatacagatgcaggtgccgctggcgcacaacgccgggagtcagtcgttgcccctcgatgctggtggccacctgggcttccccccatttgcttgacagtctgaatttaggccacggccacctcccggcaggcccaggagagctcgtactcgacgggcggtaggtacccgaggctcgagtgcaggcggacggtgttgtagcgctgaatccaggtagcgatggcagagcgagcctcggcgaggttcgcgaagcggtagcgacccaccagctcgcgcttcaggctcccgaagaaagcttcggcgacggcgttgtcgtagcaggtcgcgaccctgcccaccgactggcgaagcccgagcgttgcgcacagctggcgaaccttccgggagaggtactgactgcccctgtcgctgtggaagatcgccccagccaggctgccccgagtcccgagtgctccgcagatcgcctcgaccaccaggtcatcgggcatgcgacgcccaagtgaccagcccacgatccgcctcgagccaaggtctgccaccgtggcgaggtagcagaacccctcgtcgcttcggacgtcggtgatgtcgctcacatacctgcgcttcggttcaccaggggcgaagttctggctcacgaggtccggcagtggcgcttcctcttcccgcctcgtggtacgcacgaagcgccggggtgggcacgctgccatctcgagctcgcgcatcaggcgttccacccgcttgtggttcacgcagtaaccacttcgtcgcagctcatgggtcaccctggggctgccataggtgccgtcgctcgcctcccagatggcgcgaagctcgctcgcgagcaccaggtgctcttggtcagggccgcgctcgcgccagcgtcgccaggcgtagtacgcctggcgagagaccctcgctactcggcatggcgccgctactgggacgccctcggcctcctggtgagcgatccagcggtagcgggtcactggttgccctcgcaggatccgcaaaggccaggcaacgtttcgccaggtctcgttccatggtgagctgcttgacctggcggcgcagccgggtcatctcctcgcgctcggcgctcgtcaggccttctcgctcaccgcggtcgatgcgttcctgacggacccagttgccgagggtctgctcgttgatgccgagttcgcgagcgacctcagcgatggtgcggtgctggtcgagcaccaacgctgcggcgtcctttgcggaactggctcgggtagcggccgcgtcgtcgtcgagcggggctatcgcccgggggcgggttcggtgtctggctcgtcccttcctcctatagcaggtgtcaacctggaggggggaaggccacagagccgctcacgcgaccgttactgcccagccctgacgcgacgcggcgaccagcgacgtggctagcgtgcggtggtgcgcgacagcggcactcaaggcgccccggggcttcgcgtgagggatgcgctcaccaatgttcgcccgacgacggtgtcggtgaacgctcgccgacgtgtcgaggccttcgtccgtccgagctcaagcgcgacgatcacacgaaggtctgtgtgttgcaaaccacgaactatcgcaaccatgagccgggcgcgcggtgctcggtccgcgtcggggacatcggggccccagggggtcgaggtggcgtcgtcgaccggtcggggtgggtgggccgacgtgtgcgttcagcgtgcgtgggagggagttgtcaccttgacaccgtcgccaggcacgtggcacggtcaggcccgaggcgagacaagctcgcaggtctgcagctaccgcgctcgagaggagtttgcgcgtcgccgtggctgcgacggcggtggttcggttcgagtgttccgagccatcaccaacgctctgcgcgggtgcgtgataggcggtcggtggccatagccgatgtgaaccgggcctgcggttcgcgcagggatcgcgaccgaggccgctcccggcagatcctgctgaggtgagcatcagggcctcatgctcggtcctcgccgtcgtcgaactgcaccgcttcgaggcgctgacggcgcgcttcgagcgtctctccaccgtacatccagtaggccccaccctgtgccgacgttgtccgcagaccgatccgctgtagagccttgacggccgccgcggacaggctcaggttctcgccctcgaactccactcgattgccaggcaggacggtcacgtccattgtctcgtctcgcgagaacgtcagtaccgcgcccaccgggatgtcgagcgcctcgatgcgcagattcgatcgacgctgcctcatgctgttaagcgcgacctggtcgtcggcatcgagttctggctccgtcacctggatcggcgtgtgcggtgcgatggagatggccaggacgactcgttctggctcaattcggaagaactcgcgcttcggattgacccgcgcctcggagaacaactggtggagcttgcgttccaatgtgcttgcgtcggcgacctctgcggcgaagtggcactcgaagggcagtgggacgccggtcgtgtaaaggtcgttcatccgtgaggctacatcgccgttcgacttgccgattgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagatcttgacgatccctggcattgcctcgttggtgaggacatagatgatctcggccacacggcaacgttagccaacggccgtgccgtcgaggctcgaggacgcgcgaggaggctcgggagcacgccgggcgtggcgttcgccgactcgcgaatccaggtgctgcgcaggagcgttaccgcgtgatgtcgggcgagctcgcgccatggatccagcctctgggcgcgagtggctcgccgccaagggtgcgctgtctcgcgtcggcgacgatgcgtcccacgacgatcggttcgcgcaggcctgcggctcgacaggcgtcgatcaaggcggagggatcgtggatcgcgatgacgagctcgtagtcctcgccacctccgagcgcgtcggcgagcgtggcgtcgggcgcgatcggaacgtgatcgagctcgaagccgacgccggatcggtcggcgagccggtgcaggtcgagcgagaagccgtcggacacatcgatcgcggcgctcgcgccgtagctggctgcaagctggccgtgagcgaggcgtggttgaggggcaaagagggcatcgtggaggtggcgcgggagtgcctcgggggcctctcctgcgagcacgcgtcgtaggcccgccgaggccgcaccgagcggaccggtgacgagcaggtggtcacctgagcgggcgccacgtctcgtgagcggggtgccatcgacctgaccgagcgcggtcacgcacagcgtcagcgtggctccccgtgtggtgtctccaccgacgaggggcgcgccgaggcgatctgctgcctccgcgaccgcgacggcgatggcgcgggcatcgatcgctggtgggcaggcgagcgcgagcagggttgcctccggtgttgcaccagcggccgcgagatccgagaggttcaccgcgaccgccttgtgtgcgatcgccgcgaggggccaccggtcgacctcgacgtggacaccgtcgacgacgaggtcggagcaccacacgcgcgacttggacgagggagcgatggttgccgtgtcgtcgccgatcgccagcgaagccgatccggcgccgatgacggcctcgatgacctcgtcttcgcgccagttcgtgtccacttcagctatctaagctgcctggtttgcgcattcggtccggatgctggcagcatggaggatcctgttcgagcaacgagcgagcaacttgacccttcgggaggagaccatggggatcgcggatgcgaaccaggacgtccagcgttggatcgatgagtgggtgcgcgtgctcgagcccgcgcgtgtggagctctacctcggcgagcgggaggagaccgatcgactcatcgacggtctcatcgcccagggcacccttcgaccgttggacccctcgcggcgtcctcggagctacgtggcggcctccgacccgagggacgtcgcccgcctcgagtcgcgcacggtgatctcgaccgacgatcccgatgatgcgggcccgaccaaccattggcaggacccgaccgccatgcgcgagcgtctcggcaagctcttcgcggggtcgatgcgcgggcgcacgatgtacgtcatcccgtttgcgatgggggtggtgggatcaccgttcgcggtctacgcgatcgaactgaccgactcggcctatgtcgccgtgtcgatggcgaagatggcccgtgtcggccgcgcggcctgggatgcgatcctcggcggtgcgcccttcgtgccggcggtccactcggtgggagcgccgctggcaccaagccagcgagacgtcgcgtggccctgcgatccggacaacacctggattgcacacttcccggccaccagcgagatctggtcgtacgggtcgggctatggcggcaacgcgctcctcggcaagaagtgcttggccctgcgcatcgcgagcgtgcacgcgcgtgaagaggggtggctcgctgagcacatgctcatcttgaagctcacctcgcccgagcagcgcacctactacatcgctgcggcgttcccgagcgcgtgcggcaagacgaacctagccatgctccagccttccgtgccagggtggcgagccgagaccatcggcgacgacatcgcctggatccgtccgggccccgacgggcgcctccgggcggtgaaccccgagtacggcttcttcggtgtggcaccagggacctcgcgccgcacgaacccggtcgcgatggcgacgatcagccacgacaccatcttcaccaacgtcgccgtcacgcccgatggcgacgtgtggtgggagggcatggacgaaccggcgccgagcggcctcatcacctggcgaggcgagccctatgaccccgcgaagggacctgcagcgcatcccaacgcgcgcttcaccgtggaggccaggcagtgccccacgatcgcgcccgagtgggaggatccgaacggtgtgcctctcgacgccatcgtgttcggtgggcgacgccgcgacaccgtgcctctcgtcgccgaggcgaggtcgtgggagcacggtgtgtggctgggcgccacgatggcgtccgagaccaccgcggcagccgaagggtcggtgggccgggtacggcgtgatcccttcgcgatgcttcccttctgcggctaccacatgggcgactacgtcgcgcactggctcgaggtcggtgcccgtgccggcgccaaggcaccccgtctctacgtcgtgaactggttccgccgcgacgacgagggggccttcgtgtggcctgggtacggcgagaacgcgcgggtgctcgcctggatcgtcgatcgcctcgagggccgggcccagggggtgtcgcatccctacggcacggtgccggcaccaggggaactcgacctcgcgggcatggcggaggcgccgtcgtgggacgcgctcttcggcatcggtgacgaggagtggtcacgcgaactcgaggatgctcgagcgttcgtcgccaccctcgctccgcggttcccggcctcgctcctcgacgtcgccgaggcagcggaccgagcagcagacaccgacaggggctgaggcaccccggcgatcagatcatcaggagcccgtggaggcgctcacccggcctgcgcgagtcgtcccggcgacgacgagaagagcggctatgcagaacgtggcggccatgatggcaaaggcccagcggaacccgaggtcggtgaccgcgagcccgatgagggcgacccaggccgcgccgatggtttgtgagacggtgaagaacacgccgaaaccctgccgttccaggtcgcggggcatgtgatcggcgaagacggtctggcggagcggcagttcggagtaggagaagatcccgatcgcgagcccgaccagcgcgagtaggagtggctcggcgccgaccaccacgaagcctacgagcgcagccgcaccaagcacgtagttgatgagcagggtgcggcgatgggccgtgcggtcggcgagctggcccatcgctaccggcccgatgaccgcgccgacgtagatcacggtcaggatcaccgtgatggccgcggtggaggtgtggatgccgtcgtggaggtaggcgggtgcgtagaggccgatgatcccgatgccctggccgcccgctgcgatcgtgccggcgaggaggagggtccacacgggtcgggcacgaaggagcgtccacagcgacacggacgagcgggcggacgacgtggtctgcgcctgggggatcggacgacgccagggactgcgaatcccgacagcggtcaccaccgcggtggtggcgaggagcgcagccagcacccacagcgcactgcgccagccgccgatcgcgatggcgaggccggtgatgctgggcgcgatcagcgtgccgatgttgccggcggtgacgtgccacgacaggacggtgccgcgccgcttgggatgtcgggaggagaggaacgacgaccccaccgggtgctgtggccagccggcagcggcttggatcagccgtccgctcgcgaagatcaccacgttcggcgcgagcgccgagaccgcggctcccacgacggagccgatgttctggagcgtgagcagcagcctcgcaccggcgcgcttgacgacgacggccaagccctggagtgctgacccagcaatcgcggccaccgagagcagcgctccgatgaccgcatacgaggtgtggaaggcggtgagggcataggggatcacgatgccgatgccggcgacataggcgtgttggcccgcgtgcgaccacccgacgcttgcgaggtcaccgaggaaggaatgtcgagtgggtttgggttcgccggcgttggtggaagaggactctggcatcgatcagctcccctcccaccctaaccggaggtgccagcctgggtgcgattagccctgtcggcgctggcgctcgggctcgatgacgagcaggacgcgctcggaggtgatcggagcggcgtagggtccgccggtgtagcgctcggagagccgatcgatgtgctcgcgagcgcgagcgccgccctcggtggcgatcacgcggccgcgaacctccacgtagcgataggggttggcatggtcccacaccaccaacgcgaccctcgggtcgcgttggacgttgcggtacttcagccgatggacctcggtgttgatgaggacgtggtcgtcgtcgatgtcgaaccacatcaccgacgactgtggcgacccgtcggggagcagcgtggtgaaggttgcgaagttcgctccggtcgcgagctccacgaggagtggatctagcatgcacgtaggttagcccaacccgggctgggcccgcgagtgcgctcgctcgtccaccgtgaccggatcgacgggcgcaagcgcggccacggcgcccaagtggcacactcggacggaggcgacctcgtaggcgacggtacgggagggtaggcatggcggttgcgtggatcgacggggccctggtggacgaggccgatgcccgggtcccggtgttcgatcatggcctcgtcgttggcgacggggtcttcgagactctcgtcgtcgtcggagggcgggcctttgcaatccgacgtcacctcgagcgtctggcgcgcagtgcgcaggggatggggatcacgctccccgacctcgatgcgttgcgcggcgcgatcgaggccgtcgtctcgaccaacggttacgaacgagccaaggtgcgggtgacctacaccgccggtgacggcgaactcggctcgggtcgtgtcggtggtccgacgagggcgatcgtcgccgaggcgccgatcgagctcgaacctgcgacctgtgcggtcgcggtggccccgtggcctcgcaacgaacgtggcgtgctcgccggcatcaagacgacctcctatgccgagaacgtggtcgggctcgcgtgggcgcgagcgcgcggcgcatccgaggtgctcttcgggaaccttgcgggcaacctgtgcgaaggatcgggctccaacgtcttcgtggtccgtgacggcgacgtgctcacgccgccgctcgacgccggtccgctcgccggagtgacgcgtgcgctgctcatcgagcgcttcgccgtcaaggagaccaacatccccctcgacgatctcttcgacgagcgggtgtcggaggtcttcgtcacctccacgctgcgcttcgtccaaggcgtgcaccggctcgacgaccgcgagttcgagcaggctccgggtccggtgacggccagggcacaggcgctcttggctgatctcgttgcctctgacatcgacccctgaggagtcctcgtgcgcttcgacgatcttgctcgcgtcagtgagctggccgcgcggttcccggacgccgctgtggtccggctcgtcgcgttgcacggtttcgggggtggcgagcgtgcggcggacctcgcgatcatggctcccgaaggaacggtcggggcgatcgtcggcccgggggtcgtcgatcgcctcggatccgacccgacgccacgacttgctcgtgtcgaggtgagcgatcccgacgccgaggcgcatggcctcgcctgcggtggctgggcggaggtgctcgtgcatcccgcctcgtggctgccgccacttggcgaggtcgccggtcggcgtgtcccgttcgtgttgaccaccgtcgttggtgacgacggaccggtggcaccgatcgcgatcgaggtcgatccgctcgtgcgtccaggcgtgacggtgcgcgatggcgtccatcggcaggcgttcgtcccgaggccgcgtttcgtcgtggtcggcgatgggcccctcgtcgacgagctgggatccctcgggacctggctcgacgtcgaggtcgacacaggggacgtcactgggctcggcccgctcgacggcgtgctcgtgctcacccacgatcatgaacgggccaccccggtgctcgcgtccgcgttcggtgcaggggtcggctacgtggcggcgctcggatcgcgagccacccaacacgagcgtgtggagcggctgcgagccgtcggtgtcgacgcgcgccgactcttcggcccggcaggtctcgacctcggatctcgaagcgtccgcgagacggcgctgtcgattctcgctgagtggcttgccgtgacgcgagggcgctccggtgcgcacctcgccgccggcgacggaccgatcaacggctagtcgatcgcgtccagcttgagcggagggatgtcgccgagcggtgggggcgacgacggctcgccctcgagcgctcggtcgcagagccacgcccgcgaggggctcttggtcgatgccgggcaggtcgagtcgagcaaccgcagctgcttcgctgagcgcgccgaggtgggtgaggaggtggcgcgcgttggtcggcgcttcggcgagctcggccgccgtcctccggaccgcgtccccaaggcgcttgcctacgctcccatcgagggctgcggtgatgcgttcgacgaagccatcgcgcacaactcggtcggcgagcacctcagcggcgtcgagggcgtggacgtggggggttccctcccagatcgggagcacgagtgcttcgcggtgccatcgtgcgatcggcgcgtcctcgacgaagccaagcccgccgaacgcctccatggcccgctgggtgacgaaggcggcctgctcggcggtccggaccttggcgacgtgcgaccgtgcgcgaaggatctggtaggcacggtcgccgtggtgcgatccgagcgagctctgcgtctcctcggcgagctcgaacgcgagcaacgaggtggcgagctgagaggcgcggaggcgagcgagctcgtcggcgaacaaggcatgggcgagcagcggtcgaccgaacgcgacgcggcgctgcccacggatggtcgcctcggcgagcgcgatgcgtgcgatgccggcggcgctcatggcgttggcgacccgcgcgatcgtgagcgattcgaggatgcgatggattccgtcggggggagctgcgaggagttcggcgggcgcgtcggcgagatccacctcgccggtcgggacggcgcgggtggcgagcttgtccttcagccggcgaacggagaaggcgagcgagccatcgggctgctcgcgacgcacgaggaagagcccgagcgaacggaccccgcgaacctcaccgacgtgggccgcgacgagcgcaacgtcggcgagtccggcgttcgaggcgaagaacttctcggccgtgccgatccgccactcgccgttgggcgtctgggtcgcacgggcacggagcgacccaaggtccgagccggcgtgggtctcggtgaaccacgtcgcgccgaaccatggcccctcgcgcaagcgtgcggtggcgctgtggtggggggcgagatccgcgagtgcgagcgagacctgcgtggtgagcgtgatcgtgcagtagaggccgggatcggcgaggaggtagccagcggcgagcgcggcgaggaggccgtcgggctctgtcgtggcgagcgcgaccatgggacgcagtcgctcgagcagggccacgtgggtcggggcgagctgggcgcggtcgatgcggttgccgtcgaggtcgtgggcgaccagccgtggcggcgcgtcacggtcgacgtggcgcgcgacctcgagggcgtcggccgagatggtgcgattgaggtgctcgagctcggatcgtcgagccgcagagagtcgagcggcgagccagcgctcgaccacgggatcgagcgcgagctgatcgagtccactcgcgtagccgccctcccgtggcatcaccatccgatcgcgctcccgtcctcggcccgggggtccgagcagctgatgacgtcgtgctcgcgaaccatcgcgatatggcacacgccggcggccgtggtgaggccgggctcgagggtgagcggcccgatgcgctcggcgagctcgccgaggacggacggatccacgtggtcctcgatcacccacgtgcgcttcccgtcgtggtggtgggtgtcgaaaccggggtgtggaccggacgatgcggcggtctcggcgagtcgggcgcgagcgagggcagtgcgcgggtcgatgccctcgcgcagcgtcgcagagaccacctgggcgatgaccgtcggctgacgatcgcctcccatcgtccccgcgacgaggcgcaacgtgccggtacgcggatcggtggccatgagcggcgcgagggtgtggcgcgggcggcggcgcgggccgagctggttcggactcgcgggatcgagatcgaacccgaccgcgcctcgcgagtgcacgaagaccccggtctcgtgggtcgtgagtcgggtgccgaacgcattcgcgttcgactggacgaggacgcaagcgccccctgcgtggtcgacgacgacgatcgccgtggtgtcgggtgcgttcgggcgtcggagggtcgcgggcggagacgacggagccggggcggcgagggcggcggcgacgtcggccccgtcgtagtggagctcatggagccagcgggtctgctcgatggcgtcgaccatctcgagataggcctgcgtgagcgacgtcggtcgttcgggcgggagcgccgcgaggaggccgagggtgagaaagctcgccgacggagccggtgtccccatcatgcgcagcccgagggcgtcgacggcgatcggctcgacgagctcggcttggggtcgggcgaggtcttctgctcgcagtgcgccttgggtgagcgccatgagctcggctccgacctcgcctgcgtaaaagccctcgcgtccgagacgcgtgatggcctcgagggtgcgggcgatgccgtggtgacggatccgctggccagggacgaagcgacccttgaacgccgccgtgagctccgagcgaaagccgaggtccgagagctcgcgtgcgccagcggcgagacgggcgggcgcggcgaagccgttgcgcgcgtagtcgatcgcgtcggcgaggatggtatcgagggcaaggcggccgaagcgttcgtgggcgaggagccaaccgtcgacggcccctggcaccgtgatcgccgctggatggtcgcggggaatggtgcgaaacccttgctctcgcaggatctcggcgttcgcgttcgagccggcgcgcccgatgccgaccagcgcgtggacacgaggtggcgtgcggggtgtgcgaggttgatagacaagtccgacgacgtcgccaccgaggccgcacgcgtcaggggcgacgacggcgagcaccgcgttcgccgcgatcgcagcgtcgacgctactgccgccgcgacgcagcaccgtgagggccgcctgcgaggcgagcgggtcgatgctcgagacggccgcatgggggaaaccgtgacacgcgacgacaggtggctccacatcgcgcaaggctactccacacgtcgcttcggcgcgcagggccgtgagaaatgcgcgattgcgtggtcgacgagctcttgtgcggcggattcgtgagatttactcgtgtggtcatacggaatcggcttgcctcggggagcgagatgcgctagcgtacacaacggttccgcgctccgcgttgccacagcgcgaccgcggcgtacgtccagggcacacgaggccagcaccgagagggcacggccgagagggcaaggccgagaacacggccaagaaggagcagagcatgattcgcacgatcgggctgccggcggagacgaaggatggcgagcgacgggtagcgctcgagccgagcgcggtcaagagctgtgtccaggccgggcacgatgtcctcgtgcaggccggtgccggccgtggcgctggctttggtgatgccgactacgaggcggtcggcgcgaagatcgtggccagtgcccaggaggcctggagtgcggatctcgtcgtgaaggtgaaggagccccagcgtcacgagtgggcctacttccggcgcgacctcgtcctctttgcgtacttgcatctggcggccgagcccgaactggcgcgggcgctcatggacgctggggtgcgcgcgtatgcgttcgagacgctcgaggagcgaggcggcttgccgctgctcgcgccgatgagcgaggtcgccggacgcaccgccgccatcgtgggcgctcattacctggcccaagggtcgggcgtgctccttggcggctcggcaggcgttccgccggctcgtgtcgtggtcgtcgggctcggtgtcgcaggaacgatggcggcgcgtggtgcgcgcggcatggatgcggaggtcaccgggatcgacatcgacctgcaccgcttgatggaggcccacgagcgcgggatcgtcacggcgacgctcgcgagttccgagcacgcgatcggtgaggccgtcgccgatgccgatctcgtcgtcggtgccgccctggtgaccggggcgaaggcgcccaagctcgtcctcgaggagcacgtgcgatcgatgcgaccggggtcggtgatcgtggacctcgccatcgaccagggcgggtgcgtcgagaccgcccgaccgacctcccactcgaacccgatctacgagacccacggggtgatccactactgcgtgacgaacgtgccgggccagtacccgcgcaccgcgtctcgcgcgctcagcgccgcgatcgctccgaagctcgtccgcctggccgcgaacctggatgaccccctcctcgcgaccgcgctcaacgtcgctgacggtcgggtggtgcacccgacggtcgccgatgcccttgggctctagtgtcgctgcccgcacccagcctctggctgcgtgagctcggtcgcgaccgttggcgtccgcagctcgatggatccctcgaggcggacgtcgccatcgtcggcggtggcttgagcggcctgtggaccgcacacgcggtgctcgacgctcgtccgggcgcctccgtggtggtgctcgaggccgagcgggtcggctggggcgcatccgggcgcaacggtggctgggcgtcggcactgttcccggtgagctggggtacggtggcgcgcagcttcgggccggagggggcacgggcgttgcgcacacgtctcgtcgagaacctcgacgagatcgaagccgccctcggcgatgacgccgcggacgtggagtggcaccgagccggcaccgtcgtggcggcccgaagcgaggagcagtggcggcagctggtggccgatgtccgggaggagcaggcgctcggccttcgggaccctggggtgctcctcgacgcgcgaggcgtgcgggctcggttggcgatcgacggcgctgtcggcggagtcttcgagcccgtgtgtgcctcggtgcaccctgccaagctggtcgagttgctggctcggcgcctcgagcagcgtggaggtctcgtgctcgagcggagtcgggtccactcgggtgcacccggcgtgctcgtgggtgtcggcggtcgcgtccgggcatcgcaggtggtgtgggcgacggagtcctacagcgccgccgaaccgcgctggcatcgggcgctcgccccggtggcatcccagatcatcgcgacggcaccgctctcggcggcgcagcgtgagcgcctgggcaaccccgaggcagggctcaccttctccgatggtcggcgtctcgtgatctatggtcaactgcgagccgacggtcgggtgatcttcggcggacgaggcgcgccgtatcggttcggctctggcgtcgagttcgcgaccgaggtcggcgcgaggatgcgcctcggcctcgccgcgacactcgcggagctgctgcgtgaggccgggcccatcgagatcgaggcgtcgtggggcggtaccatcggtgtctcgcgcgattggtatcctcgggtgctgcacgatccgagcgagcgcatcgtcttcgtcggcgggtatgcaggcgacggcgtcgcgatgacgcgcctcgcgggccagctcgcggcggcgtacgcgactggggtgcggctcgatccggacctcgccgtgatcctcggccgaccggtgcggcggtgggagccggagccgatgcggtggcttggcgtgaacgttgggctcggactcacgcgactcggcgatgcgctggagggtcggccgcacgcgcagcgcgcagtggacgtgctccgaggagcagtgctcggtcgttagcgttcgctgcgatggtacgtcgtaaggtggagcgagaccgcccaggtgcggtcaagacgagaaggaggcaaggcgatgggccgcttggcaccggtgtggagcaaggtgtcgccgatcacggtcacgcatggccgaggcgcgcgtgtgtgggatacgaacggtcaggcatggcttgacatgacggctgggatcgccgtgacctcgacgggtcacgcgcatcccaaggtcgccgaagccatcgctcgtcaggccgagcgcttcatccacgcgcaggtgaacatctacactcacgacctcttgcaaccgctcgccgatgccctcgatgcgatcacgcccgacggtatcgacacattcttcttctcgaactcgggtgcagaggcaaccgaggcggccgtcaagctggctcgccaggcgaccaagcgccccaacgtcatcgtgttccaggggagctttcatggccgcaccgcccaggcgatggccatgacgacctcgcgcaccgggtaccgggccggctacatgccgctgcccgctggcgtcttcgtctcgctgttccctggcttcccgcgctcgagtcgggtgggtgacgaggtgagtgtggacgaggcactcgactacctcgactacctgctcgcgtcgcagacggcgccggccgagaccgccgccgtggtgatcgagccggtgctcggcgagggaggctacatcccggcgccggcggcgttcctcaccggcgtcgtcgaacgcgcccgggcgcacggcatcgtgttcgtcgccgatgaggtgcagaccggttttggtcgtaccgggcggatgttcgccgtcgagcacgccaacgtcacgccggacatcctcgtgatggcgaagggtatcgcgtcgggatttcccttctcggggatcggagcatcgtgggagctgatggagcgctggccggtcgggagccacggaggaacctatggcggcaaccccatgggcgtcgcggcggcgctcgcgaccatccaggtgatccaggaggaggggctcgtcgacaatgcggctcgacgtggcgcccagctgcaggcgtcgatggagcgcatcgccgagaagttcgagtgcgtgagccgagttcgtggcctcgggctgatggtcggtgtcgagcttcgtgacgacgcggggcggcccgatgcggacctcgtcggccgagtgctcgccgagatgcaggcgagccaccgcgtgctcgcgatgagtgctggcaccttcggcaacatcatccgctggatgcccccgctcgtggtgagcgaggccgagatcgacgaggccgccgccgcgttcgaggcgtcgctggcccacgtgctcgcacagcggtaggagcgtcctggtcgggaggctctcggtctcccccgaccgcccccactcgaagtgctcgagcgggggcggtcggccaggtgcaggtcaccgcggtcgggcgccgtggccgcgccccgcgcgcgcggccgcgaggcgtctagccgttcgcgagtgagggacgcacctccgcgacgacgaagtcgcgagcggtgccctcgaagtagcgctgtggcggccggagcatgtcgtagaccaagcggtagccgtcggacggcgaggctgcctggccgagctggtggttgaagtagaagaagtccgtccagtcggagttgatgtccagctccatcgcgttgaccgctccgacgcgcgcgaggaggcgggcgagcgacgcgaccgacaggccgggacccgtcacgtagacgagcgcgccgttacgggtgatgccaacgccggagcgccacaccaacagctggttcccgaccgtcgcgccccagatggcgaagttggtcgagttcacgagtggattgatgcgcccgttggagatgagcgggatcaggttctgtcgaacgaccgcgatccccttgggcacatggttgccgtgcgtccaggtctcgatggtgggcacgccgctcgtcgagatcacgaagctggcggcaccgttgcgcaagggaaccgccgtgcggccataggcgtagtacccgccgttcgcgtcttgcatgcgaaagccggagttgaaggcggcgacgagatcggctgcgaccgggttcgtgatcggtgccatgtagggccaaggaccgccaccaggcggttcctgggcacccgcatactggatgaagcgcaggagccgagtgtccatccaggcgaccccggcgaccagcgaggtatggatggggtccgggcgcatgagggtgacgtagagggtagggacgccattgacgagcggcccctccggggtccaaacgccctcgttggcgagcggcggcttggcgaacgggatcacacgggccggtgccgggagcggccccgacgcggttgcgtcgacgtggccgaccggtgtgagcgcgtgacgcggtggcttcccgcccgtcggcggttggttgatggcgtaccaggtgttctcgagaaaggcgacgaagctcgcgcccccgtgtccgcggacccactcgacgaacttcacgccgagcgacgccgaaccgggcatcgtcacggtgccgatgccggcccaactcgccatggcgaggacgacgacgagcacgacggcgcgaaccagacggaacgtgcgcgagcggcgacggcgaggaagccgctcgatgcgggggcggctcggcgcggatcgttggacggtactcacgaaagctccttctgtcgcaggggggtggcgaacgaaacggctgcagtcacggtagcagtggggagttcgactcggaagcgggcgccaccgaggtcgctgtcgaggacgcgcacgcgacccccgagcccgacggcgacgcttcgtacgatggcgagcccaaggcccgtaccgccgtcatgacgggcgcgggccgtatcgagccgcgcgaagcgctcgaagacctcgtcgcggcgatcaggagggatgccgggtccgtcgtcgtccacatcgagcgtcacgccgggcccgagggagccggtcacgagcgtggacgtccgaacccgaacgcgagaggtcgcgtgtcgtgcagcattctcgagcaggttgcgaaccagcgaccggagcaactctggctcggcagcgatcgtggcatgcacatcggtagcgagcgcgaagctcaggcggggattgaggcgttcgaggcgagcgacctcgtcctcgacgacaccgaccaggtcgagctccgtggaggcggggcgtcggggtccggtctcggcgcgcgcgaggaggagcaggctctcgatcaggcgctgcatgcgatccgcctcggacagggcgatctgcgtcgattcgtcccagtcggtgatctccgggtggagcgcaccgacctcgagggtggtgcgcagcgccgagagcgggctcttcagctcgtgcgacgcgtcctggatgaactgcttctcgcggatgagcgcgtgttcgagccgtgcgagcatggcgttcatcgtctgtgccagtcgggcgatctcatcgtcgcccggcggttcggtgacgcgctggtcgagctgcgacgaggtgatctctgcgacgtcgctgatcatctggtcgaccggtgccagcgctcgcctcgccagccaccacgtggcgctggcgacgacgaggagcacgagcggatagacgacgtcgaagatgtgcaccaaggtcctcgtcgcctgatcgacactggcgagcgaggcgatggtgaacacgtagtaggtctcgacgccggagctgccgacctgggcaggtacggcgctgtgcgcgagggtcgctgctgcgcgtgtggtcagcgcgatgggctcggcgacgagcaccgatcggatgtcgatgtcgtggccgaccaggatcgaccgcgccttgctcgtcgcccgcgtgacgacgagaccggcgggtgggacgtggtgcggattgacgagtggggcgacgccacggaggttgggggtcgcagcgacgacctgcccggtgctcgagacgatctgggccgcaagatcgccgcgcgggagcgggagcggtcgaggcacgtcgccgttgcgcacgaggaggacgatgtcgtaggcctcgctacgagcggtctggacgatccccctcgtcagggcggtacggagcacgagcacggtagcgacgaggcttgcgaggagcgcgagaccgacggcgacggtggccgcgacggtggtgcggaccaccaccgacgcagcgaggcgaccgaagaaccgaacgacgcgccaacgagatcgtgcgagacgccccaggtatccgagcgagttcagccgcatgggccgcggtcactcactggcgctcgacgccatcgcctcgcttctgccaccatcctcctccaggcgatatcccacgccgcggatggtggtgattgccttcgtgccgaacgggacatcgatcttcttgcgcagatacccgatgtagacctcgacgatgttcgagtctccctcgaaatcgtagtcccacacatgggcgatgatgtcttgcttgcgcaggacgtggcccttgttgcgcagcaagagctcgaggaacgaaaactcgcgggtcgtcagatcgatggtcacgttgccgcgcgtgacacggtgactcgctgggtcgagggtcaagtcgccggcctggaggatgggtgggtggctctcgacgttacgacgcaacagcgctcggatgcgcgcgacgagcacggtgaacgagaacggcttcttcaggacatcgtcggcaccggtgtcgagcgcctcggcttcgtcgtattcaccgtccttggccgtgagcatcaagatgggtgtccagttgcgctcctcgcgcaggagttgcgtgaacttgaacccgttgacaccgggcaacatgatgtcgaggacgatgcagtcgtagggggcatggcgcgccatgtcgagccccgtcgtgccatcgctcgcggtatcgaccgcaaagccttcagcgctgagcccgcgcttcaagctggcgagcaagttttcctcgtcgtcgacgatgagcagtcgcatgacacacctcccagcactcggaccctacgaggtttgctcggggctcgcctcaagcgagtccgaaggtttcctgagagtctgccgatccgagctgctcgagacgcggcttacgtgagcgtgggtgcgtgggcaggccgagactggtgccgacgccgacgagcgcgacgatgcgttcgtggacagcgagttcaagtgcgctggcgaggaccgggtcgcgggcgaggcgccctgttcgccacatcgagccgtacccgagtgcccgcagggcgagcaggagatacccggtcgcgacgacggcggcgtcacgctgctcctcgacgctcgtgcgagcggcggcgtcggggctcgcgatcaccgcgacgaagagcggcgcacgggagaagctcactcgagcacgtgcagcgtcgtcggggcgttcgagttcgatgtcggcgacgatcgccgctgctgcgtcgggccagatcgcgaccatccgatagggcgtgagagagcgatgatcgggtgccgtcgcagccatctcgatggcgaaggcaagctcggccgccgagggcgctggcggcgcgagcttcggttcggagcgccgggtcgccatcacggtcagtgccggtgcgcgtcgagcaagctcgagcaggctgtcgtcgctcaccagccacgctcgatccaggtcgcgagggaagggcgctcggccccgacggtcgtgatgcgcccatgtcctggcagaaggacgcacggatcgggcagctgttcgaacagttcggccgagatcgagtcgatgatcgtccgaaagtcctggggtgagccggtcttgcctggaccacccgggaacagcgtgtcgcccgtggcgcacagtgacgtgccgaatgcgaagcagaccgaccctggcgtatggcccggggtgcagatcgcctcgatcgtgacgtcgtcgatgacgagctgctgcgatgtctcgatgcgatgggtgacccacggggcatcacggccgtcggccgcacccatccagacactcatgcctcgcgccgcgagtgctggagcggcgccaatgtggtctgcgtggccatgggtgatgaggagagaggtgatcgatcgttcctcggcagctcgccagagcgtgtctggatcgctcggggcgtcgatgaggacacctccgcccggccaggagcacagccaggcattgttctcgagtggtgccaggacgaagcgctcgacgaccacatcgtcgagcgtgatgaccagctctggagcgcccacgtggcgggagcctagctggttcgcctggatctgggggacgggctcgtgcgcgcctcagcgtgcggcgaacggtggtgggtacactggaaacgggtcgtcgtgacggacgagtcgtgagtgaggggaccgaaggtgagacgtgtccggcgctcgggggagtgggctgttccggtcgcgaaggacgaccgggatcgggctcgagcgattctcgtcgaacgtctgcgttcgggcgcgatgggattcgatgagtacgagcgtcggctcctcaaggtcgagcgagctgcctcggtgccggctctctacgacgcaaccttcggtcgagcgcgactccccttcgggggaacgaggtggcgccgacgacgtgtccggctctcggtggtcgggctggtgatcgcggctgcggtcggggcgctcgggttcatgtggatcgggttcctcgtcgctgccgctgtcgtgctcgtcgctgtggcgggcgtcaacctcgcggtctgggtgcaggcccgcaggtacccccaacggttcgaccagtccgtgggcggcacgtcgcgctagccgggtgcaccggagggagccggtcgacctgcgttgcgcagccgatacgccgattggatcgatgcgccgcttgggactgcgtcgatcggcccggagcgagtcggtgaggttggcttcggcgtcgcggccagatagcgtgcggtcggtgccatcgacgcacgaggtggctggccagaagggagcggtcaatgagccaacactggcatgaggtgcaagacgagcttcgcgacccggtcaaggagctccgtgcccagatcccagagacgtggcacgcctatgcgacgttgcaccgccatgcactcgaggccggccacatcgacgccaagaccaaggagctgatcgcgctcgcggttgcggtgacgacccagtgtgacggctgtatcgcgtcgcacgcgcgcggtgcggcacggcaaggcgcgaccgctgaagaggtcgcggaggcgctcggcgtcgtggtcttgctcaccggcggccccgggaccgtctatggcccacgcgcctatcaggcattcctcgagtttcgcgaggactatcgaaccgctgagtgagccacggcctggacgacgagatcgacgacgtcgatcccagcgcgagcgagtgttcgtgctccgacgacatcttcgatctcattgaccaccacgtcgtcgtcgtgctcgaagaggtcgatgccgtagtagccaggtccgatcagacccatgacacgggtagcgaggcgatgggactcgcgagtcggtgtggcgaggtgtcccgatgctccacggctcaggttcgcagccaccccgtcggccgcgcgtcgctcggtccatgctgcgatcgtgctcccgacgacgtaggcgcgcaggacgcgctcaccgccttggacgaaggcttgggtgatccacgcgtcgagatcgcacctgggtggtgcggctgccgggacgatgcgcacgccgtggccgccgtggcccgctcgaggtttgacgacgagatcagtggccgagaaggcgcggtgtgcgagccacgagggcgtcgttggtggtccggggagctcgtgctcggcgagccaccgggcggtcgccagcttgtcgttgccgatgagggccagaagcggtgggttcaccacgaccgggagccggtcggcgagccagcgacgcagctcgcgatcgcgcgagcgggcgatcgcgatggcggtgtcggcagccaacgccgggcgatcaccgggcccgaccatgcggagcgagcacgagccgaagtgtcgctcgagcccgtcgcggagcgcgcgtgcaaagtgcacgttgcgcgccagggaccatggatcgtaacagaggaggacgcggctcatcggctggggccgaggagctggtcgagcaccgcggctgcgacatcgatgccggtgatggcactgaggcgccagatgtgtgcgttggcgttcacctcgcagacgatcgagccctcgccgtcgtcgtcgatgagcaggtccacgcctgcgttctcggcgcccacggctctcgcagcttcgatggcgagcgtctgttcgcgccgggagggccagtacggatagcccgcgccacctgccgagagattggctcggaagtcgtggcgctggcggcgctccatcgcagccaccacgcggtcgcgagcgacctggagccgtcgatcgcgaccacgcgacgatgcgatgaagcgctgcaccaggaggcgacggtccgcgagtgccgaggcgatgtcgatgagatcgtcgagcgtctcggcgaggtggacctgcgatccgaacgagcccttggcctccttgacgacgagggggaggcccacgtggcgcaccgtggcctcgagtacacccgggtcgatgggctgcttgggatagagcggcggtaggagtacggacctcgggaccgtgaggccggcgccgacgagacgtgcatcggtgcggcgcttgtcgtcgcaggcgaggatggcctctggcgagttgaccacctgcgcgccgtcagtgcggagcgcctcggcggtggaggcgtccttgtcgagcatcagcacgaagcgtgcatgcggcgggtcgtcgagccagatggcctcgcgcgagagatcgaggacgccgacatgcggtgttcgctgacgcgcagcgtggaggtagaggccagcgttcgcgcggaatgctgggccgagtccaaggttcgccacgaccaggatgtccagcgggcgcgtacgatggcttggcgccgggtgcacgcgcagagtctacgggtcgcggtgacgggaggacgtgtgggggtggtgagccgagacgacatcctcgacggacgtgtcgtcctcacggcctcgggagggctcgacgacgtcgaggaaggcgtgacggtgctcgccctgttcggtgccaccgaggccgtggggggtggccctcccgtcgaggtgctcgggggcttcgccgatcgtcttgcggagctgtcgcgccgaccggtggtcacctttgcgccgcgaggactcgatggcggtggtgcgttccgagagcgagaagcgctggcggatgcacggcgtgtcctggccgaggtcggagggcctgtcgtcgtgctggcggcgaccgtggcagccggggtcggcgttgcactgggccgcgacgagcgggtcgtgggggtggcgctcgtcgacccgtggacgatcggcgaggcggtcgccttcggcgtgaacctcgacacggatgcgagcatcgatcaatccggcgatgcactggcctgcgcggtgctcgtcgtcaccgaccacgagcgcgacgtcggtgcgatcgagacgatcgcacccgaggctgagatgcatcggctctctggggccgcgcgcagcttcgtgctcgatgcgcgcgtcctcgccatcgtggcgggctggatcgagcgggccccgtggtctggggaggtcgcctcgcccgaggcctagagcacgggcgtggaggatcggcggttgtgcgtgagagtggcggcgccgggtgtgccccagctcggctgttcgcgcgcgagctcgatggcggcgcgaaggtcgtgcgctgcttgcctcgggtccggggcttccgtcagtgcccgcacgacgacgaagcgccgtgcacccgccgcgacgagcgctggtatggcttgagccgtgacgttgccggtgatgaagcggggtcgagcctcggctgctcggtgtgcgaaggcgacgtaggagcggccggtgccggggcgccctggcttcgtcggtgtgggctcgaccggcccgacggagaggtagtcggcaagtggcgaggcggcgttgaactcggctggtgcgtgcgtcgacaagcccacgattctgtcggggccgacgagggaacgaacggtgccgacgtcgaggtcgtcttgaccgacgtggaccccgtcggcgtcgctggcgagtgcgatgtccggccgatcgttcacgatgaacggcacgccgcgccgcgcaaggagccgggcgaggtctcgagcggcgcgaagcacgagtccatcgggcgcgtccttcgcccggagctggacgatgtcgacaccgccgcgcacggttgcgtcgacgaacgcaagcaggtcacgccgcagcgggacgcacaggtacaggcagcggtccccgagcgacctcgtcactgccgcgccttggcgcgagcggccttgaccgccgccttggtctcacggatgcgctcgatggcttctggcgagacggcgtcggcgaccgagcgaaagctgccgggctcgccaaagggctcgctctcgcgctcccacccgtcgggacgaacgccgaagcgcttggcgagcagggcgaggtagatgcgtgccttctcgtcgccgaacccaggcatggcctcgatgcgccggcgcagctcggccgcgtcgcgcacgtcctcccagagtgcggtgacatcgccggcgtaatgctcgcacacgctcacggcgagtgcatggatgcgcttggccatcgaggtcgggaatcgatgcagcgctggcttggtggcgacgagtcgtgcaaggtcctcggggtccatcgccgcgatcgagcacgcatcgaacgtgcgaccgagcgcacggaggcgctgctccagctcgagcggacctcggaaggctcgttccatcggtatctgctggtcgagcagcatgccaacgaggagggcgaagtgatcggtggcgagcagctcgttggcgcgctcgtcgtcggtcaggtagagctcgatcacgcttgctccttcgacgggaccgtatgagtggcgtgccctcgagcctacatggtcgggtcgaagcgctcgggtgagactccgtagtgcgcgagcgcatcgtggagttcctcgggcttcgcctcgccgatgcgcacgagttgcgcgatcgcggcgacgacgacgtgcgccgcgtcgacctcgaagaagcgtcgaagcgcctcgcgcgtatccgagcgaccgaagccgtccgtgccgagcgcgaggaaaggtcgatcgacgaagttggcgacctgttcggcgacgagccggacgtagtccgtggtggcgacgatgggcccgctcgactgggccatgagctcgtcgagccacacgcgctggcgttcggtcccggtcagtcgctccgtgcgctcggcctcgagggcgtcttcgcgcaagcgcttgtacgacgtgatcgagaatgcggtcgctgccacgccccagtggcgagcgagttcgctctgggcctcgagcactgcccggtgcgcggttccggagaagaacagcgtcacgggacggcgccgatcgcgaggggtcgctgccgagatcggctcgacgtcacccatctcgggggcaggacggaagagatacccgccgcgcatgatcgcctcgaccagtgccgctcgctcgaggtggtcgggcgcgggcggcatcgggtagttctcgttgtaggtcgtcaggtagtagatcacgtctctcggctggggaccgtacatgtcggcgatcccgtgctcgaagacggttgcgatctcgtaggcgaacgctgggtcgtaggcctgcacgttggggaatgccgccgccaggagcagcgaatgtccatcggtgtgctggaggccctcaccgaggagcgtggtgcgccccgccgtggcgccgacgagaaagccgcgcgctcgtgcgtccgaggccgcccaaagcaggtccatcgtccgctggaagccgaacatggagtagaagaggtacaccgggatcatcggaacgccgagcgttgcatacgacgtgccggccgcggtgaacatcgccgtggcaccggcttcggtgatgcccatctcgaggatctggccgtcttgtgcctcggtgtaggacagcaagagcccggcgtcgaccggcgtgtagagctgtccgatcgacgagtagatcttggcctctcgaaacagcgcttcgagaccgaacgtccgcgcctcgtccggcacgatcggcgcgatacgggatccgacctgtgggtccttgatgagcgatcgcagaatgcgagccatcaccatcgtcgtcgacaccgcttgggcgccagagccgtcgtagaactcggcaaacgcctcgctgctcggcgcagggaggctccgtgcgcgttcgacgcgcttcgggaggtagccgccgaggacgcggcgccgtgtgtggagatactcctcctcgatcgagcccggaggaagcgtgatgtagggcggatcctcgcccgcaagcatctcgtccgagatcacgtcgttcaggtggaggcgatcacggaactcgaggagctgctcccgggtcatcttcttgatctggtgggttgcgttgcgcgcctcgatgtccgggccgagcgtccaacccttgatggtcttggcgaggatcgcggtgggtgaacccgtgtggttcaccgcggcgtggtaggccgcgtagagctttcggtagtcgtgtccaccacgagggagcgcctggagctcctcgtcggagaggtgctccacgaggcgacggaggcgtgggtcgggtccaaagaagtgttcgcgaatgtaggcccccgactcggtcgcgagcttctggaagtcgccgtctggcgtcgtgttcatcttgttcagcagcaccccgtcgacgtcccgggcgaggagctcgtcccacttcgagccccagatcaccttgatcacgttccagccggcgccgcggaaggtcgcctcgagctcttggatgatcttgccgttgccccgaactgggccgtccagacgctgcaggttgcagttcacgacgaagatgaggttgtcgaggtgctcgcgtccggccacaccgagcgctcccaccgcttcgggttcgtcgagctcgccatcgcccacgaacgcccagatgcgactggaagcggcctgggcgagcttgcgattctccatgtagcggttgaacatcgcgtggtagatcgcctggatgggcccgaggcccatcgagaccgtggggaactcccagaagtccggcatgagtcgcggatgcggatacgacgacaggccctggccaccgacctccatgcggaagtgattcagctgcgcctcggtgaggcgtccctcgaggaaggcgcgggcgtagaaacctggtgaagcatgtccttggaagtagacgaagtcgccggggtactcggtgtccttaccgcggaagaagtggttgaagccaacctcgtagagagctgccgagctcgcatacgtcgacaggtgcccgccgatgccgtccgcggcatggttcgctctcgtcaccatcaccgcggcgttccaacggatgaacgcacggatcctgcgctcgatggcctcgtcccccggaaaccatggctcgttctccggtgcgatggtgttgatgtagggtgtcgagaccgtcgcggggaagccgacctggcgctccctcgccgcttcgagcagcttcatcagcatgaaggtggctcgctggcgacctcgctcgtcgacgagtgcgttgaaggagtcaacccactccgccgtctcgtcggggtcgatgtcggggatctgatgtgcgaagccgtcgatgatcacgcctccattctgacagctcccgatgtcggtgtcgactccccgctagcctggcgcggatggccgtcgagcgtctcgtctacaccgatggagcctgtttgggcaacccgggtcctggtggctgggcctggttcgagcctctcacgggacgtcgagcgtccggctcggaggcgcagacgaccaatcagcggatggagctcaccgcggtgcttcgagcgctcgaggcagaccccgcgcccctcgtactcgtgcgctcggactcgcagtacgtcgtgcggtgcttccaggagcggtggtgggcacgctggcggcagaacggctttcgcaacgccaagggccaacccgtgtcgaaccgcgacctgtgggagctcgtccttcgtctcgtgctcgacgagggccgcagcgttcgtttcgaatgggtgcgtggccacgctggcgatcctgggaacgaggaggtcgaccggctcgcccaagctgcggcccgtgcggtggcgcgcggcgtctgacgggtgcgccgacgacctcgtcactaaggtggcctcatggagctgcgtggatcgtcggtggtggttacgggaggcgcctctggtcttgggctcggggtcgccgagcgcttgatcgggcgaggtgcccatgttgtgatcgtcgaccgcaatgcggaggccggggcggccgttgctgcgcgactgtccgccgagttcgtcgaggccgacgtgacggacgaagagcaactcgctcgcgcgttcgaccgggctgcagcgttggggccagtgcgtatgggcgtggcgtgtgcgggcatcggaattgccgagcgtgtccttggccgctcgggcgagccgcatcagttggcgtccttccaacgggtcatcggggtcaatctgatcgggacgttcaacctcctccggctcgcggctcgcgccatcggagcgagcgagccggccgatggcgagcgcggggtgatcgtgctgacggcgtcgatcgcggccttcgatggccagatcggccagatcgcctatgcggcctccaagggcggcgtcgtcggcatgacgttgccggccgcacgcgatctcgcgagcgcgcagatccgggtcgtgacgatcgcgccgggcatcatggacacgccgctgctcggtcaacttcccgaggaggtgcgccgcgacctcggcgcgtcgattcccttccccaagcgactcggccaaccagccgacttcgcgcagctcgtcgaggcgatcgcagagaaccactacctcaacggtgaggtcatccgcctcgacggcgcgctgcgcatgccgcctcgatgaaccggcgcgcggagtcgtcgatcggctgacctaggctggttcgcgtgcgctacgtcgaggcagccggactcaaggtgtccgcggtcggcctcgggacgtggcagttcggctcgcgagagtggggctatggggaggcctacgccaaccacgatgctcgcttgatcgtcgagcgggcgctcgagctcggcgtcaccttgttcgacacggctgaggtctacggttcggggcgctccgagcggatcctcggcgaggcgctcgcgtcgtcgcgggccaacgtggtcgtcgccaccaagtacgctccgacgctgccgatcccgggcagggctgctcgccacctccgcgcctccgcccagcgtctcggtcgtgacgccatcgacctctaccaggtacacttcccgaatccactggtgcccacgcaccagctgctcgaggaactcgaggccgaggtgttcgctggtggggctcgtgcgctcggggtgtccaacttctcgttggcggcctggcgcgccgccgagcgaacaggtcacgtcccgatcgtctcgaaccaggtccacctgtcactggtggtccgccgcagccttcgggagttggtcccgtgggcccaggccaacgaccggttggtcatcgcctactcgccgctcgagcagggactcctggcagggacctacacaacgacgcatcggccgaggggtgtgcgtcggctgcggcgcgccttctcgccgaccgggctgctccgggcgcgtccagtcctcgacgagttgcgacgcgtggggactcgctacggtgcctcgccggcacaggtggcgctcgcgtgggtgctgtcacacccgaacgtcgtggcgatcccgggcgcgtccagcgtctcccagctcgagcacaacgtcgaggccggggcgctgtcgctcacgaacgaagacgtcgtccgtctcgaggcctctgcgcaagcagcgtggcccgtcaggtgagtgcatcggtgcggcggcgaggaattgtgtggacgttgactgcctggtagaaacctgtatcggaaggagtggaacgaacggtgagtgactcgacctacgacgtcgtcatcctcggtgcaggtccagcgggctacgctgcggcgctctacgggggatcggctggcctcagcatcgccatcgtggaacaagatcgcgtgggcggtacgtgcttacagcgagggtgcgtgccggccaaggagtttctcgagacagcgaccgttcggcgcacgatcgaagcggcgggagcgttcggtatcggtgccacgtatacgggcctcgatttcgcgacggcgcaggcacgcaagcaggacgtcgtcgccaagctgaccggtgggctcacgggactcatgcgttctcgcggcaacaccatcgtcgaagggcgcggtgtctatcgtggcggcggggtcatcgaggtcggcggcgagcggctcgtcggcgaaacggtgatccttgcgccgggatcggttccaaggaccatcccgggcttcgacgtcgatggtgaggtcgtcctgacctcggacgaggtgctctcgctgaccaagctgcctgacagcgtggtcatcatcggcggaggcgtgatcggctgcgaattcgcctccatgatggccgatctcggcaccaaggtcacggtggtcgaggcactcccgcaggtcctgcccggtgtggacccggatctcgtcggtatactgctccggagctttcggcgtcgcggggttacggtgcggaccggagtcggcgtcagcggcctcgaccggaccggttcgggtgcggtggttcgactcgccgatgggacgcaggtcgaggccgagcaggtcgtggtggcggtcggacgtcgtcccaacaccgacggggtcatcgaccctgcgagtggtgtgggcctcgacgagcgagggtttatcaaggttgatgaccagtatcggacctccgaagcgggggtgtacgccatcggtgatgcgatcgcgacgccacagctggcccacgtcggctttgccgagggggttgcggtcgtcaagtccatcttgggcgagatctccccgtcggtcgagtacgacaaggtgccctggtgcatctatacccatccggagatcgccttcgcgggtctcacggaggagcaggcccgggcccaggggcgtgacgtgatcgtcaagaaggacccgcttggtggtaactcgcgcgcccgaatcctcggcgagaccgatgggatggtcaaggtggtagcggaccgagcgacccaccagcttctcggcgtccacatcgttggcccctgggcaacggagctcctgtcgcccggctacttggcggtcaactgggaggcctcggcggaggaggtcgctgcgttcttgcagccccacccgaccttgtccgaagcgttcggcgagactgtcctcgcactgactggaaggagtctgcacgttggctgatgtcacgcttcctcaacttggcgaaaccgtcaccgaggggacgatcacgaagtggctgatcaaggtgggtgacaccgtcgagatcgaccagccgatcttcgaggtctcgaccgacaaggtggattccgaggtcccttcgcccgtctccggggtcgtcaccgagatcctcgtccccgacggtgagaccgtggacgtggggacggtcctgtgccgcatcgaagccgcggcgtcggctgcgtcggcatcatcggggccctcgacgcctccagccgcacaggccgctccggcgccacagcccgcgtcggcgccacagcccgcgtcggcgccccagcccgctccggcgccacagcccgcgtcggcgccccagcccgctccggcgccacaggctgcaccagtgccccagcccgcaccagcgccccagcccgcgccggtcgcgatggcaacgagcaccagttcgcagccagccccgagcacgcctcctgctccatcagcgcccgtgtcgccgtcgccgagcacggtcgaggccaacggcgtcgccgccggcagcggtcccgaacgagacctcgatggcctcctgctctcgccggtcgttcgtcgtctcatcatcgacaacggcctcgacccgcgagacctccacgggaccggcgtcggcggacggatcacacgaggcgacgtcctgcgcgccctcgacgagcgggcccggtcggctgcgggatcggctccaccggccacgagcgagccggccccctcggtcgccaacgagccggccccctcggtcgcccgtgaggcagcgccgcagccgacggccgcgtcggcgcctgagctctggtcgccgagccaggaaccgacaccgagcaaccgtgcccagcaggtcgtccccgtgtcggccatggagccgagcgaacgtgattacgtcgtgccgttcacgaacattcgacgccgtaccgccgagcacatgatccgctccaaggccacctccgctcatacgctcatgtcgatcgaggtcgacttcgagggtgtcgagcaggtccggcgacgtgtgcgtgagtcgttcgctcgcgacgagggtttttcgctcacgtacctgccgttcgtggtgcgagcctccgtcgaggcgattcgcgcctaccccaacatcaacgcctcggtgctcggtgacgccctcgttgtgcatcgggacatcaacatcgcgatcgcggtggatctcaacctcgaggggttgatcgccccagtgatccatggggccgacgccatcagattgcgcggtatcgctcgcgcgatccacgacctcgctgcccgagcgcgcagccgcaagctgagcgccgacgacatcgccaatggcacgttcacgatcacgaacccgggtccgttcgggaccttcatgaccggggcgatcatcaaccagcctcaggttgcgatcctcgcgaccgacgggatcacccgtcggcccgtggtggtcacggatgcccatggagcggagtccattgcgatccactcggtggggctgctcacggtcaacttcgaccatcgggcgatcgacggcgcctatgcggcggcgttccttgcgaaggcaaagcaggtgatcgagcagacggcgtgggagcaggagctgtgagcgacaccctgcgcgtccggtggctcgggcgaaccgattacgacgacgccctcgagctccagcaccgcctgcacgagggaacggggtcgtggttgctgctcctcgagcatccgcacacctacacgatgggggtgcgcgcgaagcgcgagcacgtgctggtggaccctgccgatgtcggagcacggctcgtgtggaccgatcggggtggtgacgtcacctaccacggacccggtcagctcgttgcctaccccatcgtcgacgtgccggtcgagcccgactcgacgccgcgctacgtccatcgactcgagcaggtgctgatcgagaccttggccgagttccagctcgctgcgttcgcgttggacggctacccgggcgtgtgggtcgacgccgcggcaccgcgcaagatcgcggcgatcggcgtgaaactcacgcggggtcgttcactccacggcatcgcgctgaacgtcacgacggaccttgggatgttcggccatatcgtcccctgcggaatccccgacaagccggtcacgtcgatggccgccgagggcgtcagggtgagtgtggaggacgtcgcgcgggtctttgcccgacgctttgcagtgacgttcggactcgaagcccgaagtgccggtgtcgactggccggtcgcccagccggcgtcgtccgagtcggccacctcgccggtcgagcggcgcttgcaacgggccggcgtctcgctcggcgaagcggttccgttccatgcgcgcaagccggcctgggttcgaccacgtgtccgtcatgggagcgaggtcctcgaactcaagcgtctcgtcggccaactgtcgctcgtcaccgtctgcgaggaggcggggtgccccaacctctcggagtgctggaaggatgggacagcgaccttcatgatcaacggcgagcgttgtacgcgtgcgtgcacgttctgtctggtcgacacgagccatccgctgccgctcgaccccggcgagcccgatcgggtggctgctgcggtggccgccctcgacctcgagttcgcggtcgtcacggccgtcgctcgtgacgacctggccgacggcggtgccgaggcttttgcgcgaacgatccgggcgatcaaactggcgcgtcccaccacgcgagtcgaggtgctgatcccggacttcaagggctcggcggcggcgctcgacaccgtgctcgaggctggtcccgatgtgctcaatcacaacctcgagacggtgcttcgtctgcagcgggccgtgcggccaagtgcgcactatgcccgcagtctcgcggtgttgtcccgagcgcagcgagccggattcgtcacgaagtccggcctgatggtggggcttggcgagtcgttcgacgaactccgtgaggcgatgggggatctcgccgccgcaggggtctcgatcctgaccgtgggacagtacctccgtccgacgcagtggcacgcgccggtcgctcggtactggcatcccgaggagttcgacatgatccgggactacgccaccgaactcgggttccgcttcgtcgaagcctcgccgctcgcacgctcgtcgtaccacgccaagcgcggatcggacgccgcgcaggtccttgcggagcgcgcgtgagcctggtcgagcgctacccggaacgacgtgcggcgctcgtcggcgagctcgtccgcaacggcgtggatgcggcgatcgtgaccatcggaccggagatgccgtggctgatcggctacgaagcgatgccgctcgagcgcatcacggccctggtcgtgcgtgccgatggcacggcggtcctcgtggtgccgcgactcgaggagccgcgggtgcgtcatcgcgacgggatcgacctcgtcgcctggagcgacgggcaagatccgttcgagctcgtggcagctctgctcccaccgacggggcgcatcgcgatcggggagcgcgggcgcgcgggatggctcctcgagctgcagcgtctgcggcccggctgtcggttcgagccggctggtgccctgatcggaccgctgcggcggcgcaaggaccccgacgaggtcgcggcgttgcgagcagcggggacggcagccgaccacgtcgccacggcgctcctggcgggcgagatcgcgctggtcggaaggacggagcgtgaggtgtcgcgcgacatcgccgagcggctgatcgcggctgggcatgcacgtgccaacttctcgatcgtggcgtcggggccgaacggcgcatccccacaccacgagcccggcgcacggcgcatcgagatcggcgacgtcgtggtgtgcgacttcggcggcacgttcgaggtcgacggcgagccgggctactgctcggacaccaccaggacgtttgccgtcgggacggccccggatgggttcgcgtcggtctacgacgccgtgttaggcgcgcacgacgcagcgatcgccgcgatcgtgcccgggatcgtagctggtgaggtggatcgcatcgcgagagagacgctcgtggaggcgggatatgccgagtggttcgttcatcggctcggccacggcatcgggctcgaggaacacgaggacccgttcctcgctcctggggccacgacgacgctcgaggtcggtgacgccttctcgatcgagccgggggtgtatctccccgggaacttcggcgtgcgaatcgaggacatcgtcgtcctgacggaacatggggtcgagcggctgaatcgctcgagcacgcagcggacggtgctcgaggcgcgctgagtcggccgccacgtgcgtcgcggtggcccccgtcgagcaggtgtgcgctcgataggctggcagccatggcacaacgcagtctctcccggcgtgcaacggcgctgggcgtcgtcgtcgtggtcgcggtggtggcgggcggtgccggcgcggtcgttgccacgcgcctctttcccccgaccgtccacctcgatacgccggtgtcccagctcaagccggggccagcgctggccggcggcgtatcgattcctgccatcgtgtcgtcggtcttgccagaggtcgtctcgatcgatgccactggcgatctcatcggcgtgacgaacggcggcccgttcggcctcggtggcggtcagacgggggcggagttcaagtccgccgggaccgggatgatcgtctcgacgagcggcctcgtcctcaccaacaatcacgtcatcgcgggcgcgacctcggtcgccgtcacgctggacggaacgcacacggcgttgccggccaccatcgtgggcacgattccgtcgcacgacctcgcgctcttgcggatcgaccatccgccggcccacctccacaccgtgaccttcggtgactcggctgcactggtcccaggcgatgcggtgatcgcgatcggcaatgcgctcggcctgcaggcgggttcgccgacggtcacgagtgggatcgtctcggccctcggacgggtcgtgacggcgtcgatcccgaccaccggccagaccgagacgctcgacgacatgatccagaccgatgccgccatcaatccggggaactcaggaggtccgctcgtcgactcggctggggacgtggtgggcatgaacaccgcggctgcgggcacgacgtcggacggtacccaggcggagaacatcggctttgcgatcccgtcctcggagctcatcgcggagctcccggtcctcgagcatggcggcacgtcgggagcccctggcgccttcctcggcgtcgaggtcgaagatgactcctcggcgctcgcggctcagttcgggctcccggtctcgcagggggcggtcgtcgtgtccgtcctccctggcaccgctgcggcgcaggctggactgagcgccggcgacgtgatcgtcgccttcgatggacacaaggtgacttcggcggcagcgctcggcgcgatcgaggagacgttgcaccccggcgaccaggtatcgctctcgtactggacgtcgtcgtctgagcgaacggtcaccgtgacgctcgggactcgcccggcgagctgactcgtcgcacgctactcgacgccgacgtctttggcccgcaggtgcatcccttcctgccagcgagcgagcgtccagagggcgtcggagagtcggttcaagtacgcgccgacgtgcgagctgggcgccgatgcgacgaagcggaccgcgaggcgctccgcgcgccgacagacggttcgggcgacgtcgagcgctgccgcggtcggggttccaccgggaacgacgaagtctcgaatcggctcgaagcgttcactgacgtcgtcgatgagccgctcgagccgctcgaccatcgccttcgtcacgagggtttcacccgggacgagcttgcttcggtgctcgggcagcgtggcgacttcggccatgaggacccacaggtcgcgttccagatcgagacagatggtcgcgaggtcgacggctgcactggccctgacgaccccgagctgggcttgggtctcgtcgacggctccgttgagctccacttgcgggtgatccttcggcagtcgaccgccatagagcatgccggtcgtgccgccatcgccgcgacgcgtgtagatcggcgtccggcgtcgtgctgcaccctccacgatccacctccccggtcccggtagcctagttgtcgtgaggacctacgaggagctgctgcgtgagcgtgtcgtcgtgttcgacggcgcgatgggcaccaacctgcagctggccggcctcggcgccgacgactttgggggtcccgcgctcgagggttgcaacgagatcctcgtcgtgacgaggcccgaggcggtggccgcggtgcacgactcgttcctcgccgtcggtgtcgacgtcgtcgagaccgacacgttcggcgccttggcgccggtcctggccgagtacggtatcgccgagcgtgcctacgagctcaaccttcgagcggcccagctcgctcgagacgtcgcctctggctatgcgacgcccgatcatcctcgcttcgtggcgggctcgatggggccggggacgaagctgccctcgctcggccagatccccttcgaggacctgcgagacgcctacgaggtgcaggccgagggcctgatcgcgggaggtgtcgatctcctgctcgtggagacggtctacgacctgctctctgccaaggcggcggtgatcggcgcccgtcgagccatgcgccgactgggccgctcggtcccggtccaggtgcaggtgacgatcgagaccaccggtcggatgctgcctggcacggaggttggtgcggcactcgccgcgctggagcgtctcgacccggtcgcgatcggcatcaactgcgcgaccggtcccgaggagatgggcgagcaccttcggtatctctcggagcatcagcgcgtgccgatctcgtgcctgccgaacgcgggcatgccccacgtcgtcgacggtcacatgcactacgacctgaccccggacgccctggcggcggcgcaccgtcgcttcgtcgacgaactcggggtcgggatcgtcggtggctgctgtggcacgcggcccgagcacctgcgggccgtcgtcgaggccgtcggtgaggcggtcccgagagagcgccatccgacgccacgggcacaggtggcgtcgctctaccaggcggtcgagctgcgacaagacctcgccatcactgcggtgggtgagcgcaccaacgccaacggctctcgccgcttccgcgacgccatgctcgctcgcgactgggacacctgtgtgcgcatggcgcaggatcaggttcgcgacggcgctcacatgatcgacctctgcgtcgactacaccggcgaggacggcaccgtcgccatggaggagctctcgagccgcctcgcgaccgcgtccacgttgccgatcatgatcgactcgaccgaagcggcggtggtggagaccgcgctccggcacctcggcggcaggccgatcatcaactcggtcaacctcgaggagggtgaggggtccaatacccggttcgactccttcttgcgcctcgcgaaggactacggtgcggcggtggttgcgacctgcatcgacgaggaaggccaggcgcgtaccgcggcgcgcaaggtcgagatcgccaagcggatcgttgcactcgcggtcgaacgctacggcttggccaccgacgacatcatcatcgatccactcgtcctcccggtgacgaccgggatggaggagtcacgacgtgacgcgctcgaaaccatcgaggccctgcggcgcatcaccgccgagatgcccggcgtctcgacgctggtcgggttgtcgaacgtctccttcggtatcaatgcggctgctcgtgaagcgctcaacagcgtgttcctcgccgaatgccaggcagccggcctgagtatggccatcttgcacccctcgcggatccagccgctcgctcgcatccctgaggatgtgcgcgcgatctgcctcgacctcatctacgatcgccgcggccagggcgacccgcttgcccgcctgatcgagcgcttcgcggacgtccaggcggtcgcggtcacgggcgaggagctcgaggccctctccgtgccggaacggctgcaccggcgcatcgtcgacgccaatcgtcagggcctcgaggatgacctggccgccgcgctcggcgagggcatgagcgcgctcggcgtgatcaacgacgtgctgctcccggcgatggccgaggtcggcgacctgttcgggtcgggccagatgcagcttccgttcgtgctcgcctcggccgagacgatgaagcaggcggttgcatggctcgagccctacctcgatcgcgcatcggtgaacgatcgaggcaccgtcgtgctcgcgaccgtccaaggggacgtgcacgacatcggcaagaacctggtcgacatcattctcaccaacaacggctatcgcgtggtgaacctcggcatcaaggtcgccttgtcggagatgctggcggccgccgaagagcaccatgccgatgcgatcggcatgagcggactgctcgtcaagtcgaccctcgtgatgcgcgacaacctggtcgagatgaacgaacgaggaatggcccacctgccggtcatcctcggtggcgccgcgctgacccgtaccttcgtcgagcgggacctgcgccaggtgtacgacggtcgggtcttctacggcaaggacgcgttcgaggggctcgatgtgctcgagcggttggggcgcatccgtcgtggcgagctcgacgatcccgagttcgggcgttcgatccggcagtcgagcacgaggacgccgcggctcctgcgacgctcgacgagtgagcgcaccgagcgatcgccgacggtcgcgatggacaacccgatcttccgtccaccgttcctcggcacgagagtcgtgaaggggatcgcgctggacgacatcgcggcctacgtgaacgagaccgcgctgtttcgtcaccagtgggggtatcgacccgaaggcgatgaggacgacgcggccttcaagcagcgcttgcgcgcggagctgcgccgtcagctcgaccgtgcgctcgtggaccagagcctggtgccccaggtcgtctacggctacttcgtcgcggcttccgagggtaacgacctcgtggtgttcgcggacgaggcgcgtgagcacgaactcgctcgattccgtttccctcgccaagagcaggagccgtacctctgtatcgcggacttcttccggccgctcgcggggcccgagatcgactacgtcgccttccacgtggtgaccatgggtccgcggatcacggaggtcgccaagcgggcgttcgacgagaatcggtaccaggagtacctcctcctccacgggctcggagtcgagctcaccgaggcgctcgccgagtactggcatgccaggatccgagcggagtggggctttggcgacgaggacggcccgacgctcgcggggctctttcgtcagcagtaccgtgggagtcgctacagctggggctacccagcctgtccggacctcgaggacaaccggacggtcgtcgatctgctcgatgccggtcgtatcggggtcagcgtgtcggacaccttccaactggagcccgagcagaccacgaccgcgatcatcgttcaccatcctcaagcgaagtacttcgtcgcctagcgagcggatcgccgaggggcgcatgacgcctaacgtggggccaacgaacgttcacggtgacgagacgagagggagccccgcatgggtgtgacgacgaacgtggtgagtggtgtcgaggctcgcgggctgcgggttcgactcgacgcagcgagcgagcgtgaggacgcctggcgcaccgagatcgtcggtgacgaactctggtgggtcaggggctacgacctcgaccacggcgcgcggggagccggggccgatgtcgtggcgctcgccgccgaccgccacgcgaccgacgtcagcgtcgatctggggtcgcacgacgcgatcgttgccgaggagttcgccctcggcgcgctgctcgcgagctaccggttcgatcggtatcgacacgcctcggcgccggctcagacctggcccaccgaggtcgtcgtgatgggtgacgtcgcgcgtgcggcgctccagcgggcgaggagtcgagcggaggcggtggcgttggcacgcgatctcgtcaacgagccgccctcgaggatgacgccgacggtcttcgcacagctcgccgagcaggtggccgatgcggcgggtctcgaggtgcgcgtctgggaccgtgcggcctgcgaggctgagggccttggcgggctcctcggtgttgcacgagggtccgtcgaggagccgcgggtcgtgcacctcgtctatcggcccggggcgcccaccggtgagccggttgcgttggtcggcaagggtattaccttcgactcgggcggtctcagcctcaagagcgccgacggcatgatgtccatgaagacggacatggcgggcgcggccgcgattctcgcggccatgtccgtcctcggtgagctcggctgtacgcgtgaggtgcgtgcgtacctgatgctcacggagaacctcccttcgggcagcgcgcaaaagcccggtgacgtgctcgtcacgcgctcggggaccacgatcgaagtgctcaacaccgatgccgagggccgcttggtgctcgccgacggactggcgctcgcggtggaggacggcgcgagcgccatcgtcgatctggcgaccttgacgggcgcgtgcgtcgtcgccctcggcgacgaggtcgcgggcatcatgggttcggatccgaatctcatcggtgcgttgcgcgcagccggtgaccgcgaggacgaacccctctgggaactgccgctgccgtcacgctacgaggcacacatcaagagcagcgtcgccgacgtgaagaacatgggcaagcctggcaaggctggggccatcgcggccgcgttgctgctcaagcgcttcgtcgggtcggttccgtgggcacacctcgacatcgccggtccggcgcgcgccgatggcgaccgagggtgggtgcgcgagggtgcgaccggtttcggggtcctcaccttgacgcgctggctgtgcggaccgacgctcgacgacgctgctcgttgacggcccgggtcaccgcctcgaccgtatagccctggcgaacgaggcgtgccgagacctcggcctcgctcgcgcccaggccgagcagggtcgcggtgagctggcggagcctcgcttcgcgtcgctgcgcgttggcgacctccgaggcgctcgggtgccaggcgtcgacgaggcgcagtgatgcggggagcgcacgacgctgacgcgcgctcagatgcggcacgggggaacggatctcgagccggtttcgttcgacgacgcgagccagttcgaaggtcgcgaggcgctcgatggcgcgcacgatcgagcgcaggccggtgtcgtgcgaacggaggccgaggctcgcgccgaggtcgtcgagccgtacgagcgcgggtccgtgctcgctgagcgcgtcgagtcggcgcaggagagcgagggcggtcggcccgatgaggggcagccacagaagttcgacctcgtcggagcgggggctccagccgggctcatgcgtgtgccaccggtcgatggtgagtgctggatcgagctgtgccatgggccatcctccatgatgcgggctcgggcctccctagcccgagcgcggatcggaacgtcctgttccgccttgcgccgtgtggcgcgcactccagtatgtcagctatgacgtttcatgtcaagcgatgtccgtccctacgagccgtcgtactcgccgaagactcctcgtagggtgtcggcgacctcgccgagggtcgcaccagcgcggagtgcagctcgcatgggatagagcaggtttccggtgccgcgggcggtggcggccaggtcatcgagggtgccagcgagcgcctcggcgtcgcggtgacgacgccaccgttggacccgcgcggcttggtcgcgctggaaggccgggtcgatggggaagacctcgggggcttctggctctggttcgcggtagcggttcacgccgacgatgatggtccgaccctcgtcgatggcggtggcggcctcgtaggcggagcgttcgatctcctcctgcatccactgctgttcgatcgcggcgaccgcgccaccgcgcgcatcgatctcgtcgatgaggtggcgtgcactggcctcgaccgcatcggtcagggcctcgacgtagtacgagccggcgagcggatccaccgtgtcggtcgcgccgatctcgtgggcgagcacctgttgggtgcgcagtgccaacttggcggcgtgttcggtcggaaggccgagcgcctcgtcgaagccgttggtgtgcaggctctgggttcccccgagcacggcggagagtgcctggagggtgacccggacgatgttgacctctggctgctgggctgtgagggccgatcctgcggtttgcgtgtggaagcgcatcagccagctccgctcggacctcgcgccgaagcgttcgcgcatgatgtgagcccagatacgtcgagcggctcggaacttggcgatctcctcgaagaggttggtgtgagcgttccagaagaaggagagccgcggcgcgaaggtgtcgacgtcgaggccggcggcgagcgccgcgtcgacgtaggcgatcccgttggcgatggtgaacgcgatctcttgggccgccgacgcgcccgcctcgcggatgtggtagccggagatcgagatcgtgttccactggggcaggcgatcggcgcagtaggcgaaggtgtcggtgacgagccgcatcgatggtcgaggtgggaagatgtaggtgccgcgggcgacgtactccttcaagatgtcgttctggatggtgcctcggaggtgctccggtgcgaccccttgctcttcggcaacgagttcgtagagcagcaagagaactgaggcggtcgcgttgatggtcatcgaggtcgtcacccgctcgagggggatgtccgcgaagaggcggcgcatgtcgtcgatggtcgagatggcgacgccgacgcgccctacctcgccgtgcgcgcgcgggtgatcagcatcgtagcccatctgggtggggaggtcgaaggcgacggagagacccgtttggccagcctcgaggaggaacttgaagcgctcgttcgttgcctccgcggtgccgaagccggcatactggcgcatcgtccatgggcgatcgcggtacatccccgcgtggatgcctcgggtgaaggggaaggttcctgggtcgcccaggtcccggtcgtagtcgaggtcggcgaggtcctcgggtcgatagacgcgtcggatcgggatgtgtgaggaggtgagacgctcgtcgtcggccacgggctcatcctaccgacgtctggtcctcgcgccacggcgacccggcgtcctcgtcgagcgctcgagcgagcgcgtaggctggtgcgaggacagcgcgacggtgaaggccgcttggcgcgtgagcgttgggcgcgacgaacgatcgtgatgccacgggaggagcgttgcgtggagcagctgagtgccgagcagttcacggcggtgcccacgttgagcgcgtgggaggttcgtgggcacgttgccgtgtgtcggttcgcgaccggtgacttcgcgaccggcgtgaggttgctcgaggacgttgcccatatcgctgacgccctcggacaccatccggacgtcaccatccgcttcggctcggtcgaggtggcgaccaccacctacgagacgggcggtttgacggaccgcgacgtcgcacttgcgcgtgcgatcacggagcttgctcgacggttggggctcacgcctcgagacgcgtagcaaccagccaccccgagctggaggaggccgccggtgaggctaggggcgcacggggtggggcaggcatagatcgtcgtaggcggcgatggtgatctgtgcggggtcgaggctacaagccggacacgccggatcgcggtggaggcggtagctgtggaaggtctccgcgagggcgtcgaaggtgaggaggcggcctgcgagggtgtcaccaaggccgaggatgagcttgatcgcctccagggcctggattgaccccacgatgcccgggagcacgccgagcacgccggcctccgcgcacgacggcgcgagctcggccggtggtggctcggggatgaggcaccggtagcagggcccgtcgtagggcgaaaagacggtgacctgcccctcgaagcggaagatcgacccgtggacgaccgggatcttgagcttgagggaggcgtcgttgacgaggtagcgggtcgggaagttgtcggtgccgtcgacgacgacgtcgtagcccgacaggatctcgaggacgttgtcggcatcgaggcgcaccggatgcttgaccacgcggacgtccgggttcagctgtgcgatcgcggcttcggcggagtccaccttggccatgccgacgcgatcgagggtgtggagcacttggcgttggaggttcgaggcgtcgacgacgtccatgtcgacgatcccgatcgtgcccacacctgccgccgcaaggtagagggcagccggggaggacaggccgcccgcaccgaggagaaggacgcgcgcttcgagtaggcgcagctgaccagcttcggagacctccgggagcagcaagtggcgatggtagcggcttcgctgctcaggggtgagtgtccggggcgtcgaccaggcccgtccctcgtccttccagcgattgaagcctcccgccatggagaccacgcgctcgtagccgagatcgccgagcgtcctcgcggcgaacgccgagcgtacgccgcccgcgcagtagacgacgatcggcgtcgacttgtcggggagtttggactcgaccacgagctccaggttcccgcgagggatgaacaccgccccggcgatcgcgccttgctcgtattcgtcctgttcacgaacgtcgaggagtgcccaaccctcgcgttggaggcgagcagcctcgtccgtcgtgacctcgtgtaccgaggccttggtctgaaacagcagatcgcgaaagcctgccacccctacgcacctccggaccgtccgccctgtagcttacggagcatcggcacgaggcgctgcgcctggaggtcgagcggcacgacgcggtcgcgggggtcgaggcgccctcgcctcgacggtgagccgtgcactggctcgggaagggggtggccgagcgcgaccgtgatgacgatgcggctcgtctgagcgagtccggcgaggtcgcgcagcacctcctcgcctcgaaaggtgccgatgacggctgccccaatgtcgagcgcggtcgcggcgacgaggatcgcttccagtgtggcgccagcgtcgacccaccagtaggggatgggccatcgttccaggctccagagtccggcggcgcgcttgtcgggggcaccgtagcgttcggcgtaggccgcggggtcgacggtgacgaggagcagggccggtgcgcgttcgagtcctcgcatctcgggacgcgcggccagccaccccggcgtcgtgagtgctgcgaggatccgggcgcggctctccggttcgcgcgcgatcgcgatggtgacggcctgtgtgaagccggcggacggcgctcgcagcccggcgtcgacgatggccgcgagcgtcgcgtcgtcgatcggatcggcagtgagcgctcggcgcatccgtcgccgccgaatcgcagcgagcgcctccacggtgctactcgatcacgacgacgatgtcgcccgtgccgacggtgtcgccggggttgacgcgcacttcgcggacggtaccggcgcgctcggccaagatggcgttctccatcttcatcgcctcgagcacgatgacgacctcaccagcgtcgacctgttgccctggggagaccgggaccttcaccacggtgccctgcatcgggacgctcacctcgccggagcccgtctgtgctgctcgggcaccggctctggccgatgagcttcgctgaggtcggctcggtgcattcggcgtgcgcggagcaggcgcactcggtgctgcggcgtcgagatagagcgtgacggcgacacgcttgccgttcacctcggcgatgaccggggtgggcacgagctcgtgagcgtcctgggatgcggtcgcgacgggggccacgccgcccaggtcgaggcgttcttccacccaacgggtcgagtgggttcctgcgcgaaagtcggggtggtccaagatggcgacgtcggccggtgtggtcgtggcgacgccctcgatgcggagctctccgagcgctcggatcgcacgagcgatggcgtggtctcgatcggcggcgtggacgatgagcttggcgaccaggttgtcgtagtactgcgagaccgtgtcgccggtgtcgtagccagcgtccacgcgcacccctggtccgtcgggccggtcgaagcgggtgatggtgccaggggtcggcatgaagcggccaccggcggggtcctcggcgttgatccgcacctcgatggcgtgtccgcgccgcacgacgtcgtgctgggagaagccgaggggctcgccggcggcgacccgaagctggagctcgacgaggtcgagacccgtcacgagttcggtgatcggatgttcgacctgcaggcgcgtgttcatctcgaggaagtagaacgcgccgtcttggtagaggaactcgacggtaccggcgttgcgatacccgcaggcgcgcgccacggcgcacgcagcctcgcccatcgcgcgccgggtctcgtcggggaagtgcggtgcaggtgtctcctcgatcagcttctggtggcgtcgttgcgcggagcagtcgcgttcgctcagccacaggaccgagccgtggtcgtccgcgatgacctgcatctcgatatggcgaggccaggcgaggtagcgctcgaggtagcactcgtcacgtccgaacgcgctgcgtgcctcgcgccgtgcggaggcgagggcctcggccgcctcgtcggggcgggtgacgacgcgcatgcctcgcccaccgccgccataggcagccttgatcgcgacgggccagccatgctcgtcgccgaaggccacgacctcttcgggatcgtccaccgggtgggtgaggccggggacgccggcgacgccagcggcttcggcggctcgtcgggacgagatcttgtctcccatgacctcgatcgcgtcggggggtgggccgacgaacgtgacaccggcctgggtgatcgctcgggcgaagtcggcgttctcggagaagaagccatagccggggtggacggcttcggcgccggagcgctcgatgatctcgaggagcttggtcgtattgaggtagctctcttggctggtgagcccgccgagcgcccaggcctcgtcggccatgcgcacgtggagtgcatcgcgatcggcgtcggagtacaccgcgatggttcgcagtccgagctccttggcggtgcggatcacccgaaccgcgatttcacctcggttcgcgaccagcagcgatgaaaacacgcgccctccttttgctcgccccgcgctcagggctccgccactcggcgactctagggtggagtccgtggcaggacgtcgagcgccctggcggctgatcctatcggacgaggtcgactccaccaatcgcgtcctcgcggctcgcgcccggtgggccggcgcgcacctggtggtggtcgccgatcaccagcgcagtggtcgtgggcgccgtggtcggaccttcgtcgacgtgcccgggggctccctgctcgtctcgtcgctccatcgctacgaggcaccggcgcgcccgatgctcctcggagcgtccgtcggtggcgctgcggccagcacgctgcgccgcctcggcgtcgcccagggagcgtggctgtggccgaacgacgtggtggtgggcgaggccaaggttggcggggccctgatcgaggcgtcctggcagggcggttcgctcgagttcgtcgtcgggttcggcctgaacctcgccggttgtcccgaggtgccaggtcgccagctcgccgacctcggctcgctcgctggccggtcgatcacacgcgacgaggccctcggggtctggctcgaggagctcgcgtcctggctcgagcgctggtctcggggcgatgacgtgctgggcggtgcgcgtgcgttgctcgcggggatcggcgaggaggtcgttgtcgaacgagctgcgggtgagcttcgcggacgtgtcgtcggattgggtccctcgggtgccttggtgctccgtcacgacggtgctacgttcgaggtgagcgaggcagacctcgtccgtctcgtccgctcgtccacgggagccactcgagccgacgaccaaggaggcacgcacgcatgacggtggagttctcgccggaacacgagcagctgcggtccgtggttgcggacttcgtcgcgggagaggtcgcgccgaacgctgccgcgtgggatcgtgaggagcgattcccactcgaggcggtgcgcaccatgggcaagctcggcttgttcgggatcccgttcccgtcgcgctacggcggcggggatggggacttcacctccttgtgcatcgcgatcgaggaggtcgccaaggcggactcgtcgctcgcgatcaccctctcggccggtgtcgggctcggtgcgagtccgatctaccgcttcggcaccgacgcgcaacgcgaacgctggctcccagccctcgtccggggcgaagccctcggtgccttcggcctgaccgagccggaggccggatcggacgccggcgcgacgcgaacacgcgccgagcgcgtcgctgaccgatggcgtctgcgcggcgagaaggcctacatcacgaactcgggcacgcccatcacctccgtcgtcaccgtcacggcgcgaacggacgaagggatcagcgcgttcatcgtgccggccgggaccgctggtctcacggtgctgccgtcctatcgcaaactcgggtggcgcgcgtccgatacccacggcatcgtgctcgaggacgccgaggtcggcgacgacgcgctgctcggagcgccaggggctggctttcggcagttcctcgcgaccctcgacgagggacgtgtcgccatcgcagcgctcgcgctcggtctccaggaggcgtgcctgcgcgagggtctcgagtgggcgaaggcgcgcaacgccttcggcggtccgatcggtcggtttcaggcgatcgccttcaagctcgcagacctcgaggtcgcggtggaggcctctcgtcatctggtctaccgtgcggcctggctgcgtgatcagggacgcccgtttgcgcgcgaggcggcgatcgcgaagctctatgcgaccgaggcggcggtgagcgccgccagggaggcgacccagatcctcggtggtgccggcttcatcgaggacaccccggtcgcgcgctactaccgcgacgcgaagatcctcgagatcggtgaaggcacctcggagatccagcgcttggtgatcgcgcgctcgctcgggttgagcccgagctagcatgagcgccgcatggatcggctcgtcctatgaaggcgctcgtcctcgctggcggttcggggacgcggctgcgtcccatcacccataccgcggccaagcaactggtcccgatcgcgaatcggcccatcctcttctgggcgctcgactcgatcgccgaggcgggcatccgtgaggtggggatgatcgtcggccacacgaaggacgaggtccgcgctgcggtcggcgatggctcggccttcgggctctcggtcacttacctcgagcaaccccagccgctcggactcgcgcacgcggtcagcgtcgcgcgtgactggctcggcgacgacgacttttgcatgtacctcggcgacaacgtcttgctcggtggcgtcgcgccattcgtcgagcggttcggtcgacccggccgtagcgaggacgcactcgtgctgctcgccaaggtcgacgacccgacgcggttcggcgtcgcggagttcgacaccgaggggcgcctcgtccgcctcgtcgagaagccgtcggtccccccgagcgacctcgcgctcgtgggcgtgtacttcttcagtccagcggtccacgacgccatcagccagattcgcccgtccgctcgtggtgagttggagatcaccgacgccatcgacgcgctcatcacgagcggacgcatcgtggacgcgctcgcggtcgatggtttctggaaggacctcggcgaccccgaggcgctgctggccggcaatcgcttcatgctgctcgggatcgagggttcggtcgaggggacggtcgtggactcctcggtggacggcccggtcgtggtcgagcctggtgccgtcgtggagcgcacggtggtgcgcggtcccgccaccatcggtcgcggggcccgcatcgtcgatgcgtacgtcgggccgttctctgcgatcggtcccgactgcgagctgcgggccaccgagatccagaactcgatcgttctcgccggcgccaggatcgatggtgtcggcccgttggacggctgcatcatcggacggagcgctgtcgtcgagcgccgaggccacctcccacgtgcgaccagcgtcgtggtcggcgaccactctcggctcgagctcgcctgagccgagaggcggccaaggtcggtcgctaggctgccgggcgcccgtcgagggtgcatcgcaggtgaggaggagtggcatgcggcttctggtgaccggtggagcgggattcatcggctcgaactatgtccacgagcgagtggcccgccacccagacgaccggatcgtcgtgctcgatgccttcacctatgccggctgtcgtgagagcctccgcgacgtcgatgaccacattcgcatcgtcgaaggcgacatcggcgacaccgagctcgtgagctcgctgctcgacgaggagcgcatcgaggtgatcgtcaacttcgccgccgagtcgcacaactcgctcgcgatcatcgacccggagcgcttcttccggaccaacgtgctcggcaccgtcggactgctcgaggccgcgcgtcggcacgacggcttggtgcgattccatcacgtctcgacgtgcgaggtctacggcgacctggagctcgacgaggagcgagccttcaccgaagacgacccctaccggccccgcaccccctacaacgcgtccaaggccggcgccgatcacgccgtgcgggcctaccacctgacctacggcgtgccgatcacgatcacgaactgcgccaacaactacgggccctaccagttccccgagaaggtgatccctttgttcgtgacgcgcgcgctgcgtgatgctcccctgccgatgtacgcatcgaaggagaatcgccgggagtggatccacgtgcgcgatcacgcggccgcgatcgaccgggtgctggaggccggcaccgtcggcgagacctaccacgtgggcaccggcgtcgagcgctcgatcgagcagatcgccacttcggtcctcgacctgctcggcaagccacggagcctcatcgaggtggtgcccgatcggccatcacacgaccggcgctacgtgctggactcgacgaagctgcgcaccagcctcggttgggagccgacggtcgccttcgacgaaggccttgcgtcgaccgttgcgtggtacgtcgagcatcccgagtggtgggagcccctgcttggccgtgctcctgtcgtcgaaggcgaggcctggcgccggtgagcgatcgcatcgtggtcctcggtgcgggcggtcagctcggtcggcggttggtgcgcgcgttcgagcgcaccagcgccgcggaggtcgtcggtctcgatcgtcgagcactcgacgtcaccgagcgtgtggcggtgcacggtgccgtcgacgcactccggccacgctggatcgtgaacgccgccgcgatgacggccgtcgacgcctgtgagcgcgaggtagagcgggcggttcggctcaacgccctcgccgtgcgttggctcgtcgaggccgccgagcgcgccggtgcgcgcgtatgtcaggtgtcgaccgactacgtcttcgacggtaccgccacgcgtccttatacggaggccgaccagccgaaccccatgagtgtctacggcctcacgaaactccagggggagcgcgagttgcgtcccgggatcgacagttgtgtgcggacctcctggctgatgagtgccgacgatcgttgcatgctcgggaccatcgaccgccttcgccgaggacctgggcccttgcgcttcgtcgaggaccaggtcggttctccgagcttcgcggacgacgtcgcgctcggcatcgtggagctcgtgcgtcgtgaggtgaccggcgtcatccacgtgacgaacgacggtcaggcgagctggtacgacgtcgcgagggaggcacttcgggcctttggcgacgatccacaccgagtcgagccgatccccacgacgcaactcgccggcagcttcgtcgctccgcgacctgccttctcggtgctcgccggggtcgtgcgcgccgcggtcgggctcgagcccctgcgaccgtggcaggaggcgctcggagctgcggtcagcgagcgtgctcgtggatgagctctgggcggtcgtggtcgactacgggggccacgccgacgactcgctcctcgatgcgctgatcgatgccggtgcggcacgcgtggtcgtcgtcgacaatgcactcgctgtggcgagctcgcgcaccgagccacggggccagggggtcgtcgagtttcggtcctacggcgccaacctgggcttcgggggtgccgtcaatcgggtccttgcccgtcgaggagccaggtggctgctcatcgccaacccggacatcgagatcgctccgtccgcgctgcggacactcctcgcgaccggcgagcgctggtcgcgagctggcatcgtcgcgcctcgactcgaagaccacgcaggccaaccccaggcgagcgtccgagcgttcccgagcctcgcgctcgcggcgctgcacggagcactcggcgtcgtctggccgtcgaatccggcgtcacggcgctatcggcgcgaagtgcccgatccgccgaatgcatacctggcgccgtgggtctcgggcgccctgatgctcgcgcggtgggaggcactgtcggcgatcggtgggttcgacgcgagctacttcttgtacctcgaggacgtcgatctcgcctggcggctcacgcgggccggttgggaggtcgtcgtcgatccgaccgtgcgtgtccgccacgtcgggggtgccaccacacgctcccgacgcgtggtggcggccctctggcacgcacgttccctggttcgctacgggctcgcgcaggaggacacggccactggcgcggcgttggtgctcttcggcgtgcttgctcgttgggcagtggtcgtcgtggcgtcgcgacgcagctcagcggacggatgagtcgctaacctagtgccggtatgcccaacccccaggaaggagctcggcgagtccagcgcgccaaggcggctggtcgaggggctcacgtaccgcgtgagattcccgtcgggttctacgctgccctcacgatcgtcgcggtgctcggcatcgctgccatcggctactcccgctacgaggtcaaccatccggtctccgcgacgtcgtcgcagtcgccgcctcgcgtcggccagacgtggtacaccgcactcgggatcgaggtctgcgggcacttcgagccggtgctcgccaagggttcaggtgctgcgagcggcatgacggccctcggcaacggggtcgtcaaggtcgcgccgaagacaccggccgagaccggcgctgcggcgacgctcgtgcacttcctcgacgcggcgggcgtgcgcgtctcgacgtcgagcgtcgtcctgcctgggcacgcgagcatcgacgtcgcgagcgtgtgcggccagcggccggtcgaggtgcgtacggcgacgtgggcatccctgcttgcgactcggccgacgatccatgcggggacaaccggtgtgcgcatgctgagcggcgaggtcgtggccgtcgcggtggtgaccaagggcgcgacgatcgcccagcctcccacggccgccaacctcgcgaacgtctaagggtcacccgaggacacgcaagaaagtacggagggcgcgtgcaagcgatcatccttgtcggcggggaggggacccggctgcggccgctcacgctgcatcaacccaagcagatgctgcggttgctgggctttcccatgctcgagcgcgtcgtcgagcgtctcgccgcgatcggcgtcgatgaggtcgtgctgtcgctcggataccagcccgatgcgttcatcgcgcgctatcccgaccaccgcatcggcacggtcaaggtgcgctacgcggtcgagccggagccgctcgacacggcgggcgcgattcgcttcgccgtggacaagggcaacgtccacggcacgttcttggtcgtcaacggcgatgtgctcaccgacctcgacgtcgcccagctcgtcgacttccatctcgatcgaggcgcactcgcaacgatcggcctcgtggaggtcgatgatcccagccgcttcggtgtggtcgtcaccgacgaccggggccgagcggtgcgcttcgtggagaagcccccgagggatcaggcgccctcgcacgcgatcaacgctggcgtctacgtcatggagccggcagccatcgagcgcatcgccgttggcgagcgcgtctccgtggagcggagcctgttcccgcagctcgcgagcgaggggacgctgtgggggctcgcgcagcggtgctactgggttgatgcgggcacaccggcgagctacctgcgtgcggcgctcgacatcgcaacggggcggcgcgcggcgagagtgcgagagggcgtgcggttcccggtcgagagtcgaccccccggtggcgagacgtgttacctcggagagggatcgcaggtcgcgagcgacgccgtcgtggacgccgcgatcatcgaggacgatgtcgtcgtcggcgacggggccgtcgtgcgatcgtccatcgtcctcgagggcgcgcgactcgcacccggggttcgggtcgagcactcgatcgtcggagccgagacggacgtcccggaggccgtcgagctggtcgatctcgcggtggtcgcgccgtccacggagctcgcccccggccagcgactcgctggcacccgatgagcgaggcgccgccggtactcgtcacgggcggggcgggctttctcgggtcctgggtggtcgagcgcttgttggcacgcgggctgcgcgtggacgtcgtcgatgacctgtcgacggggtcgctcgagaatctgcggcgagcgcgcgaccgacacggcgcgcgactcacggtcgtcgtcgaggacgtgacgagtgccgccatcgggtcgctggcggagcggcggggctggcgcagcatcgtgcacttggctgcccgagcgagcctccgcgcatccacgctcgatcccgtgcgcgacgccgaggtcaacgtcctcggtaccgtgcgcgtgctggaggctgcgaagcgggctcgctcgcgcaaggtggtctttgccgcctcggcggcgatctacggcgaccagcgggcgttgccgattcgcgaggaggcgccgcttgcgccgatgtcgttctacggcgcgggcaaggtggccggactcgagtaccttcgagcggctcgacacgtccacgggacggcgtccacgagcctcgtcttcgccaatctctatggtccgcgccagcgcgctgagctcggcgcggtggttgcgcggttcgtcgacgcactgctcgcggggcacgcgcctgtcgtcgtcggtgacggcacgcagacacgggacttcgtgtgggtgggggacgcggccgatgcggtggtcgccgcgctcgatcgggccgatggggagatgatcaacgtcgccaccggcctcgagacctcgatcgcgggcctcgcacgactgctcgtcgaggtcgccgggatcgacgggctccacccggtgcaccagggacgccagtcggtgggggaggtgcaccgcaacgcgctcgacccctcccgcgcggcgcacctgctcggctggcgaccatcggtccgactcgccgatggcctcgcgcgcacctgggcggctgcgctggaggcgcggcgaatccgcgaggcggcgccgaggtcctgagcagcgctgatcgagctcagtggtcctcgcggcgggcgccgagctctcgatctgccccttcgcagcgcggtcttgacctcgtctggctgctcagaagcccacggctcgccgcggtgctcttcgaggtcggcgcgcccggcgtgggcgtcagcgaaagaggtctcgagcgctgtcgcgcacgatggcgcgggcggacgactcggcgagccaggcggggtcgatgcctcgcacgacgctgaagggcgtgccggcagccttcgtcgcgacgagattcgccgccgctgcgatctcgtcggcgatgcagacctcggtcacgcgcaaggttgcgccggtccagtcggcggtgccacgcaggtcgaggattgcccgaacccccgccaccccgatggcgacgtcggtgaccccctcgcgccacgctcgaccgaaggtgtcggtgacgatgacaccgacgtggaggttccatgcaaagcgcaggcgatcgcgaatccgacgcgccgagcgatccggatcctccgggagcagcacgagcgcatgtgcgggggcgttcgaacggtcgataccggcgttcgcgcagacgaagccgtggtgggtctccacgatgcgcgtggtgccacgcacgcgcagcaccctgcgcgtctcggcagcgagtgcggcctcgaacgcctcgtcgagatgctcggggtcgctctggatcacgcgaccttcggccttggagacggccttttgcgacacgcagacgacgtcgccgtctgcgagctcgccggtcgcgcccaggagatcgccaaggttgtccccggcgcagatctcgcgatcgatggggatcgaccagatcgtgagccgtctcatcggtcagaacccaccacttggacgagccgatccacgaggtcggcgcttcggtcggggtcggcgatcatcgtgtccatcaccacggcccgcacgccatggcgttcgacgtcgccagccagtgcgccatcgcggtggtcgacgacgagggtgccggcgtacggtgcgtagagctgggccacgctcgttgcgctcggttcgaggccgaagtcggccatgatggaggctgcagggcccttgatggcctggcctcccacgatcgggctgatcgcgaccgttcgatcccgtgcgtcgcgcacgaggtcgccgaggtcgccgagttcgaggatcggaaagaccgagaggaacgggttcgagggcgcgatgatcacgagatcggcctcggcgatcgcggtccgtgcatcgggatggggacgcgcggttgcgatgccgtcgtagcggatgcgttcgacgtggggttggtgtcgcatggccacgaagtactcctggaatcccacctcggcgaccccgtcgtcggtccgtaccgtgagcatcgtcgccacctcgtcgtcgctcatgggtacgaggtcgatgtcgatccccagtcggcgcacgacgtcgcgggtgatggatcggaggccctcgcctcgacggagccggtcggttcggtagaggtggaggccgatgtcgcggtcgccgagcgtgaaccacgtcggtcccccgagccgtcgcagcatggtgagcgccgagaaggtctcgggagcgatcccccagccggtgtgggggttcacgaggccgctcagtgtgtaggtgatcgtgtcgaggtcggggcagacgcgcacgccggcgatccatgtgtcgtcaccggtgttgacgaccgcggtggtcgcgggagcgagcttgcgtcgggtgacgccagcgaggaggcgagccgcgccgaccccgcccgagaggacacagatgcgcgggtttggagtcacggccacgaggctaccggtcgaggtgtgacccgatcggcccagagcctcctcggtagactgcgcccgtgctgcgcgtgagcctcgacgtcttgcccctggtgggcgcgaggacgggcgtcggagagttcgtctggcacctcgcgaacgcgcttctcgaggccggcgtcgacgtctcgggctggggtgtgacgtggcgaggccgcgaccggctccgagcggccgtgcccgccgagctccgtgtgcacgacgctcgtctgcctgctcgtccgctctgggcggcgtgggcacggtggcgatggccgtcgatcgatcgcgtgttcgccgacgtcgacgtcgtccacgcgaccaacttcacgctgccgccgctgcgtgagcgcccgagcgtcgtgacggtccatgacctcaccgtcgtgcaccatccgaactggtgtgatcgcgcgacgctcgtctatcccaagctggtcgcggctgcagtgcgcgagggctcgttcgtccacaccccatcggaggcggtcgctcgcgaagtcagggcgtggttgggtctcgacgccgatcgggtggtcgcggtgccccatggcgcccccggggcgccggttgccccgcccgcggcgccagcgaggatcgcgcggctcgccgggcgccgctacgtcctcgcgctcggaaccctcgagccccgcaaaggtatcgacgtgctcatcgaggcgttcgcgcacgtcgccgagcacgagcgcgacctcgagctcgtgctggctggacagtgggggtggggggtcgacgccatcacctcggcgctggtggccagtccggtgcgcgcacggatccgggtgctcggctacgtcgatcccatcgagcgagcctggctgctcaccaacgccgccatgctcgcctacccgagtcgctacgaggggttcggactgccgcccctcgaagcgatggcggccggcgtcccggtcgtcgccagcgacgtgcccgcggtacgcgaggtggtcggctcggcggcggtgctcgctcccgtcggtgatgcggcggcgctcgcagcgtcgatcggccgcgcgctcgtcgacgcggaccgtctgcgcgcactcggcccgagccgagcggcgcagttcacctgggagcgcacggcgcgcgccatgatcgagctctacgagcgggtcgcggcgacgtgagggtcgacatcgtcgtcgagcagctcgcccgtccggcccccggggggatcggtgtgtgggttcgcgaagtcaccccacggctcgcccgacgtcacgccgtgcgtctggtcgcgtcgcgctcggcgcgcctcgacggtgtagtcgagggggccacgacggttcgacggatgccgttgcccgagccgatcgcacagcgtgcgtgggatgcggggctctggggggcagatccgtccgccgatgtggggctctggctgtcgttcggagggccgccgatcgcgcgacgaccgccctcggtggtggtggtccacgacgtgatcttcctcgagcatccagagctctacacgaggcgaggggctcgctggcacgtggcccaactcgaggcggcgctcgcccgtgcgacgcggttggtcgcggtcgatcccaccgtggccgatcggctggtcgcgctcggggcacgagatcgggtccgcgtcgtcgctcccggggccgaccaccttcctccggccgatgcagagggcgcgcgggccgtgctggcgcgagccggggtcgagcgcccctacctgctcgtggtcggtacgctcgagccgaggaagaacctgggtcgcctcgtcgaggcgtaccaggcctatcgcgcgcgatcgttcgaccccgtcgacctcgtcgtcgtcggcccggctggctggggcgacgacgctcggcgcggtcccggggtgcacgtgctcggcacggtggcggcgccgatcctggcgggtctgctcgtgcaggcgagagcgctggcctacgtctcgctggtggaggggttcggcctcccggtcgtcgaggcactgcacgccgcggtgcccgtggtggtgtcgacgaccgtgccggccgcgcgtttcggcggcgttggcgtggatccctacgacgtccggtcgatcacggatggtctcgccgcggtgctcgacgacgaacgggcgcgctcgcggctcgtgagcgagggcttgctcgccgtcgagcagctcaggtgggaccgtacggccgacgcgctcgccgacgtgctcgaggaggtcgccgatggctgagatcgtcatcgatgcaaccagcatccctgcggaactgacgggcgcgggtcgctacgcggtcgggctgtgccgtgcgctcgccgcgctcgaggggcgtccggacatcgaggtcttcacgaccggtgcggcgcgaccccacttcgtcagcgacgcccccggctgggcggtgtcgacggcagccccgcgccacagggtggcgcgcctcgccgcccaggaactgctcgtcggccggcgtgcacgccgccacggagcccgcgtcatccacgggctgcactaccagctcccgagggcacgtggggtcggcctcgtcgtcaccgtgcacgatctcacgctcatcgagcatccggagtggcacgatcgcgcgaaggtcctctactttcgcggcgccattcgctcggcactgcgacgtgcgcacgccatcatcgtgccctcggaagccactcgcgagggtcttcgagcacggttcgacccgcgcgttccggtccacgtggtccaccacggcgtcgagggcgttcctcgactcgaccatcgccttgcccgccccggtcgacgcagcctcctcgtcctcggaaccctcgagccgcgcaagaacttggtgcgcatcctcagggctttcgatgcgatcgccgaggaggagcccgacgtcatccttcgcttcgtcggcaagcgaggctggggcctcggcgagttcgacgcgacgctcgctggccttcgccatcgtcgtcgcgtcgaggtgctcggcttcgtctcggacgaggcgctcgcaggctacctctcggaggcggctgcgctcgtgtacccatcgctcgaggagggcttcggtctgcccgtgctcgaggcactcgccgcggggcttgcggtcgtgacgtcgaaggactcggtcatggaggaggtggcgggtgggttcgccaccctggtcgaccccaccgatgtcggctccatcgcccacggcatgcgccaggcgctcgacgaggcacgtccgacggaacggatcgaggcgcagatcgcctgggctcggagcttcacctgggagcgcgcggccgagacgaccctcgcggtctatcgggaggtcgccgggctctagcctcctcacgcatgcgcgcgctcgtcaccgggtcacggggattcgtcgggacgtggctgcgggcacacctcggggccgccggcgacgaggtcgtcgagctgccggccgatctcgacgtcacggatcgagccgcgatcggtgcgtggatgcgaacccacggcgccgcgatcgaagcctgctatcacctcgcggcgcaggcgagcgtcgccaggtccttcgaggatccaggccacacctggctcaccaacgcgctcggcacgcagttcctggtcgaggccctgtccgaggcggcgccggccgcgacgctgctcgtcgtgtcctcgtccgaggtctacggtgcaccggcgcccgatgagctcccggtcgacgaggacgcgccactgcggccgacctcaccgtatgccgcgtccaaggtcggtgccgaggccgcggggctggagggagcctggggccgtgggcttcgggtcgtgatcgctcgaccgttcaaccacatcgggcccggtcagtccgaggcgttcgtgatcccgagtcttgtgggtcgggtcgtcgaggcgcaccgcaacggagagcgcgtgatccgtgtcggcaacctcgcggctcgtcgggacttttccgacgtgcgcgacgtggtcgcggcctatcgagccttggtcgtcgatgggcacgatcgcggcgtctacaacgtctgttcgggccaggcgtactcgatccgggaggtgctcgaactcatcgtgcgagcagccgatgcgtcactcgaggtggtggtcgatcccgcactgctccggcccgtggacgtgcccgtgatcgtggggaatccggcgcgcctcgtcgcacacactggggtgcgctttcaccactcgctcgaggcgacgatcgaagagctggtcacgagcgcacttcgcggaccaacggcgacgggagggttcgtcgatcgctagcgtggaggcctcatgtctaccgctccacgggtcgcggtcgtcgtcacggcgttccgtcctggtcgctacgtcgacgagtgtctcgcagcccttgcgcatcagagctacccagatctcgacatcacggtggtcgacggcgccggtgacgatcgtgaattgcgcgacgccgtggccatggcggcacccagggcgcgcatcgtcgatggaggaagctgtggggggtacggagcctgcgcgaacgcgggggcgcgggtgcaccccgacacaccgttcctcgtcttcgtccatgacgacgccgtgctcgcgcacaacgccatcgcgtccatggtcgaggtggcctatgccgccaacgccggcatcgtgacgccgaagctggtcgccttcgacgatccacgcagtctggtgacggtcgggtgggatctcgacccgttcttcaacccgaccgctcgggtggaggcgggcgagctcgaccagggtcagctcgacgaagtcgtggacgtggacgccgcaccgggtgctgcaatgttggttcgtcgtgacctcttcgacgccctcggtggcttcgacgaggtcttcggcctcatcggggaagacgtcgacctgagcgtgcgcgctcgactcgctggtgctcgcgtcgtcaccgctccgcacgcccgcgtccgacatcgaggggtgcgcatggagcggctgcgacgcgcgcgccgacgccgccaggtcggcgcccaggtcctcgaggagcgcgtcggtctgcaagatgccgagcgggtctggcgcaggcgccgcgcctcgcgcatcatgatgtcgagcctgtacgacggcccgatccgcttggtgctgctcctcctgtttgccacggagcgcatcggcgagctggtctggagggccctcgcgggttcgccgtcggcgggtgtcgcgggactgcgggcgctcgtgctgtcgcgcgacgaccgcgtggcgctccggcgtcgtcgtcatggcatcggcgagcgcgctcggtcgcatcgcgtcgtcgcgacgcgcacctggacaccgggggagcgtctcgtggccgtcggggcccaagcaggtactctctcacctgggcccacggatgcgccccccaagcggctcgcacggtgggtgccgcgctcgggctcggctcgctggttgctcctcgtcgcgatggtgattggcctcgtctcagcgcgaggtgcgctgacggcctcctcgcccggggggagcctcctgggtggagtgagcggcctcgcgttgctcgatgcctgggtccacgctcgggccgttccggcggtcctcggggccggcgtggcgccggtggggaccgcgttcatcgggctcgtgtcgctggtgttcggcggtgacgtcggactcaccgtgcgattggcggtactcgtcggcgcactcgtggcgcccgtcgcggtggctcggctcgctcggcgcgagttcgacgacgtgcgctccagtgcgctcgcgctcgtgtggtcgctcggtccggccttggcactcggcatcgccaggtcctctctgtcgctcgtcgctgcgtcggcgctcgcaccggtgctcgtcggcgccacgctcgctgccacccaaggacagcgtctcagtccgcgtcgcgccaagcgtgcccagcggcggctcgggctggttgcggccgtcgcgctggcgttcgcgccagagctcgtcgcggtgtggctggtggtcatcgctgccgaggcgctgtggtgggcccgtgcggcagacgcctaccgactccggcgtctcgggcgcgcgctcggcatcgcgggcctcatggcgatcggcatcaacctgccctggctcgcggccctcgtcctgtggcatcctggggtcgctgtcgtggcccacggcgtgccgggagcgcgagtgcagtcgctcggggcgcacctgttcggcggaggctacctcgctggcccagcaccgtggctgtacgtggcgctcggtgcgatcgccctcgctgcgggcgtcgagcgcagcgaacgagccagactcgcggtggctcgggccgtcacgggtcttgccctcagtggcgtcggggcgctggcgatgctcggtggccttggctcgacgccgatccagccggcctacttcgacgtgctcggtggcctcttgatcgtgctggcggtgccgactggtgtcagcgcggcccaggcgtggctgcgccgcagacgcctcggactctggcatctcgtgggggtggttgcggcgctcctcgtcgccatcctcggccttggttcggcgctgtcggcgctcatcgcgccggcggagccgatcgcgctgccgaccgccaacctcgcgctcgctggcgggttcttcgcccgtccggtgccgacgttgtggatcgaggtcgggcccggcggacctgttggtggcgcagcggtcgccgccaacgtgaccgttgcggtcaccacgggtgcggagccgagcttcctcggccagttcggtccgccggtgacggaggggtatcggcgcatcgtgccctcgattctcgatgcgctctctggtcacacggtgcaactcggcgcggtcctgcgaaggctcggccttggtgaggtcgtggtgctggacgcatcgcagtctccgctcgccagtgcagtcacgctcggcgtcgagcgccaggtcgacctgcgtcagctcctcggaacctcgtcgatgactatcgcggcgacgacgggggtgcctcggccggtcgccgcggcggcaacaccgccgtggttcgtggtgagcgagctcatcgcagcgggggtgctcgtctggtcggcagcgagcgtgttcgggatcgaggagcggatggtgaggcggcctcggctgcgcatgcctgctgcccccacgaccagggtcgaggtgctccagtgacgcgctggtcgcgcaccccgacgatcggggtgctcggcgtcgtcgtggtcgtcgcggcgacggtcgcggcaggactcgcgccggcacggccgcgcccagcggtgttcgcgcttcccgggcaccgctcactgagcggtgcgaccgtgctcggggcactcactcagccagcggtcgtggccggtgcgtcctcggaggcctggtactgcgtcgccccaccgttgctgccgctcgcggcgtccacgatcgcgctggccaacctcggtgcgagggcacgccacgtggaactcgtgcccacggccagcggtgctcgcccgatcgccgtcgtgcccctcgcggcgggcgcgatgacgtctcggcccgtgggtgtgcgtgggttctcgatcgtcgagggacctgggggcgtcgcggcgacggtggtgagtcacgagagcgcgggcgtccagagcgagccgtgccagagcactgcgagcgatgcgtggaccgtccttggtttcgacaccggcgcgggcgatcgcgccgtggtgcgcatcgccaacccgttccagacgactgcggtcgtcaacgtcgatccgatcggaccgtcgggtaccacggtggtcgcgtcgacgcaggggatcgtcatccagcctggccagacggtgaacgtggacgtagccaagctcgagccgggcatgacggacgcaggggtcgtcgtcggcgcgaagaacgggcgcgtcgtcgtggtcggagcgacgcggcccaatggcgcgatcgcgccgatcgtgctcgatccgcaggcgacgcaggggcgatcgctcgtcgcgccgtgggtgccggtggtcggcctgcgcaacctctcggtagtgctggccaatccgagctcgagcgtggtgcgagcctcggtgcgggtcgtcggccttcgtgggaccgccggatcgacggcttcggtcgcggacggacatggcgtgagcgaacgggtcgtcgtgccgagcggcgccacggtggtggtcccgctcaccgccgaggccctcgcggagccgtcggccggggtgcagctcagcgtccacacgagcggcggtgctgtgagcggggtcgtggacatcgagcgccgcggtgtcctcgacgggcgcagtgtgatctccctcgagcaggttgcttctcgcgggtggttcctcacgtgcccatcgagtgcggcgatgtcggcgctcgccttcgacgaggttggagcgagcgcccagctcaccatcgccgcccacaccgctgcgagcggtgcgcgatccttcgagacgaacctgctccacgcgggcgtcatcggtcttggcggcgttcggggcgtcgcctggtacgacgtgagcgccaccgagccggttgccctctggccggtcgcttcgtcgaccggctgtgcggtgctcggtgtggtcggtccgctcgattagtcgaacctggtccaggcctcggcccagaggcgctcgtagccgacacgtgcgaccagctcgatcgcgtcggtcggtcggctgggctcggctccaccctcgagcaggatgcgcgccatcgccgtgggtatgggatagtcaccgggggtctcggcgatacgagccagcccatccgggggtgcctgggagttcggtccgagcggtccccaggctccccaggcgcgcagcaccacgacgaggagcgctgcgggaccaagggtccgattgaccacctgctcggtggcacggcccggggggccagcgatccagctcgccccgaggtagtcggcagcgacgagccgtaccgggccgaaggtcgtcgtgaggtgtgccgccatggcgtcgagggacggaccatcctcccaatcgagcaccccgtcgacgagggacgctcgaggctcgagcgcgcgcgcgacggccagcaggcgctcggggtcgaggatgcggcgtcgtaggatcatgcgtcggcccgatcctgggtggtcggcaagccgaggcgccacaggagctcgcgctctgtcgagacgagggcgagcggtgtcgccgtgagcggagcctcgaggatgcgagggacgagcggcgcctcggcttgcccggcgacgatcggagcgaccgtcagcgagagttcgtcgatgagacggcgttcgaggagggtcgcaaggacggtcgggccgccctcgacgaggaggtggccaggggcgctcggctcgacgccacaggcaccgaagaggtcggcgcgcgtgcggatcttgtcgaggtcgacggcgcgagctgcgaagtcaggcgccgtggcgcgggtggcgatgcagatcgggacctcggtgcccccgatgccgaggcgcgctcgcagcgaccggagctcctcgttgcgcaccagcgcgggtccatagccctcgtcgcgagccgtggcagaccctacaaggatggcttgggccgtggctcgcaggaatgcgagggccgaacgatcggcctcgctcccgaggccaccggagcggccgtcgatggtggctcgcccgtcgagcgaggcgatcaccaccgcaatgacacggcaggtccctggcgcaaagtggcggccgaggagcgtggtcgggatccgtccggtcggccagtgctcggtcttcacgatctcacgctagccggctaggctcggttcgtcgtggagctgttcctcgggcgcccggccccaccagcgacgtcgacagcgttgatcgacgaactcgtggtgccgcgcgcgctggtcggggcgacgttcgacaactacgagccgaccgacgcctcccaggtgcgtgcgagagacgccgtgcgtgcctgggtgagcgcgatcgaggccccccgcccccggcgtccgtggagacggcgccatgggcggagggcaccgatggggatctacctcgacggtcccttcggcgtgggcaagacccatcttgcggcggctgcggtggcggctctcggcgatcgtgcacggttcagtgcgttcggtgacttgaccgcaatggtgggtgtgctcggcctcgagcgggtggtctcgctgctcgcggcctctcgcgtgctcgtgatcgacgagttcgagctcgacgatcccggcgacaccgtgatgatcgccaggctgatcggtgagctcttcgagcggggcacagcggtgctcgccacgtcgaatacgctccccgagcggctcggtgaggggcgcttcggtgctgatgactttcggcgcgagatcggccagctggaggctcggttcgaggtggtgacccttcgtggcaccgactggcgtcagcgccgcttcgacgcgctggtcttcgatcggcccctcgtgccgacgcgactgcgtgacgacctcgagcaccggcggggaacggagctcgtccgggaactcgttcgggtgcacccggttcgctatcgcggcgcgattcgcgggcaccccgggtgggtcatcgagggaccggtaccgctcgatgaccaagatagcgcgctgcgcctggtcgccttcgtggatcgagcctgggaggaagacgtggcggtcgtgctgcgcgaccagccgctggcgaccttgttccgtgagagctggctcaccggggggttccgtcagcgctacggcagggccctctcacgtctcgtggcgctcagcgaccgtggcggtccgcagcggcaggctgaacctggccatggtgcccccggttggtcggcgctcgagacggaacgcgccgccgagttcgtgggcacgggcgctgagattggcgagaccgtgcccgagggtggccccgtcggagtcgaatccgacgccgtcgtcgtcgacctcgagggtcaccgtccgcgcatcgacggcgatgcgtaggtcgacgcgctgggcttgggcgtgcttgacggcgttcgtcaggagttctcgtaccgcggcgacgaggtgtggccggagcgaggcggcgaccgcgaagtcgacggggccatcgaaggccacgctccgtcgcatgccggtcgcggcggtcaggcgctcgacgaggtcgagcacctcgccgcgcagtgacgttcggcgggcctgttcgaggtcgaagatggtggtgcggagaccctggatggtcgcgtcgaggtcgtccatggcgttgccgaggagttcgagggcgtggggcgcctcgatctctcggagcgccgcttggatggtgaggcccacgccgaagagccgctggatcacgtcgtcgtgcaggtcgcgtgcgatgcggagccggtccgtcgtcacttcggtcgccgcgagctcgtcgcgcagcgcgaggctctcgatgacggcggcgagggcggtggcgagcgcctcgaggacggcggcgtcgacgaggtcgaatgggccgccgtccgcgcggtcggcgacatagaccgtgccgtagatggcgtcacgaacgctgatcggtgcgccgaggaaggaccgcatcgcagggtgggactcggggaacccgacgctgcgagggtgcgtggcgatgttggcgatcgcaacgacgtgatcacgtgcgagtccgaggagccccttgccctcgggaagggaggcgatctggtctgcggtggcggggtccatgccggaggtgacgaagcgagcaagacggtcggggcgatctcgctgccacacaccgatggctccgtaacgggcgttcgtcagccctcgcgcggcctgggcaccgaggtcgaggagttcatcgaggtcgtgggctcgaaccaaggcgatgacctgatcgaagagcggccggagccgtcgcgccggaattgcctgaggcacctcgactagcctagcgatggcgctcagacggtctcggacgtcgcgtcgagttggagggcggtgccatgatcttgctggaagagaccccgatcgaagccgaggtacccgagatcggctcgggcgcctggcggggggtgcggctcctgcgtcgccactgcccggtcttcggcaccggcacgcgcctgatcgagggcgccaaactgaccggcacggggtccgatctcgcaccgctcgtggccgaaggggggttctgccctttctgtgccgatgtcatcgaggaggcgacggctccgttcccgaccgagatcgccgtgacgggacgcatccgtcaaggcacggcgtgggtggtgcccaacgtgctcgcgtactcggcggtgtccgccgttggcgtctatgaccccgggcgccacgtgctcgagctcgccgatttcgacgaggacctcctcttcgacgcctttggtgccatgctcgagcacgcccgagccgttcgtcgcctgagacccgagctcgtctggtcgtcgatctcggcgaactacctgccgccctcggggtcatcgttgctgcatccgcacctccagagttcacacgatccggtgccgcttgcggcccaagcgatcctcgaggcgaggagcgaggcgcactgggcgtcgtttggtcgagggttgctcgacgaactcgtggagctcgagcgcagcgcgagcgcacgcttcgttgcccagaccggtccctggtcgtggatcacgccctttgctccaagcggcttctacgaggtctggggcgtgcacgagcgcctgggcgatctcgtcgcgctcgacgaccacgaccgccgacagctcgcaggcgcgatggccgccgtcctcgccagctatcgcgccaagggtctgtcgagcttcaactaccagctgctcggggccggcccgcgtgggggcgagttcgacgttcgtgtgctcgtgcggatggtggcgcgtaccccggcggccccctggtaccgtagcgacgtcacctacttcgagaagcttggtttcgaggcgatgatcgatcacacgcccgaggcgttcgccgcggagctacgtcagacgttcggcacggggctctaacgacggggctcaagtcagagccctgagacgtccgatacctgcttcgttcaggcggtgtggcctcaggaggcatggatgcggacgctggcacagaagttgctcatcgcgatcgtgacgctcgcgatcgtcgtcgggattggtggcgccatgacggtcgaccaggcgctcgcctcgcggactcaagcacgcgtctacgcggccgaccaggcgcggctcgaggtgttgtcgcagaccatcacctctgacttctacgcctgggacgatcagatgaacatgtacgtcctcacggcgctcgcgacgccaggacagcacagcctgatcgctcagacgtaccagcaggcagcccaagccggcgcccagctcgaccatgacctcggcgtcgctgcgtcgctcccggcgacgcccgcgatccgagctgacctcgcacgggtcgcacgcgatgcacgggcctatggcgggtatgcgcgagaggtgcacgcggcggtcctagccggggcgacgagtcgagccgcctacatccagacggtgggcaacctcgcgccgtccaacgacatcatggtcgcgctctcgaacctcggccgcgacgcacggatcgacgcatcgggcgcactggccaacgtacgcgccaaggcagcctcggcggcgacctggaccgccatcagcttggcactgctgatcgtgctgctcgtcgcgctcgtcgtcgggatgcgccgttacgttctcggaccactgcgtgcgctcggcgcgtcgctgtgggcgcttgccgaggggtcgacgacggtcgagcggctcgatgagtcgcgggcggacgaattcggtgagatcgcaagagccttcaaccagttccggggaaggctcctcacgctggtggaccgcgtggccgcttccgtcgggacgttgctcgagagcgcccgcgaactcaccgaggtggcccaaggcctgagcgatggcgcacgcgagaccgcggaccagaccgccaacacggtccacgccgcccgggacgtcaacgagcacattcaggcggtcagcgtcgcagccgagcagatgcgcgtcgccatcagtgagatcgcgcgttcggcggccgatgcggcgggggtggccgctggtgcggttgacgtcgcaggcgcgacccaggggcgtgtgcaggccctcggcgagtcgtccgccgagatcggtgaggtgatcgcgacgatcaacgggatcgcggagcagaccaacctgctcgcgctcaacgcggcgatcgaggcggcacgcgccggcgaggctgggaagggattcgcggtcgtcgcgagcgaagtcaaggagctcgcgcgcaataccgctcgagcgaccgaagacatcggagccaagttggaggcgatccgctccgagagtctggcggccgtcgaggccatcggtcggatcagcgaggtgatcgcgacgatcaacgacctgcagtcctcgatcgcttccgcggtcgaggagcagtcggtcacgacgaacgagatcagtcgggtggtcgagctcgcgacccgctcgacgggggatatcacgcgcgcgatggaagacgtctccgacagttcgcgccgcgcggtcgactcggtcgacagcgcaggcacggtcctcgcccagctcgtcgagctcgcgaattcactcggagagctcgtcggggtcgcggcgacacggagccgcggcagcgatggtgccgcacggttcggcctcgcgcgtcacgacgccgatcgtagcgagtcgttcagcgcggtatcgtcgtgaacttgagctcgttgatctcggggtgatcgtcgaaggtcccgaggacgtggtcgagcgtccggcgggcaagcgcaccgtcgccattggggcgggtcatcaggcgtacgaacgcagctcggccgtcatcgaggatgacggtgggcacgccgaagacgcgaaagcgctcgacggcatcgtggtgtgcttcgccgagggcgcggatcgcgcgaggttcttcggcggccgcgagcacgctgggcccatcgagcccgctggcggtgagcacgtcggcgaggacctcgcgatcggcgaggtctcgcgcttcgtcgtggcgggctgcgaagagcgcccggtggacgcgcgcgaaggcttcagggtggcgatcgcgaacgaccacgcccgcgctgagcgcgagcagctggtcgcgcttggactcgtccgcgaagacgctcgtgccaccttcggggacatggacctcgaggagcgagaagggaacgaagtcgacgttccacgacgctccagcctcgagggccgcgagcacgtgctcatggaagttgcgggcgaatgggcaccgatagtcccacgtgacggcgaagtgcatggcgtacctccttcgaccaggctaacggctgcggggagaacgcgtgcagatgcaattacatgccggggctcggtgccctgagcgcgcggaggagctcgacgtcgccgccgtagtgcaggagctccggtgcgtcggccagggggatccaggtgacctggtcgacctcgacgccgtcggggcgaagctggcacggggccggcgcgagcatgaggaaccacgtcacgaccttgatgcgtccgtccgcgaggcgatagcgcgcgacgccgaccggcgcgatcgggaccgcatcgacgccggtctcctccgcgacctcgcgcagcgcacaggcgaggatgggttcgtcatcgatggccttgcccttcgggagtgaccaatcgtcgtagcgagggcggtggacggcgatgacggtgtcgtcggatccgatcacgatgccgcctccggcacgcaccagcccggcacggaccggctcagccacgccgacgccctcgacgagcgtcgccgggctcgaggtgctcgatcagtcggcgggcgaacgtgccgtaggccagcccgaccgcgatgccgccgagcacgtcggaggtgtggtggatccggacgtagatgcgcgacagcgcgaccgcaccagcgagcggcagcagtgagcgccgctgcgcaggcgtgcggccaagcagcatggcggcggcgaaggcagccgaggcatgaccgctcgggaagctcgaggtgcgcggatagcggagtccgagtgggtggggatgatcgcgatcgatcgggcgatcgcggtggaagacgctcttgacgacgccgttcacgagtacggactcgagtccgagtgcggcgatggtcagaagcgcccgacgacgagagcgcgcagagagcgcctgcacgcccgcgatgagcatccacaagatcgagtgatccgcgagtgccgtcagcgtgtagaacgtcacgtcgacgatccggtggccgcggagggcgtcgatcctgcggtcgatcgcggtgtcgaaggtgtgcagtgggcctgccgcggtgctggcgctcatcgggcggctcccatcgccgggcacacgtcacggtgtgggcagctcccgcagagccgtgaggggcggggcggaaagtcctcgcggtcgcaggcccgctcgatcgcgtgccagagcgcgcgaaggcgtgtggcgaccccgcggagcatctgtgcgctcggtgcgcgttcgatcacgctgccgtcgccgaggtagacgaggcgaacgagacggggtacgcggccgaagagcaccgacaccagcagggcgtaggtgaggacaccgccgagccgcgcgtcttgatgggacggtgggggggtccgcccggtcttgtagtcgacgaccacgaggtcgccctcgtcgtcgaggtccaggcgatcgatgaccccgcgaacgtggacgccctcgatggtggcctcgagacgcagttcggtgccgattgcccgaacgcgcgcgggatcttcgaggtcaaggatggtgcgcgagagggtggtgatggagcggtacagtgcagcgcgttctcggtcgtcgagctcggccacataggcaccgagctcgtcgtcacaggcggcggcacggaccgcggtgtccaccgcttcgttgagcgcagcttcggatcgacggtccggctctcgtcgatagaagtcctccagggccgcgtgaaccaaggtcccgaccgcgagcgggcgggtcggtggggttcgcacgccgtcgatcacactgcgccgaaaggcaaaggggcagtcgctgaacgccgtagccttggtcggggtcagggtcgctggcggcgcgagaggcatggcccaaggttaccgaggcggctcgagcggtgccgtcgagagccacgagcgaacgacgcttgcgacggcgtcgggatgctcgaaggggccgaagtggccgacgccgtcgacgatcgcgcagctcgcggacggcgcgcgttgggcaacgagtgcgaggtcctcggccgtcatggtcgtcgaggcggcgcccgcgaggatgagcatcggtgcgctgatggtggcgacgaggtcgagcgccccggtcgtgatgccaccgcgatacatcgcggcttcggcagcaggggcgaagcggaggcgaacgcccgcgtcgtcgctgacgaggcacgtgtcgaggtaggcctcgagcacgcgtgggtcgaacgaggccatcggcggcttggcgccgagccgttcgcgtgctgcttcgcggctcacaaaggaggctcgccgacgcagcgcgccgtcggcgagcgcgttggcctcggccagctggcgtgcgttcgtcgggtcgatcaggatcggctcaaaggccaccagtgcccgagcgggcacggaggcgcgtgagagtgccatgatggcagcggtcgcgcccagggagtggccgaggatcaccggggcgtccgcgaaccgcccgagtgcgtcggcgacggctcgtgcaaagacgttccagtccgtggcatcccccgggggtgggtcggagtcggcacctccgtgaccagggagatccagtccgaatgccaagccaccgagcgcttcggcgagtggtgcgtagcaggcggcgctgaaaccgcccgcgtggacgatcaaggtcgagatggccctggcgctcgccgagatcggtcgatgcagcaggacgaggttgggcgctggcagttcactgctccttctcagggactttcggtgcgacgtccaccacgttacggctaccatcgcggatgtgacccacctgatcgactcgctggtgtctcgcgatggcttgatcgccatcgtcgttctcatgacgctcgagtctgcgctgatcccggtgccctcggagctcgtgatgtcgcttgccggcttctttgcctacgaggggcatctcagcctcgtcggcgcgatggtggcgggcgtcgtcggcaacgtggttggttccgtcgtgctgtgggtcatcggccgtaccggtgggcgcgctctcgtcgagcgcttcgggcgctacgttctcctcaagcctcgagacctcgatcgcgcggagcgttggttcgccaagcacggcgagtcggcagtgatcgtctcgcgactgctgccggtggtccgatcggtgatttccttgcctgcgggagtggcagagatgcgggtggggcgtttcacgctgttcacgctgatcggttcgatcccgttcgtcgtggcgctcacgcttgccggctatttcctcgggagcagctacgagacgatcgtgcgcatcgtccaggactttggctacctcgctgccgtcgcgatcgtgctcgccgtggtcgccttcgtggtggcacgggcgagggctcgacgccgtggggccgaggcggcctgacccgagcgaggtctagactctcgcgtgcgcgggaagtggcgcagcttggtagcgcacctgctttgggagcagggggtcgcgggttcaagtcccgccttcccgacggccacagccacgcgggtgtagctcaatggtagagctccagccttccaagctggtggtgcgggttcgattcccgtcacccgctccgcatcggcgcttctgggcgcacgacccgacggtcgtgcgcagggggcgcgggcacgatcgaggcggtcgcgttgtcgctcgttcggacggattcgcgagcctcgcgcgtgccgacaccctcgggtcgtggcgggtgccgaagaacgtcagcggtgcgccggcatgagcgcacgcaaggactcgtcgtggctctggtgactcgcggctggccgtcgccatgcctgatacctggtagggtataaggagcggacatgggacgtgaccggtctgaagtcgagttgctgggtcggatttcgttcatgccgtttcgtattgcgctattatcagtgcgatagcagagaccgaaggaggcccccggtggtgcaggtcgtgcgccctagtgatccttccgaggagcttggcgctccgtcgctggactcggtcgtcggcgagggtgtcgacggacgcgtcgtcggcgatcagccggcaggcctcgacgagtccgaccctcggagcggagaggtcggcgacctcgttcgacgtctctcgcgcatcgaaggccagatccgcggcatcaagcggatgatccaggacggtcgcgactgccgcgacctcgtgacgcagttcgctgcggtctcgcgcgcgctcgagcaggctgcgttgaactacgtcacctcggagctggtgtggtgcgtcgagcgacctgacgaggccgctgagcacggctacacggtcgacgagctgcgaaagctgctcggtcgccttcgttagtccggtcagcgggccggcgcccccggtatgattggtgcgctatgcgctctaccacctctaccagcgatgatcgccgatcagccaccgtcaccgtcgagttcgagagtgacgaactcgcctccaagttcgacgaagtcctcgcgcgcctgcagcagcaggtgcgcctgccaggcttccgtcgtggcaagatccctcgtcagctcctcgttcggcgcatcggcgaagaggagctggtgcgcgaggctgcggaggcgttgatcgaggagcgcgtcggagatctcctcgccgagagcggtctcgacgtgatcggccggccggcgttggcgcgggtcgaggcgcggcccgagggaggtgccgaggccgagctgcgggtcgagctgcgtccgagcgtcgaggtcgcgggctggcgcgacatcgaggtgcgggttccggatccccgcttgacgagcgaggaagtcgatcgcgtgatccgtgagatcctcgagcagcgtgcggaggtccgtgacgtcgatcgtcctgtcgccgaaggtgaccaggtcaccttgaacgtgtggcgtgtcgagtccgacgggaccgaggcgctcgtcactccggacctcgtcgtgcgcctcgggcgaggtcaggttcctcgtgacatcgaggaggcactcgtcggcgccgtcgtcggcgctcgcgtcgagcgaccggtgccacacgagacgccgaccgacgctggggccacgaccgacgccgaggcaggggaggccggcgatgccgaggatgcgtcaccggccgacgcgccgccccaggccgccgcggatgcgccgagggagctctacgaggtgcgtgcgatccgggagatcgtcgttcccgaggcgacggacgagttggtggaggaggtcacaggccagccgacactggcggccttgcgcgaggccgtcgaaggagacctgcgctcggctcgcctgcggcgcgcccaggaagccttcgaggccggagttctcgcggcgctcctcgagaggacggagccgaagacggtgccgaacacgctggtggaccccgtctttcagcaggagatccgccggttcggctcgtcgctcgatgcgtcgggaatctcgctgcgtcgctacctcgatctcaccggccagagccgcgatgacatcgcgaggagcctgacggagcgctcggcggagacggtcctcatcgatctggcgctgcgtgccatcgctcgcgacgcggatctcgaggtcaccgacgaggagttgcgcgcggaggtcgatcgcttggtcgcgacgggccagattcgcgatcgcgaggaagcggcgcggccggcgatcgagacccagctcgtcgctgacgttttgttgcgcaaggcgctcgcgctgctccagcgggaggtgcacgtggtcagtgagtcgggcgaggcgctcaccctcgacgatctcgagctcgcgaacgccatcgcagacgtcctcggcgatgcgcctccgaccgctgaggaggagcttcctggttcgatcgccgaggaggcatcgacgcccgcaggttccgagaccgacgacgctcactaggatcgctctcgtggatcgaccgctcgcgcctcgtaactacctcgtcccgaccgtcatcgagacctcgtctcggggcgagcgggcttatgacctgtactcgcggttgctgcgcgagcgcatcatcatcctcggcacgccgatcgatgatgcggtcgccaacctggtgtgctcgcagatgctctacctcgagtacgaggaccccgaccgcgacatcaatctctacatcaactcgccaggcggggagatcaccgcactgttcgcgatctacgacacgatgcgcttcgtgcgaccagacgtgtcgaccttctgcttcggtcaggcggcctcggcggcggccgtcatcttggcggccggtgccaagggcaagcgatttgcgctcccgcacgcgcgcatcctgctgcatcagccctacggcggtgtcggcggccaggcgacggacatcgaaatccaggccaaggagatcctgcgcatgcgcgacctcctgaacgagatgctggccgaagcgactggtcaaccggtcgagcgcatcgcccaggacaccgatcgcgatttcgtgctcgaggctcctcaagcggtcgagtacggtctcatcgacgaggtcgtggtcgcgcgcgaggctcgttgaaccagcagcggaccccacctccgcgaccatgacgcgctaggctggacgagtccgcaccgttcgaaggaaggtgggcgatggccaaggtgggcgacgggcaagagatcgtcaagtgcagcttctgcggtctgtcgcagaagcaggtgcgcaagctcatcgctggtccgggcgtgtacatctgcgacaagtgcatcgagctgtgcaacgacatcatctctgaagagttgggcgagccgaagccggaagcggtcacgcaggaacgactgccgaagcctgccgagatcatggagttcctgaacgcctacgtcgtcgggcaggagtctgcgaagaagatcctctccgtcgcggtctacaaccactacaagcggatccggtccggcgcgaaggatgacgtcgagctccagaagtcgaacgttctgctgctcggaccgaccggttgtggtaagaccttgctcgctcagacgctcgcgcgcatgctcaacgtgccctttgcgatcgccgacgcgacggcgctgaccgaagccggctacgtcggcgaggacgtcgagaacattttgctcaagctgattcaggcggccgacttcgacgtgaagcgcgccgagaccgggatcatctacatcgacgagatcgacaagattgcccgtaaggcggagaacccgtcgatcacgcgtgacgtatcgggcgagggtgtccagcaggcgttgctcaagatcctcgaggggaccgtggcctcggtaccgccccagggtggtcgcaagcatcctcatcaggagttcatccagatcgacacctcgaacatcctgttcatctgcggtggtgcgtttgtcggtctggacgagatcgtggctgcgcgccttggacaccggggcatcgggttcaccggctcgctcgccgagcgcgatgggggtgagaacatcctcgcccgggtccaaccggaggacctcttgcgcttcgggctgttgccggagttcatcggacgactcccgatcgtgggcactatcgagaacctcgatcgagacgccctgatctcgatcctcaccgagccgaagaacgcgctcgtgaagcagtatcagaaggtgctcgcgatggacggcgtcgagctggagatcacgccgtcggcactcgaggcgatcgcggatctcgcgctcttgcgcgggaccggtgcgcgcggcctcaaggcgatcatggaagaggtcctcctcgacgtgatgttcgaccttccctcgcggtccgatgtccagcgctgtgtgatcgatcgtgacgtcgtgctcgagcacgcggctcccacgctggtgccgatcgatccggcgagcgagccgcgccgccaggcctcttgacgagcgatctcgcgcggtcggcggacccgcgtcgttggctcggtgagctccccgacttcgaggccgatcgcagcgtcaccgttcatggccctgccgtggtgcgggccgccctcgatgcgctcggcgcacccgaccgggacctcgtcgtggtcagcgtcgcgggcaccgctggcaagggctcgacggcgacgctactcgccgcgctcctcgcctcggttggcgtgcgagctgcactgttccgatcgccgcatctgtgtcgatgggaggagcggttcgtcgtcgcgaccgagccggtcgaggcggcggccatcgacgaggagctcgagcagatccgcctcgcgagcgaggcgggactgctcgtcccgttgacgcggttcgaggtcgagacggtcctcgcggtccagctcgcggcccgcgagggctgcgaggtcctggtggccgaggccggactcggcgcccgcgaggacgccaccagagccctcgagccggcgctcgcgatcgtgaccgccatcggtgacgatcaccgggccgagctcggcccgacgctcgagtccatcgccgctcacgagctcggcatcgccgcgggtgccccgacggtcgtgctcggcgagctcggcgccgtcggggaacgggttgcggcgaggcagctcggtgccgttccgagggtccggcgtctggggatcgatcgagccatcgtggagcgccacagcggcgtggcggggcagtccgtcgtgctcgacgacggccgtgagctgctcttgcccttcatcgggcgaccgggtgcgcagagcatggtcctcgcggtggtcgcgctcgaggagctgctgtcgatctcgctggaggcggcccatatcgatgcggtcgcgcgtcgtgcggtggtgcccggtgtcccgtggctccatcggcagccggttcgtgcggtgagcgatctcgcgcacaatgccctcgcgatccgcgcgctggccgagaccgtggcggagacgttcccgcccgacctcacatggcggttggtcatcggcctgacgcatggccgcgatccgcgtgccgtcttcgaaggcctcggcacgctcaaggtcgacgaggtcatcggggtcgacgtgggtgtggcgacggaggtgcttggcgaggcggcgcgcgagctgtggccgtcggcgcgctggcggagcgcggcgagcgtggaggaggcgttgtccgaggcgccggaggacgacgtgtggacgctcgtgaccgggagtctgcgaatcgtcgcgccgctgcgctgtgccgaggcgccgtcggggatcatcgcggtcgactaggctcctcgtcccgtatgcagcgcacgcttgtcatcttgaagcccgacgccgtcgaacgaggactcgtcggggagatccttgcccgtctcgaggcaaagggcctgcggttcgagcgcctcgaactacgccagctcgacaaggacacggtgcggcgtcactacgccgagcacgaggggaagccgttctacgacggtctggtcggcttcctgacgcgcggccccgtcgtggtcgcggcggtgactggtcccggggatgcggtcggcgcggtgcgggctctcatgggtgccaccgacccggcagtggcggccccggggacgatccgcggggatcttgctatgctcatcgacgaaaatctgatccacgggtcggactcgccgggcgcagccgctcgtgagctcgcgctcttcttcccggatcatcagtagtagctcaccaccgacatgcctgaggtcgcgatcggccaccacaggggaggttccagatggccagcgtaggaaagatgttcggacgcgatatcgccgtcgacctgggaacagcgaacacgctggtgtacgtgcgcggcaagggcatcgtcatttcggagccctccgtcgtcgcgatcaacgtcaacgacgggcgtccgctcgctgtcgggctcgaggcgaagcgaatgatcggacgcacgccatcgaacatccaggccattcgtccactcaaagacggggtcatcgcggacttcgaagtgtgcgagaagatgttgcgctacttcatcggtcgggtgagcgcgtcgaaggtctccaagccccgcatggtgatctgcgtcccgagcgggatcaccggtgtggagcgccgtgcggtccaggaggcggcggagtacgcgggcgctcgtaagcctgcctacatcatcgaagagccgatggccgccgcgatcggcgcgggtctcccggtgcacgagcccaccggcaacatggtcgtcgacatcggcggtggaacgaccgaggtcgcggtcatctcccttggtggcatcgtgacggcgaagtcgatccgcgtcggcggcgacgagatggacgaggccatcatcgcgttcgtgaagaagcaccactcgctcgccctcggggagcgtaccgccgagcagatcaagatgacgctggcgtctgcctacccgctcgaggaagagctgcgggcggagattcgtggtcgcgacctggtcaccggtttgccgaagaccatcaccatcaccaccgaggagatccgggccgccatcgaagagcccaccagccagatcgtcgacgccgtcaaggcgacgctcgacgcgacaccgccggagctcgccgccgacatcatggagcgcgggatcgtcctgaccggtggaggggcgctgcttgcgggcctcgatcggcggctgcacgacgagaccggcatgccgatcgttgtggcgaagaacccgctccagtgcgtcgcgatcggttctggtcagtgcctcgaggagttcgacgccctgcgccaggtgctgatcacctcgtctcgctgatcgagctcgtgtcgcgactgcttgcgagacctcgctcgaccctgctcgtcctgctcgtcgtcgggttgaccctggtgacggtgagctttcgatcgccgaacgcgtttcgtttgggaaccgtccgttcgctcgtcactgacctcgtgaacccggtgcgcaacgccgtcgacggcgcgtttcggccgttggcatccagcgtgcgcggcgcggtcgactaccagcaagccgaggccgagatccgcacactgaaggcagaggtcgcccaagccgaactcgcagcccgggagcaccaagctgctgtggcacagctcgatcagctctcccggctgctgcacttgccgtgggcgggctccatccccgtccagccagcggaggtcatcgggaccactccgtcgaatctgcagctgtccttcgtgatcgatcgcggcagcgctgcaggggtcgcggtcggtaatcccgtggttggtggcggtggtctcgtggggcgtgtcgtcgcggtgacgtcgtcgacggcgacggtcctcgagatcaccgatcccacgtcggtcgtcggcgtgcggctccccgggtcgggtcaggtcggtgcgatgacgggcagggggcttggcgcgccaatgtcggtctcgctcatccagccaggcacgccgctgcggcgaggggcgatcctcgtcacctccgggctccagggggggctctttccaccgggaatcccggcggcgcgcgtccggtcggtctcgaacccgttgaacgcgctccaggagcagatcagcgttgttccgctccagaacctgtcgtcgctcgcctacgtggatgtgctgcgttgggtgccgacctctggcagcggcgcatgaggtacctccgtgcgctcgtggtgctggtgctgctcggaaccgcgctcgtcatccagaacaccggcctcggacaggcgacgatcctcggggtgcacccagatctcgtcatggccatggtggccgcgatcggggcggtacgaggacgcgagtcgggcgccatcgctggctttgtcggtggtatcgcggtcgacgccttcctgtcgacgccgttcggcctgtcagcgttgatctacgtcgtcgtcgggtatctcgctggtgaggtggagcgcatcgacggcggcgcacccctcgcggtgcgctggatcgtcgtcggcctggcgagcctggtcggggagggcctcttcgtcgttgctgagttcctgctggggcttgcgaatcctcttcagaccaggctggtagaacagatcttggtcgttggcggcgtcaacttggtcatcgctccggtggtccttgggctcgtgcgcttggccttcgtgtcgacgccgtcgaccgtgagttgatcagggagcgtgcgatgcctcgacgtcgacgtcgcagccgtccgggctcaccaccaaccggcccgaggacgtcgttccgagcacgagtgctcggacttgcgaccctcgccctgttcggcggtctgctcgcccggctctattcgttgcaggtcctcgaagcaccgacctaccaacaggcggcggtcgagaactccgtgcggaccgtgtcggttcctgccccccggggcttgatcctcgaccgcaacggcacggtcctcgtcggcaaccaggtcgtcgacgtggtcggcctgtcggcctacgaggcatacctgcatccggcggtcgttggtcggctcgccaaggtgctcggattgagcgccgcgcaggtcaaggcggatctcgccaactcccagtactcgacctacgagcccactccgatcgccacgggcgtctcgcaggcgaccgcggtgtcgatcgaggagcacgcggccgagtttccaggcgtggtcgtggagctcgagacgcagcgcacctacccacagggcgacacggcggcccatatcctcggctacgtgggtccgatctcgccctcgcagctcgccaagctcgccaagtacgggtacgcggcgggagaccaggtcggtcgtgcaggggtggaggagacgttcaaccagtacctccacggtcgcgccgggtcggagcagctgctcgtgaacgcatttggtcaggtggtcggggtacgcaagcgggtcgccccgacgcccggcggcaatctcgtgctgtcgatctcgctgccgctcgagcgctatgtcgagcaggtgctcgcgacccaggtccgcaagctgtcgaactcctacaacagctacttcgggcgctacaccggcaacctcggcggggccgcggtggtggaggatccgaacaacgggcagatcctcgccatggcttcctatcccacgtacaaccccgagtggtgggtcgggggcatctcgacgcagcactacgcggagctgaccagcgcgtcggcgaacgacccgctgctcaaccgcgcgatctccgcagccttcacccccggctcgacgttcaagctcgcgaccgcttcggcggcgctccaggacgggctgatcacccccagcacggtcatcgacgacacgggccagttccagatcccgaactgcaccggatcgttctgctcgctccacaactcaggtggtgaggcgctcggccccatcaccatcacgaccgcgctcgctgcctcggacgacgtcttcttctacacactcggctaccgcttctatacgcaggcggcgcagttcggccagacgccgatccagaacatggcggctgcgtatggctggggtaagccgacgggcatcgcgctccccggcgaggtctcgggcatggtggactcgccccagctgcgcaagtacctccacgagcactatccacaggcctatccctacgacacctggtacgtggccgatcagctggagatggcgttcggccaggggctcaccgagatcacgccgatccagctcgccaacgcctactcgacgttcctgaacggcgggactcgctacgttccccagatcgccctcgcggtgacgaacgaccagggccgtgtgatccagcgcttcgcgcccaaggtggcgggacacgtgacgctctcgccgacggtgcgccagacgctcatccagggctacgaggaagaggtctccaatccgctgggcacgggctactacgtctggcagggttggcccgatgccagctacacgatcgccggcaagaccgggacggcgtccgtgtccggccaggtgccgaactcgtggtacgtcggcatggggccgatgcagaacccgcagtacgtcgtggtggtggcgatccccaatggagggttcggcgatctcggtgcgggtccggtggcgcgcgagatcttcacgtacctccgagcacacccggtcggcgccccgaactaccaggtctcccacctcgctgcgggatcgatcacgccagtcgggcagctcggcaggacctcggcgggctaaactgccggtgagcgtccccttggcctacccagcgtgactgcgagagtccgctcgcggtgggcacggggcttcggattccagtggggcgcggggtcgatcggagggtgatgcggtgagcaagcgtgctcagctcccgtgtcctcgtgtcgacccgtgggacatcgtctgggaagccgccatcgccgcatccgaatggacggcccccgacacgagttcgatggtggtccgcgggcccaggcggcgttcgcgcgtcggtctcgatgcgcccggtcgctcgcgcgccacccagcaaccgagaagagggtttcatggtcgatcagccaacaccgacggaccgtgggggtgcgggtcctgaaggagcagctccaccgcctcctccaccacctccaccacgagcgccaaaggctgcctcagcgccggccacctcgagcgctcaaggtcaggggcgacgacgtcggtcgcgaggagctcgccgcggctcagcggcgtcgagcgctctcgacgccacgtcggaggccgtagcagagacctcgccagccgatcggcccgcgagcgcagctggcgggcgcccagatggcctcggcgacgacgctcccgcgaacggagccgacggctctgggagcccggctcagggggccccgggtggagagggtagtggcccatcggccgagggttcgcgacgtcggcgttcgcgtcgcggcggccgcggtcggcggggtcagggaaccccgagcgaggcccggagcgagccggtgatgatggagatccaggcgccgctcgccgagccctcctcgcagcgtcaggggcgccgtagggcccagagtcgcctcccgagggagcggcgtggccgaccggtcgggcgctaccagatggccgtgcatgtccacggggacgtcacgcacgtcgcgattctcgagggtcgcagcttgatccagcacgcggtctctcgcgcgagcgacaccgagacgagcgtggtgggcaacatctatctcggacgggtggtgaacgtgctacccggcatggaggccgcgttcatcgacatcggcacggcgaagaacgcggtgctctaccgcggcgacgtgcgctacgagcgcgaggatctcgagggactcggtgacggcgcccgcatcgagcagctgctgcgtccgaagcaggtgatcgtgtgccaggcggtgaagaacccgatcgcgcacaagggcgcgcgcctcacgcaggaggtgtcactcccggggcgtttcgcggtgctggtgccgggtcagcggtcggtgggcatctcgaagcgcctcccagaccaggagcgacggcgtctgcgagggctcgtcgaggatctcgtgcccgagggtttcggcgtgattctgcgcactgctgctgagggcgcgacccgagcggaactcgagcgcgacatcacgcagctcgtcgggatgtggcagcgcatcgacgagctggcacgaactgagcacgctccagccctgctctaccaggagcccccagcagcggtccgcgtcatccgcgaggagttctcgcaggagttccgctcggtcgcgatcgatgaccgagcgctctacgaggacgtcgcgcgctacgtccagacgatctcgcccgagctcgccgaccgtgtcgagtactacgacgccgaggcagagggcgttccgatctttcagcgttaccacgttcagcaccagctcgccaaggcgctcgagcgcacggtctggttgccgagcggcggatcgctcgtcatcgatcgcgcagaagcgctcaccgtcatcgacgtcaacacggcccgcaacgtcggggcggtgtcactggaggagacgatccaccgcaacaatctcgaggcggtcgaggagatcgctcggcagctccgactccgcgacatcggcgggatcatcgtgatcgacgtcgtggacatggtggacccgcagaaccgtgacgacgtgatgcgggcgttccgagcagcccttgctcgcgacaagacgagaacccacgtctacgacatgagcccgctgggtctcatccagatgacccggcagcgcatcagtgagggcctcgtggagtcgctctcgtcgacgtgcccgacctgccatggccaaggctacgtcctggacgaggatgtggtcgcgagccgctaggctcgtgcgagctatggacgcaatcatctcaaccgggggccgccaagagcgggtgcgcgagggggacgaggtcctcctcgacctccagtcgttcgagggctcctcggcgcggctcactccactggcgatcatcgacggtgacgaggttctcgtcgccccggctcagctcgagggagcctatgtcgaggtcgacatcgtcggggtggccaagggtcccaaggttcgagggttcacctacaaggccaaggcgaacgagcgtcgccgttacggccatcgtcagcggtacgtccgtgtgcgcgtgacgagtgtccacgtcgagcgcgcggcggcagtggagaggactgcgtagccatgtcgaagaccaagggtggcggatcgacgaagaacggtcgcgactcgaatgcgcagcgactcggcgtcaaggcattcggtggcgagaccgtgaaggcgggctccatcatcgtgcgtcagcgcgggacacgattcttcccgggccacaacgtcggtcgagggcgtgacgatacgttgttcgcactcgccgcgggccaggttcgcttcggcgttcgtcgtggtcgtcgcgtcgtcgacgtcgagcccgccggggagtcgctcggctaggcggccgagcagcgtgtcgagcttcgtcgatcgcgctcagctccatgctcgagcgggcgatggcggggcgggtgcggtctcctttcgccgtgaggcccacgtggatcgtggtgggcctgatggcggtgacggtggtgatggcggaagcgtcttcgtccagggcgacgaaggcgtcgcctcgctgatcgccttccgcgatcagccgtttcgccgtgcagaagatggccagcatggccgcgggcaacggcggcatgggcgtcgcggccgagatctcgtcgtgcggctcccgctcgggacggtcgtgcgtgatggcgagggcaacgtcctcgccgagatcctcgacaccacgacccgcgtggagatcgccagaggtgggcgtggggggcaggggaacgctcggttcctctcgaaccgccgccgtgcgccggcgtttgcggagcagggcgagcatggcgacgatcggtgggtcaatctcgagctgaagctcgtcgcggacgtcgcactcgttgggcctccgaatgcgggcaagagctcactcgttggggtgctcaccaacgccagaccgaagatcggggactatcccttcacgacgctcgagcccaccctcggcgtcgtgcggcgcggccccgagcgcgagttcgtcatcgctgacgttcctggtctcatcgagggggcgagtgagggtcgtgggctcggccatgcgttcctccgacacgtggaacgcgcgcgggtgtgcgccgtcgtcgtcgacgcggcgagtgcggcaccggagcgcgatgccgcgacgacgttgcatgagctccacgcgtatgccccatggctcagagagcgcccgacggtcgtggtgctccagaaggccgatctcgtcgacgaccgagccatggtggccgagcgggttggtgacgcggtcgggctcccggtggcaggtgtcgtctccgctcaccagcgggagggtctcgggccgctgctcgacgtgttcgagcgactcgtggccgaggcgcgggctcgggcggcggcggggccggcggtgaccgtgctcaggcctcgggcgcgtgtggaggcggaggcgcgtcgtgtcgcgcccggggttttcgagttgctcggacgcgacgccatccgggccgtgcgcttgagcgatctcagcgacgagggcgccttacgggtggtgcacgagcgtctcggagcgcttgggctgttgcgggcgttgcgccgtctcggggctcgcgatggcgacgtcgttcgtgtcggggacctcgagctcacctacgaggacgaggcgtgatccggcgcctggtggtgaaggtgggcacctcctcgctgacgaccgaggcgggctcgctccgcaccgagctcatcgggagcctcgccgctcagatcgccgagctcgagcggagcggcgtcacggtggtctgggtcgccagtggcgcggtcgccgtcggactggctcgctgtgggctgacgaggccgcaggaacccgacgtcctccaggccgcgagcgcacttggtcaggtggtgctcgcgtctggactcatcgaggcgctcggagcgcatggagtgctgggaggacagatccttctcacctcggatgcactcgccgatcgtcggagctacctgcatgcgcgcaccacgttcgaggcgctgtttcgcctgggtgtggtgccggtcgtgaacgagaacgacgcggtggccagtgacgagatccgcttcggcgacaacgatcggctcgcggcgctcgtcgcacacctcgtgggtgccgatcggttgctgttgctcaccgatcagccgggcgtcttcgccaaggatccccgttcccatcccgacgccgacctcatcgaggagctgacgcccgaggctgcctcggtggtgacgctcggtggtgccggcacgatgcgcggaagcggcggcatgagctcgaaggtccaagccgccgagatcgcggcccgttcgggggccgactgcctcatcgcgagcgcggctcgtgccgaggtgatcgtggacgccgcgcgcggacgtccgctggtggcgaccctcgtgcgacgccgtcgtcggcgtgagcctgcacggaggttgtggatcgcctacgcggcgacgcctcagggtcgcgtggtggtcgacgacggagcgcgcgatgcgctcgtcgagcgcggcgcgtcactgctcgccgtcgggatcgtcgaggtcagcggggagttcctcgccggcagcgtggtcgaggtcgccgaccgatcagggcggctgttcgccaagggcgtggtgcgggtcgattcgagggatgtgcgtcgttgtcgcgacgaggtcatccaccgtgacgacctcgccatcctcgtcgagggccccgggccgagagagcaccacgcagacggatgactcgtccgcaggtcctcgctcggttcggagtctgccgcgagggttgtgcgcgagcgttcggtgccgtgccgacgaggcggccttggcgagcgacgccgccttgaccacggccgagagccgtggtggcgtgctcagacgagctcggcgatgcggcgagcgagcttgtcctcgatctcgcgattccacgcgagctcggcgagatcgagcggcaggaacaggtcggagatgagcagcgtctccacgcccgcgacgacgaggtccttgcgccagttgccgacgccgatcgtcacggtgacggggctcggtgtgacggtgaagacgagggcccgttgcgcatcgatgatctcagcgaggaacccacccttcttggcctgcagcacgaaacccttcgtgccatccccggccatctcgacggtgaagccatcgccctcgaggagttggcgtaccttggtcgcgagctcactcgggtcgacctgcttgtcgccgaaggtcacggtcttcttgcctgccatggagtactcctcgtggtcggatcgtgccttcatagtctcgacgaccgggcgggccagcgcaagtcgcggcggtgtcgtcctctcaggaaccgaccgtgccgtcgatgagttcgcgcaggaggtcagcgtggccgttgtgacgggcgtactcctcgatcatgtgcgcgaggacccagcggatggtcggagcgccgggctggcgtgcccacgtcagctcgcgcccgtcgatggcgcgccggctcgcatcgatcgcgctctgccaggtggcgaggtcgtcggcgaagcccacgggagcgtcgatgagaaaatcggcatccggggtctctggatcccagaaccgaggtgcccagccgtcctcgccgaggagctgcttgcgaaaccaccacgcctcgacgtcggccatgtggcgaacgagtccgcgcagcgacaggagcgacgtcgcgatcggacgcgtcgtgagctgctcctcggtgaggccttcgaccttgaggagcaacgtggtgcggtggtagtccaaccatccctcgagcatggcgcgctcgccatcgtcgaaccctggttcgactcgcctgggatcgtgcagttcaccgaccgtcgctggcatcgttgcgctctccttgctcggtggggtccgttaccagtgtcaccaccagctccccgtctcggcaggctaccgggtccgacatcgtggtgggtgtggcggatgcgtggtgcctccaggttcgatggcgagcgccgagcgcacgttagagctcttggaggccttcgagtccaaagaaggcctcgcggagttggttgtcgtgttcgaaggcgtcgcgagggccgctgaagcgcacccgaccaccctcgaggacgatcacgtcggtcgcgagctcgaggaaggagacgttctgttccgccacgagcagcgtgatgccctgggcatggagatcacgcaggcgatcgatcacctcgttcacgatccgaggagcaagcccagccgagggctcgtccatgatgagcaggcgtggggccgccatgaggcacttggcgatcccgaccatcttgcgctgtccgcccgacaggctccctgctggctcgccgagacgatcggcgagctcggggaacatcgcgaggacctcgtcgatgcgcgctgctcgctccctctggcgaaggcggaggccaccgaggacgaggttctcgcggatggagagactcgggaagatgccctgctcgctcatgaacgcaacgccgagacgagcgcggcgatgggcaggcacccggtcgaccgactcgccgaacagcgagaccgacccgccgcgcgtctcgtggaggccgacgagggtggcgagcaaggtggacttccccgctccattcgcaccgaggacgagggtggcggcgccgtcctcgaccgagaacgtgatgtcccagagcacctggacggggccccacgcggccccgagaccgtcaatcgtgagcgctggtggtgccaaggaagaccctttcgacctcgggatcgcgcagcgcgtcgcgcagcggtccgacgaagatggaggagcccgcgttcaacacgacgaccgtgggcgtgacctgctcgaggaagccgagcaggtgctcgacgacgacgagtgaggttccctcggccgcgatctcgttcaagaggcccgcgatgctgtgcagttcggctggggagagtccagcgccgagctcgtcgatgaaaaggacgcgtgggcgcagcatgagggcacgtgcgagatcgagcagcttctgctgcgtggcattgagcgtgccggcttcggacgctccgaaccgcgcaagtccgaggcgctcgaggagttcgtcggggtccacgtcgccccgtgggtggcgcgtgctcgtggcaacgaggaggttgtcgcgcaccgtcatcccgcggaacgggcgggggatctggaacgtccgcccgatgccggcgcgcgcgagctggtggggccgtgccccggtgatgggcgtaccgtcgagcgtcacggtgcccttcgtggggcggttgaggccgcagatcgcgttgatgcacgtcgtcttgccggagccgttgggccccacgaggccgagcgcttgggcgggctcgaggtcgaagtcgatcccggcgagcgcgacgagcccgccgaagcgctgttcgagtcccctgacgctaagcagtggcatcggggagctccttgggccgccgaacgagcagcccgcgaacggcggtgaggatgccggcgaggccacgaggtgcgaacaggacgagcaccacgatggcgagcccatagatcagctggaaggcctgtgggtcgctcacgccgatgatcgcatagagcgcatagaggaccacggcgccgatcgttgggccccacagggtgccgacaccaccgaagagtgcgaagacgagggccagcacggtcgtggtgacgtcgaagacggcggtggggtagaacagggaactcgcccagccgtagagggcgccggccatgccggcgatcgcgcaggcgatcagccacgccacggcgcggcgcatcgggacgttgacgccgaccatcgaggcggagtagggctcgtcgcggatggcttggagggtgaggccgaaccttgagttgcgcagccagaccaccacgatcagtgacaggccgacgagcacgatggacgcgacgtagaactggccggaggagtaggcgctcgcgaggttgaggccgtccggaccgttcgtcacggaggtaagggccgggttggcgacgatgtcggcgagggcgagagcagctgcgagggtagcgatcgcgaagtaggcacctcggagccgaaacagtgggatgagcacgaggccgacgacgacggcaccgaggccgccgacgagcacactcgcaagtgccgggacgtgcaggtggatgatggcgaggccggaggcgtaggcgccggctccgaagaggccgaagtaaccgaacggaagataaccggtgaaaccgtagatgacgttgatgccttgagcgagcgcgacgtaacccatcatatagacgagcaggagttcgttgccgtagatgtggaggccgaacgcaaagccgacgaccgggacgacgacgccaaggccatcggcgatggctcggcgccccaggcgtcgtcgtgagcgccgttcggtcgtggggcgttgggcgagcgcaggctcaggcaacgcgggccctccttccgaagagaccttcgggtcgtagcagcatcgtaccgagaacgaggacgtaggggacgaggttcgaccattccgggaggtagacctgcgcgagctgcgacaagacgccgaaggcgatgccggcgacgatggtgccgatcgggttgccaagcgatccgaagacgatgatggcgaacgcggtgatcgtgaggctcgctccctcggacgggtcgacccccgagaagacgacgatggcgagaaccccggcggcggccgccagcgcgatgccgacgccgaaggtgatcgcggagatccgacgagtgtcgatgccgacggcgagggcctcgcgcgcgtcggccatcacggctcgagtctcgaggccgagtggggtgcgatagaggtagaggagaaagagtacgagcagcggcagtgacaccgcgccgacgatccagaggtaggcggggtagctctcgccgaggaagcggatcggatgcgaggggagcgccgcgatcggcagtgtccgttcgttcgggccgaacccgatcgccccgagtgcctcgatgacctgcgagatgccgaagaagaggacgagcgacatggtctcgatgtcccgagcgcgtgcgagcctggggacgacgaggcggtggaaaccgtagccaacggcgacgccgaagggaaggacgatcaccgcggcgaggacggggctcatgtggagggcgctgtagagatcccaggccgcgaagccaccgagcatgacgacgtcgccgtgggcgaggttgatgatgcgttggacaccaaagacgatgttgaggcccatcgcgaagagggcatagaagagcccgagcaggacccctccgatgatcgcaaagagggcgagcacggcggtacggttcctccagccagtcatgcgcggatccgccaccgagcaccggtggcggatccgcgtgaggtggtcgttacggtgcggggtagacggcgctgaccgggttcggtgcaggcgatgtgaccggcttcagggcgaccgtgttgcccgatcccgggaacagctgcgcgagcggcagcaactctcccgtctgtgctccctcggagttgatctggaacgtgccgtcgacggtcgtgaggttacccgagaccgaggtcagcgcgttgcgcagcgccaactgggacaacgaggtcgcgtgccggagcgcggcttcgaccaccagaccggtgttgtagccgagcaggcccagtgtgttcaccgcgctcgggtaggtgctctgcagcttggccatgaacgccgaggtggtgaggccttcggtcacggagttgtaggtgttgtagaagttggtcccgtaggtgtaggtgtactggagaccggtcttgccgagctgcgactcgaacagcgagagcagctgccccgggaagacggtgaacaccatggggaagtggtcaccggagctctcgagttgctgcaagaacgcggtgtcgttcggctggtagccgagttcgagcacggcgccaggcttcttcgcggcgaggctcgagatgatggtcgagtagctcgtcgtcgacgtcgggacctcttcgtaggcggccagcgagacgtgggccgcggtcagcttggccttgagcgtctcggcctgcgagccgtcgaagtcattgcccccgtagacgatggccacgttgttgatgtgcttcgagatgatgaagttcgccaacggatccggccagatcgacgacaccggtaggtcgcagagcacgatgtagggattgcccggggtgaagaacgggatgccggttccggactggtcgaagagcaggtagtgatgcgcctgggcgatcgagacggccggtgcggtgagcacggacccgaagtcggcgacgaggatgttgaccttgtcctgcgtgatcagctggttggtgagcacgccggccgtcgatgggttggactggtcgttcagggcgatgagcttgaccggaatgcgcttgtggtaggcgcccacgtagacgccacccttcgcgttctcgaggctgacccagagcttcaggccgtcgagttcggggatcgaactcgtcgcgtactcgccggacgaggcgtacgtcgttccgacggtgatctgggacggagccgccggcgcgctcgagctgctcgaactgcttgacgaggagctcgagccgcacgctgcggcggtgagtgccagcgtccccaacgtgagcgccccgagcgacgctcggcgaagacgcggacgaagacgtactcgcatgtggtgttcccccttgtatcccacggagtggtcgccgctgcgccgcactgcggctgcggtgcgccaaaccgacggaagcataggtggtggggtttcgggggccaaggcgatgtcgatactatgcacagtctgcattcaggcaagattcaggttccctgatcacccgcgtcggtgacctgtgtgccgtagactggacgcgcgggtcgcgacgccgtgcgacgtcggtggtccccgacgagtgggtcgggtcgatcggtgggtcgagcggctcgcgagccggtgtcggtcagggcgccgggacagcgcaggagtgggcttcgccggagttggagcggtcagatgatccaaagtgtcgaacaagcgcaggtcgatcgggtcgacgcgcgagcgatcgaagcggtcgcggtggcggcccgggcggcacaaccgcagctcgcggcggcgcccggtgagcagcgccgggcggcactgctcgcggccgcgcgggagctgcgcgcgagcagggctgcgattctcgaggcgaacgagcgtgacgtggccgacgcggtcgatctcacgagtgcccagcgggaccgactgcgcctcgacgatgcgcggatcgaacagatggcccagggggtggaggcggtggcggcccaacccgacgtcgtcggtcgggtcgtcgatggctggacgttgccgaacggcctgcgcgtgcgtcgggttcgcgtcccgctcggtgtcgtgggtgtcatctacgagaatcgaccgaacgtcaccgcggacgccgccgcgctcgcactcgcgtcggggaacgcgatcgtgctccgcggatcgtcccaggcgctcgcgtcgaaccgtgtgatccggggcgcgatcgcgaggggggtcgcctcggtagggctcccggaggcgctcgtcgggctcgtcgaggacacgtcgcgagagggtgctcgggcgttcatgcgcctcgagggcatcatcgatgtgctggtgccgagagggggtccggggttgctccgggcggttcgggacgaggctcgggtgcccgtgatcatcgatggcgacggcaactgccacgtctacgtcgatcgggcagccgatctcgcgaaggcagctgcgatcgtcgagaacgcgaagctccagcgacccggtgtgtgcaacgccgccgagacgctgctcgtccacgcagccgttgccgacgagttcctcccgcagctcgccgagcgactcggttcgtgcgaactgcggggcgacgagcggacgcgagcgctcgtccctcgggcgttgccggccacggccgcggactgggagacggagtatctcgcccccattcttgcggtgcgggtcgtcgacaccctcgaggacgccatcgcccacattcggcgctactcgagcggtcactccgaagcgatcgtcacggaggacctggctgcagcgacgcgcttcacgggcgaggtggacgccgcagccgtcctcgtcaacgcctcgacgcgcttcgtggacgggggccagctcggcttcggtgcggagatcggtatctcgacccagaagctgcactggcgcgggccgatggggaccgaggcgctcacgagcgtcaagctggtcatctggggcgacgggcacgtgcggacctgattgggggcgctagcctggggtggacatggtcgcttttggctcgccccaggtggtcgcggaccggcttcgagaggtcgggtacctcccgaccgatgagatcgcgacgacgatcttcctcgccagtgtgctcggcaaacccgtgctcgtggagggacccgcaggaaccggcaagaccgaactcgccaaggcggtcgcgagggcgtgggggctcgacctggtgcgcctgcagtgctacgagggtctcgacgagtccaaggcgctgtacgagtgggattaccgcaagcaactcctggcgctccagagccacgacgatgacctcggctccgtcttcgacgaggcgttcctcctcgagcgtccgctgctgcgcgcattgcggatgacgagcgaccgactgctgctcatcgacgaggtcgatcgtctcgagatcgagaccgaggcgctcctgctcgaggtccttgcggagttccaggtcacgatcccagaactcggcacgctcgcggcgacgagtcgaccgctcgtcgtgctcacctcgaacggcgtgcgtgacctctccgaggcgctcaagcggcgagccttgttcctcttcctcgactatccggatcccgagcgcgagcgtgcgatcgtcctcgaggcggtgccggggatcgaggcgagtctcgccgatgccatcgcacggttcgtcgcaagcgtgcgcgagctcgacgtgaagaagcgaccatcgatcgcagagaccatcgactgggctcgtgcgttggtcgtgctcggtgccgatgtgctcgatcgcgagaccgtggagacgacgctctcgctgctcctcaagcatcgtcacgacatcgagcgagtccggcgcgagctgctcggggcggccagcgcgtgatcggtcgcgtcctcggcctcgggcgcgcactcgcggaggcgggcgcaccggtgagcccggccgagctcgtcgatgcgctgcgtgccgtggctgcgctcgaggatctggcgcgctcgccgctcagggctgcgttgcgcgccacgatggtcaaggacgtctcggcgcttcccatcttcgacgtgctgttcgacatctatttcccgatggcgaacccgacggaccaggacctcgcggagctcgacgatgcagcgatgcgcgccgagctggaggttgcgttgcgcgatggcgatgacgagcgactcgctgcgctggctgctgccgcggtcgagcgtttcggcgaggtgcactctggcgccgcggtcgctggcgcctactacgcctatcggacccagcgcgggctcgatctcgagcgggtgcgcgaggaactccttgcgggcttggcccgcccccacgacgccgaactcgactggcgcgagcgagaacgcgaggcgaggcgtcgtctccagtcgttctcgcgccacatcgacgatgcggtacgcgcgcgtcttgctcgcgagcgcgatcccgacgaactcgcgcacagcctcggcctgcgcatcgccgacgacgtcgacatcatgaacgcatcacgcgaggagttggcggcgattcgcgaggccgtgcgtccactggctgccaaactggtcgcacggctcgagcggcgtaggacacgccggggcggtccactggagctgcgtcgcacgatccgtcggtcgctctcgaccggtggggtgcccctcgagcccgtgttccggccgcggcgaccgcatcggcccgacgtggttgtcctcaccgacatctccggttcggtggcgtcgttcgcccgcttcacgctccagctgctctgggcgctcgcaggggagctgcgtcgacttcgagccttcgccttcatcgacgccgtcgacgaggtcacccccctcgtcggggggtcgtgggacctcgacgctgcgcttcgagcggtggcagagcgcgccgcggtggtcggcaagcagggtcactcggactatggcgccgtgtttgcccagttcgaagagcgcttcgtcgacgccgtcagtccgaggaccacgctgatcgtcctcggcgatgcccgcgcgaactaccacgagccgcgagccgaggtgctcgatcggctggcgcgacgagcgcgcgccacccactggctgaacccggagccggcacgctactgggacagcggggactcggtcatgggcgcctacgccccatcgtgcacgtcggtcgtcgagtgtcggacgctcgcgcagctggagcgcttcgtcgaggaggtgctgtaggctctggccggcgaggcgcccggcggcgacgatgtcacgaacgcgacgatgtcacgaacgcgacggcgtcacaaacgcgtcaaggtcgcacgagggctcccgcgtcaggggcatgccgtgtcgaggtcgaccgcggtgccgttgccgttggcagagaaggccgtcgtggctccgtactggacgtagcgaatggtgccgccgccgaagggggcatactcggtcccggcggtgcccgcgcagacgctggctgggtccgccccgggatcgggaacccagaggggcgtgccggcaggcagggtcgcgccgccggtgatgtcaccccactggtagttggtcgagtagacgcctgcgctcacgccgaccgattcgaggaacgcgagggccccgtagaccgcgtcgcggttggcggtcgtcgagctcgtccacgatccgctgagctcgacgtccagccaccacgcgttgcgcagcgtgctcgaagtggagccgagatcgacgaaggaggtcgcgtaggcgtactcggcttcgtcgtagccgtaggagaagtaggcaccgggcccgctcgccgacgtggcgctcgtgtagagctgaccggccggcgtcgagagtgctgcctggggcaccgggttgaaggaggtgccgttccacgtcgaccagcttgcggtgccggcgggcgggatcgcgagcggcgccatgttggtgccctgggggatggtgttgctcgcgccggcaaagacgtagagctgggtgctggagccccccaggccgaccgcctgttggaacgcgtccggggcgcagccggagttgctcgtccagtcgtacgagaagggccagccgttcgactcgacgagcagcagtgggtcaccgacaggaaggtaggggaggttcgagcagttgaagttgctgaggtcgaccccgctcatggcgggcagttcgatcgccccgacgatggcgccagggagcgggtgcgaccccgcaagtcccgtgtagcccatcgagtaggtggtgccgtcgaagctcgcgtccccgaaggtgaacaccccgccgtcggctgcgaccaaggtgtagccggcaccggtagggctcgggtcgatcccgacgacgggagctgcgagcggacgagacccaccgagaccggtgagccccaaggtgtaggtgttgccgtagaagccagcatctccgaagctgaacaccccgccgtcggccgccaccagccaatagcccttgccgtcgggggttgtggccatcccgacgaccggggctgcgagcggacgtgacccaccgagaccggtgagccccaaggtgtaggtgttgccgtagaagccggcgtctccgaagctgaagacgcccccgtccttggccaccagccaatagcccttgccgtcgggggtgggcacgatcccgacgatgggggctgcgagcggacgagacccaccgaggcccgtgagccccaaggtgtaggtgttgccgtagaagccagcatctccgaagctgaacaccccgccgtcggccgccaccagccaatagcccttgccgtcgggggttgcggccatcccgacgatgggagctgcgagcggacgtgacccaccgaggcccgtgagtcccaaggtgtaggtgttgccgtagaagccggcatctccgaaactgaacaccccaccgtccgcgccgaccagccaatagccgccaccgcctggcacggcggctgccccgacgacaggagcagcgagcgggcgagacccgtagagacccgtcagcccgaggttgtagaccgagccgaaggtctgtgtcgcgaacgggtacgaggagccatccgccccgacgagaacatagccatcggctggcgtggtcgacgaggccagggtggccgccgtgtgcggggcttgcgccgtgagggggcggtcggtcgcgagtccggcggcggtgacggccaagaggctcgtcgcggcaagtgttccgagcgagcgtcgtagcaaccggtgcgacatgagcggtgcgatcctccgtgcgtgcgtcgtgtagcagaggggatatcggcacgccggctcgaaacgttgagccgagcgcgtggcgcgcccacgaggtcggccgcttcgcgccatcgaggtggttccctacgagtggtgctcggtgtggccggcgtctggcgcgacgaactcgttgcgcatcgtgccgatcccctcgacggagctctccaccacgtcaccgggccggaggaagacgggcggccttcgaccggcaccgacaccatcgggtgtgcccatggcgatgagatctcctggctccagggtcatgatctcggagaggtaggcgatggtggtcgggacgtcgaagagcatgtctcgtgatcggccatcttgcatcgtggtcccgttgacgcgcgtggtgagagccacgtcacggacgtcatcgacctcgtcgcgggtcaccatccatggcccgacgggcgtcgaggcctcgaagatcttgccttggaggaactggctcgtgcgatgttggtagtcgcgcatggagacgtcgttgacgacgacgtagcctgcgacgtgctcgagtgcatgggcgacatcgacgtggcgagctcggcgaccgatgacgacgccgatctcgacctcccagtcgacctcatgggacgtgaccgggagcgtgatctgatcgaaggggcccgtgagggaccgtgggaacttcgcgaacaaggtcgggaaggcgggacgctcgtcgtgacccatctcgtccatgtgcttggcgtagttcagccccaggcagatgatggctccgggggtcgtcacggtcggggcgaaacgggcgtcggcggcttcgacggcttcggctgcacgcagctcgccgaacgcgccgaggtctccctcgacggcgcggagcgccgccgcgaggtccgggaatggtaacagccgccaatgggtaccgaaatccatcgcggcgtgcgttcccgttgctgtgcggatagtggcgaggcgcacggttccctccttgtgcgacgcggtgcgtgggtggaacgctagttggactggtcggcgtcgtcggagctggcccggatggtctcgagctcgatggtgagcggtgccgccgactcgctcgagcagcgcgggcaggggtcccgatgaatcatggagcgtaggatgcgagatcccgatggattgaggcgaacgaggaaggcgcccgagaccgggtcgacgacgacggagtcatacggctcccaccgagacgggggcaccatcgccgctgcatcggggtgtgcttggttgcggggcaggcgcacgaaccgatgctcgctcgtgtcgaagatccacgtggagttgcaggtgtcgatcgtctcgtagcgcccgacgtcgttggagggctgaggtgtcatgtgtcggctcccggtcggcgggttggcccccacagtgtacccggtgggcgctgctcgcgaagagagagtgcgcgggtggagttggctagtcttagggctttgcccgccgcaccaaacggcctcgaggaaggagcacgtcatggccgaagaggaacagccagcgagtccggaagaagaggagctcgccgccttcttcgacgacgaggacgcgcccgaggatcgcatgacgttctctgccttcgatgggtttgcgaccggcatcgcgctcgcccccgaggcggtcccacaggcggcgtgggtcgcggtcgcgcttggcgaggcggccgatgaggcaccaccgcgggtcatcgagttgatggcgcactacgtcgacgagatgcgatcggtgctcgactcgaccgacgtgagcgagcgattcgtacccgtcttcgacctcgtgggcgaggacgacggcgaagagctcgtctcgccgtcggattggtgcgcgggatttctgatcgcgaccgagttctaccgtgacacgctcgatgcgctcgccgagacgaacgacgaggtggccgaactcctcgtgccgatcatcagtttcggtaccgatgagggtctcgacgcgctcgaggagagcggcgacgaggacagcctcgcggacgaactcatcgacgcgatccaacccagcgtgatcgccctgcgcggatacctgcgctcggcttagtcgacccgcgcgacggaagcgtcgtccgcgtcgaggggcgcgcttgcggcgcctgtcgcgatggtcggtgcgtccgcccagaggcgctcgagctgatagaactggcgagcctcgggtgcgaggacgtggatcacgatgtccatgcagtcgaggacgacccaggggtctcccgggcgtccttcgacgcgtgggtggagtccgagatcgcgacggatctggcgaacgagatcggtgacgagcgaggcgccgaggcggggatttcgcgccgtcgcgaggatgaagtgcgtcgcgatcgcggtgagttccgccacttccaagaccacgacgtcatcagcatgcttgtcctcggccatgcgggcgatcgcgagcgcgtgcgtgcgctgatcggagagccggaggcggtgaagatcgtggtcggtgctcacaccagggtcgtggaatgggcgcagggtgctgtcggcgatgtcgatgatggggcctcctcgtcgtgatcgttcggttgggcgcgacggcactcgagactcgtgattgccgagcggtcctcggccgagagcacggcatcgcgcagcggcgggcgacaccgaccgaggcgatggaactgacccagtcgatgcagacgaggacggacggacgcttgctcgccgagagctatctcggagcgaccgctgcacgcgagcctgcggtgctcgggcctgctcgaggtcgtaggagatggtgacgccacgcaccagtcagtctagcccggcttgggctgtatcgccgagtgtggcgggggcgcgtcgtggtagagcccgaagcgattgatggcggcgatggcctcgtcgggcaacaggaactggagggggcgacgatcgcgcacgcgttcgcgcagatcggtcgaggagatgtcgagccagggcatctcggcgaagatcggatcgcgaaagccctcgagcacggtcgggctcgggtagccatagcgattgacgacgacgatgcgagagaggagcgggagctcgtcggctcgttcccaggtcctcatctggttcgcggcgtcggagccgacgatcaagaagagctcgtcgttcgggtgctgagcccgcagctcgcggagcgtgtcgaccgtgtaggagcgacccccacgacggatctcgaggtccgatgcctcgaatccgtcgatggtctcgatgaccgcgcgcaccaccgcgagccgcagcgcagggtcggtcacttcgcgagcggcctccttctgccagggcacgttggccaccacgaagagaacgcggtcgagggcggcagcgtactgcgcgttctgagcggcaacgaggtgtccgatgtggagagggtcgaaggtgcccccgaagaccccgatgcgcatcagtggttctgctcgaggagctcgatgacttcgccgaaagcctcgcgttctggctcgtggaccacccattcgtcgacgccgagcgtctcggagacggcctggatcttctcggcaacctcggccgcggtaccgatcaggaccgccggcatggcgagcgcgtcggcgacgtcgacgttgtaggcgcgactgaggtcgcgcacgacggatgcggcgtcgttgccgaggtgcacgaacgcggtgcgcagctggatgcgtggcgatcgatcagcgagggcggcagcctcacgcaccttggcgagcttgcggcgataggaggcggccgagagctgatcggcgaccgcgcgccgcgagtcgggtcgtgcgagcgatgggttgacgctgacgacgtcggcgtagcgtgccgccagtgtcagcacgcgcggccccccgccgccggcgaccagttcgaagcccgccgcccccatggggaggcggaatccgttgagctgataggcccgaccgtggaaagtgacctcgccgtgcgatcgcagccgatcgacgatcgcgagtgcctcggccagacggtcgacgcgagcggcggcgacgtcgaagcgcgcgccgaggtggtcgaagtcgctgcgctgccaaccagctccgagtccgagcgcgatgcgacccgggaacgccgaggcgatggtcgcgaactcggcggcgatgatcgcgggatggcgcaggtcgttattcatgacgagcgccgcaaccgtgaggcgtcgtgacgctgcggcggcgagcgccaccgaggcgatgggagcggtgcgctcctcgatgtggtcggggaacgacacgccgtcgtagccggcggcttcgatggatgcaaggagcgcggggagctcggcgagctgtgtgctcgcgccaagttggacgacgaagtgtgggcgcgtcacgagacgattccttcgcgagggctggagagcggggagtcctggggcatggtcgggtgagcacctagactaccgctaggaggcttcatgaacgcgcttgacgacgccggttggcagccgtgggactggcagcagcgtgtggccgcgcagcagcccgagtggcccgatcccgaggcgttggacgcggtcatcaaggagttggctcagcgcccagccctcgtggtcgccaaggacgtcgaccggctacgagccgcactggcgcgtgcggcccgtggacgtgccttcgtgctccaagccggtgactgcgcggagagcttccacgatcactccgcgagttcgctgcgcgccaagctgaagatcatcttgcagatggccgtggtcctgacctactcgtcgggcgtgtcggtggtcaagatcgggcgtatcgccggccagttcgccaagccgaggtcggcgcccgtcgaggtcgtcgacggggcgaccttgccgtcgtttcgcgggcacatcgtccatgatgacgccccgacactggacgcgcgtcgtcccaaccccgaacgcctactctgggcctacgatcagtcccgagcgacggtgagcgtgttgcgagccctcaccgaggggggcttcgcggatctctccggggcgcatcggtggaacctcgacttcgtcgcctcgtcgccggaagggcagcgctaccaggcgatcgccgatggggtcgatcgggcacttcgcttcatggcaggctgcgggatcgatctcgagcgcgaggccgttctgcaccaagtgaacgtgtggacctcgcacgaggcgctcttactgccctacgaggcggcgctcacccggcgcgatcctgcctcgcagcgctactacgacctctcggcccacatggtctgggtgggcgagcgcacgcgccagctcgacggcgcacacctgcgttttgcatcggggatcgccaatccggtcggactgaaggtcggccccacgatggagcccgacaccctcgtcgaggcctgccggatcctcgatcctgatcggacgccgggtcggctggtgctcatctcacgcatgggtcacgacgccgtgcgtgatcgcctcggaggtctcgtcgaggccgtacgtgaggcgggctatccggtggtgtggctgtgcgatccgatgcacggcaacaccttcgtctcccagtcaggctacaagacgcgccgcttcgaggacgtgatggacgagatcgccggtttcttcgaggtccatcgacggcttggtacccacgcaggtgggatccacctcgagctcaccggagaggacgtgacggagtgtcttggcggctcggaggcggtgctcgagtcggaactgtgtcgtgcctacgacaccatctgcgatcctcggttgaacgcgcgccaatcactcgacttggcgtttcgcgtcgctgaactcctgatccgctgagttctgctcagctcagatccccatccgttgtgcgaccacgccgcgccgggtggcgcggggcgccgctctcgagctacgcgttggcgaccagcgtggtgcggccccggcgtacgaacacgacgagcacgccaagcaaggcgacggtagggacgagcacgacgacctccatccctcggtaccctgcggcactcgcgatcgccccgagcgcggccggtgcgccgaccccgacgatgttggagaacccgatcagataggagttcgccttcggtagcgcaatgggttcgagggtgtcggcgagcatggagagcacgatcgggaagatcgccccgtgcgggatgccaaggaccgccatcgcgatcgcaaagacggcgaacgacggagcgacgaccgcgatcgcgagtccggccacggtgagcaatccggagacgacgagcatgcgctgcttgtgcgcgatcgggctgcgcgcggcgacgacgccgcgtgatgcgaacgacgtgacgaagaaggcggtgaaggcgtactgtgcttctgcggcgctgacgtgagggagcgagcgcgcaatggccgcgccaaaggcggtcaccgcggcaaagggcaaggcgtacatgagctgagcgatcagtgcctggcgggccgctcgatggcgaaacgggtgcacgtcggcgatggcggcgcgctcggaggcgtggtcgttggcggatggtcgggagaggtggatggtcgccatggcgccgaccacgaccagcgggaagacgccgaagacgaggaggggcgcacgaacgtcctggtgcgcgacgaccaggatgcctgactcgatgagcggggcgacggcgagcgaggccgagagtacgagcgtgaagatggcaagctgacgttctcggtcgggtgccccggccgagacgagttggctcagtccggtcaggctcggcatcccgagcccgcccgcgatgccgacgagggccgctccgaggctcgccacggcgaggttggggctgagcgcgaggaccacgagccccgcgagcaggatcagggctgccgcgagaaccgcgtcgcgcaggcgcgatgggtgcaggcgcgacgagaacccgaggttgacgacgacggtggctgctccggcgatggcaccgacgacgccgatcgccgtcgcgccggcgtggagctgatcgcggagcaagagcgcgatggtggtaagggccatgttctgcgtcccgcggaaggacgccgtggcgccgaggagagcgacgggacgacgagaggactgagccatgattctgatagtgtagcggtcattacggttgcatgcgcaacgactatcttgcggtgagtagttatctggcagtgtgcagttgccgaggttggatgcgtcgccacagcgcccaggcgagtcgcggaccgaccaggaagaggccgaggaacgagccggccacggcgacgaagagccacaccacgccttgatggctgagaagacgcaacaccataccgagcgttacggtgctggcccagacgacgatccctcctggccagacctggcctgtacgtcgacgtacgagcaggaatccgacgagcgtcccgacgaggaacggccaccacgtgcgccagacgccgatcagctgctcgctgtggccgtgcgcgtggcgtccgatcacgacgaagatcagtgtcgcgacgatgtcccacgcaatccagcttcgccagcgcatgtcgctccccttcgcgtcgggttctcagcgtcgatcgacctcgggcgatgcacgatgacgcgtcgatcgctctcgacgcagcgtaggcgacctcgatggcgaggctgtccgacaccgttgacggggctctgtgtgctcgggctcgtcggtcctccggtgcggttggcggactgccatgcggcgcgggcagggcctcgggggcctcacggtgtcggtcccccgtgcgcgtgtggtgggggctcacatccttggaggctcacgcgctggcgtgcgagcacccagcgggcggagcgatcgtaggaggtccgtggtggtgctggaggagcgtcacggcctcgatgctctggtgcacgagtgcgaaacccgagccccgccagcgaaggctcacgacgtagtaggcgacgtgttcggccgcgttggagggggccgggccatagctgcccatgaggcagagggtgagcctggagccgttgtgggcaatccaggcagcgctcacggggacgggtggcagcgcgagcggctggtcaggatgcggggcgagaagcgttggcgtcacgactgccgtgacgtggtgcggcaggagcgcagggtacgcggtgtagagagcctcgacgagcgatgcctggtggtcgcgcgtggctcgaaagagcagaatggaagcgggcgtgatgctcgcgaagttggtggcttcgtaggcgagcacggcgaccgtctggcccccctccacgagatacaccggtcgttgccgcgacaggcgctcgtcgacgtgcatgaacggagggttcgggaccgggagcggaaggttgagccgttgccagtcgaccgaggaaaacgcggccgggttcggttgttcgggggccgcgggcgacgtcgagccgcacgccccgagcgcggccccgacggccaacgcgccgaggatgccgaggatgctccgggcccggtgcgctcgaaccgatgcgaacctgatcacctcggtggcgcgagccgaggcgcgaggctcgcgctgcaggtgcgaccgtgtgagcctcgccacctggaggctccggcgaggacgactcgacgtcgtgatcgacatgacgagactctagctcggcagggggaacgcgtcacggagcgtggagcgtgctccacgctcggccactcgtcaggatcaggggcgcgatgtcctcggctctgtcgacgggcgcacccggcgctcgagtcgttccgtcggcgaactcatcgcgacggccggtgagcgaagccgacggcgcgaggccgcggacgcacgcctccgagggtcgctgtggtggcacgatggagctcgggtggggggtgtgtgtcgcagagcgacatgtggtcacaagggggcacgggtgcacgggacgcgttccgggcgcccccggcaggattcgaacctgcgaccgactgcttagaaggcagctgctctctccactgagctacgggggcggcactcagcatgctaccgatccgatgtggcgacgtggcgtccaggttgtagcatcgccagccagatcaggaggagtatgcatgcgctgcattccgggtgagctgacccttgccgagctgcggtcgttgtgggcgggggaaacctcgttcgaactcgacgcgagtgcctgggaggtgatcgatcgcgccgcgcgtaccgtggccgaactcgccgatcgtgacgacccggcctacggcatcaatacggggttcggtcgcttggcatcgacgaagatcccgcgcgaccaactcgagctcctccagcgcaatctcatcttgtcgcacgcggtgggcgtcggcgatccgctcgacccgccgaccgtgcgactcgtcctcgcgctgaaggtcgcaagcctcgcacgtggtgcttcgggggttcgccgcgagctcgtcgaggctctcctcgcgctcctcgagcacgacgtgttgccgatcatccctgagaagggatcggtcggggcctccggtgacctcgcgccactggcgcacgtcggcgcgctgctcatgggtgtcggtgatgcgctcgtcgcgggtgcgcgcgtcccagccatcgatgcgctcgccgaggcggggcttgctccgctgtcgttcgctcccaaggagggtctcgcgctcatcaacggcacccaagtctcgacggcgatcgcgctcgcgggactgttcgccctcgagcgtacgctcgccgctgccgtcgtggcgggtgcgctcgccgtcgatgcggccgctggctccatggtgccgttcgacgctcgcatccacgcgctccgtggccatccgacccaagcagacgtggccgccgcgctgacgacgctgctcgcggggtcaggcatcgtccagagtcatcaggactgtggcaaagtgcaggacccctactccctgcgttgtcagccccaggtcctcggcgcggtgctcgatctcgtgcggatgcaggccgccgtgctcgagcgagaggccaacggcgtcacggacaatccgttggtcttcgtcgagaccggagaggtgctctcgggcggcaacttccacgccgagccggtcgcctttgccgccgatgtgctcgcgatcggcgctgcggagatcggcggcctcgccgagcgtcagctcgcgctgctcatcgaccactcgctgtcgggcctacctccgtttctcgtgcgcgagggcggtgtgaactcgggcttcatgatcgcgcaggtgaccgccgcggcgctcgcgagcgagaacaagacgctcgcacacccggcgtcggtcgattccttgccgacgtcggctaaccaggaagaccacgtgtcgatggccaccttcgcggcgcgcaagctccacgaggtcgtcgccaacacgcagacggtggttgcgatcacgctgctcgctgcggtccaaggcgtcgagctccgtcgacccttgcgcagttcggatcggctcgaacaggtgatcgcgctcgtgcgcgagtacgtgccacactacgacctcgatcactacctcgccccggacatcgctcgagccacagagctcgtacgggcgggcgccatcgcggagcacgcaccgttgcgcattctcgagcagcgctaggcggtcgacgttcagggagagggctgctcgagccgctcgatcgccgtgaccgagctcgggccctcatcgtcaccgaccacgacggtgagcggatcggttccccacagcgagaccgtggccgccgagcctcctggcagtgagcgcgggaactcgatgcggacatgggtcggtcccgtgagcgccgccgagaggccggcgcgccacagtgcctcttcgacgagggcgagatgaatggcgttgttgacgtggtcgacgatgtcgagatcgctgcggcgtaggtcgagatgccaggtcgcctcgggctcggtgtctggtgtcgtgatgacgaggctcgggcggacgcgacgaccagcggcggcctcgccatagacctcgtcgaagccatcggggagtgacgcaggtgccccagtgtcggggcgggtgttcacccagacggcggcggcgctgacgaggagttcgccgcgaaccaacaggtcggtacgacgctctgcccacgcgcgcccggtcccggagaccgccgtggcgaggtcgacggcgtcgagatagcgaggccaggagaagatctcgatgtcgatcgagcggatgacccatagacccttgtccaccagcggggcatcggtgttgtcgagggtcgcgatgtcgtggaggaagcgggcgatcgcgtcgagccgaagacgtccgtccggcgtcgtgtcagacagcagcacgcggcggtggtcgtcgtagcgacgaccctggtctggcagaggggcgagcggcacgcgcccacgctagtcgggaggggctgacgcgggcaatgacgagctgggacgctcgtcggccagcgatgcgagttgcgcccggagcaccttcttgtcgaacttgccgacgctcgtgcgagggatctcgtcgacgacgacgaggtgatcgggcagctgccaacgcgggacgccatgggtctcgagccacgcccgtgcggcggcgagcgagagcgaggtgccgggtgcgagcacgaccgctgcggcgggcctctcgccccatcgcgcatcggcgatcgcgacgaccgcagcctcgacgacgtcgggatgtcccatcagggtcgactcgagcagcaccgagctgatccattcaccgcccgacttgatgagatccttggtccgatcgacgatgcggagccggccgccggggtcgatggtgccgacgtcgccggtgcggaaccaccctggccgtgccgtgaacgactctgggcccgccccgtggaggtagccatcgagcacccatggtccccgcacgtagatgtcgcccatgtgcgcgccgtcgtgcggaacctcgctgccggtctcgtcgacgacggcgagggtgatgccagcgacgggagcccctgcgctggcgatgtggtcgagctggtcggccaaggggagctcacccatggcgtgcgggagtcgcgaggtggtggcgatcggggaggtctcggtcatgccccaggcctggagcatgcggatcccgtaacgctcggcgaaggtcgtgatcaacgagggtggcggcgccgacccgccacagaggagttcgcgtagtgctccgaggtcgccgccgttcgcctcgagcgcctctgccaccgcaatccagacggtcgggacgccgcccgccttcgtgacgcgctcggcgcggatcagctcgatgaggaccgcggggttgagggtcggtggcgggaagacgagcttcgcgcctgccgccaccgcgccgaagggcagtccccaggcgtagacgtggaacatcggcacgaccggcatgacgcactcgctgcgcgagagggccggcccgttgccggcgttcaccgcgagcgcggtgtggagcacgagggaacgatgagtcgaggccacgcccttcggccgtccggtggtgccggaggtgtagcagatgccggcgcgctggcgctcgtcgagggtgcgcgtgccgggggcgggatcggcgctcgtgacgagcgcgtcgtagtcgagcacctcgccaagggcgttcgcggccccggggtcgacgggaccgatggcgatgatccgtgggatctgtcgaaggcgcggtgcgatgcgcgccacggtcgcaaccagatcgccgcttgcgatgatgacctcgtcgccggcgtcgtcgatgatccaggcgagatcgtcgtcgccaagacgcggattgagcgtgtggagcgtcctccccgagagcgtgatgccgaagtaggcctcgaggtgctcggcgctgttccacgcgagcgtccccacgatggcctccggcggagccaggtcgtcgaggacggtgatgaggcgccgggcgcggtcggcgaagtcgccgaagcgagagcggtgctgctcggtgggcgagcgctgggtgacgatctcggtgtcggcataggccccttcggcgtgctcgaacaggagccacgtcgtcaacgcaacgtccatcatcatggcgacaccccccttcgccacttcggatggtagcgaagggctccgcgccctgtcagctcagtcggcctctggttcgtcctgcatcacgcagaactgtacgccgtcggggtcggcgaggacgcaccaggcgcccccgtcgacaccctcgcgtcggtcggagcgctcctctgcgccaagggcgagggcccgctcgcggagcgtctcgcggctcgcgccgtagaggtcgaggtggacgcggttggcgcgagggtccgccgtctcgatgcgctggaggaacaccggcggcagggacccatcgggcgccacgaggtcgagataggtgccggtgctgtcgagatcgccgatgcgatagcccaggaggcgtgcccagaacgcggccgcgcgccccgggtcgggggtgtcgatgccgatctcgatgcggcgcagatccccgtggtctgcgatgggaggtggtggtgagaacggggggcgccatcgacaggtgtcgcagctcgatcgaacctggcgccaggcgtcctcgatgccgtaccagacggcgtcgaggacggcgggatcggggccgaagcgctctgcgacctggaggtcgagcccgagcgcgcttgcgcgctccgtcgcctcttgttcggcccgctcgaggaggacgccggcgaacagccaccacggcacgaggaggacgctccgggccccgaggcgccagaggcgttccacaccctcaccgacgctgggttgggccagcgagacgaaggcctcttcgacgaggtcgacgccgagacgttcgccgacgaggcgcgcgatcgcggcgagctcggcgttggcgctcgggtcggtcgatccccgtcccacgacgagaacggcctcgggcggcatcggcgagaccgcacgagctcggcgtacggcgagctcgaggagctcgttcgaggcaccgagctggggggcaaggcgcacgtcggcgtcgggggcgagtgctcggatgcgcgccgcgaccgatgccgcgtcgtccttcaagtgacccgcaccgacgagcaccacgggcgcgacggtgatgcgtcgcgcgccagaacgagcggcagcgtcggcagcgtcggcgagggttgggtcggcgaactcgatgaagcctgcctcgacgcgggtcgggaggcgccgagcggcaagctcgacgaaggcgcggaactcagcctgaccgtgctcgagacgcgtgccgtggccgacgaggacgacgagatcggttggggcgcgatgtgtcatgtctcctccgtagcgagttcggcgagcgcattgagtgccgcggcggcgacgggactgcctccgcgacggccacggagggtgaggcacgcgaggccgctcgcgaggaggcgttccttggcttccgccgcgcccacgtagccgacgcagaagccgaggacgacgccgacgttgacggggtgctcgaggagcgccgagagagcggtcggggcgttgccgatcgccaccacggccgggttcgcgagagcggagagcgacgcgcgcatcgctcgcgccgagcgggtctcgacggcgtcaccttgctcgaccgcatcgagcgtcacgatggtcgggagccgcggagcccctgcggcaaccatgcgcgcgtcgacgaggatcggcgcgccggtgcgaaggagacggaccgcctcggtgacgaccgcctcgtcgagtacgaggtcgtcaacgagcgaggggtcggccgtggcgtggacgatgcgcgcggcgacgcggcgcgcgccgggaccgaaacgcgcgagatcgacctcggcgcagatgcgctcgaagctctcgcgagtgatgcgtgctccggcgtcggtcgtcatcgtcgctcccagctccccacgatcgcgtcggtggggcagacttcgatgcaggcgccgcagtcgtcgcaacgtgaggcgacgagctccgggcgccccggagcaggtcgaagggcgtgggtgtggcaggtcgggatgcacacgccgcacccgacgcaggtacccagtgcgatcgccacgctcatcgcgcaggctggtagccacggggtgtcaccgcgagtcctccgaggactcgggtcgccgactggcccacgatgacgatgctcgtcatgtcgacggtcgtgacgtcgaggtcgtcgagcgtgccgagttcgaggtgttcgtcgacgcgttcgacgttgcggccgacgaggacgggcgtcgtcgggggtcgatgtgccgcgaggatcgcgagcgccttctcgagctgccacccgcgtcgtcccgaacgggggttgtagagcaccacggtgagatcggcgcgagcggccgcttcgagccgctgctggatggtctcccacggcgtgaggaggtcggagagcgagatgacggcgtgatcatgggcgaggatcgcgccggcgcgggccgcggtcgcgagggatgcggtgacaccgggcacgacggacaccggcacgcgaccatcggccacctcgtggacgagggtcgcgagcgcgtagataccagggtcgccggaggcgagcaccacgactcgggcgcccgcctcggcgcgggcgaccgcggccatggcgcgctcacgttcggctccgagggcaaagccctgctggagagcgtggcgaccaatgagaggttgggcctggtcgaggtagccgtggtaggcgatcacgacgtccgcgttggcgatggcgccccgtgcccgcggcgtgacgagatcgagcgagcccggtccgagcccgaccaccgttacctcaccgagtggcgcgtcacggaccgccacggcgacggtgacgggcccgtcgatccgcttgggcagcacgagcgttgcgtcgggtccggcgagccgaagggccgcggcctctgccacggatggcgtgtgcacggcgcgctccacgatcggcgatggcgtcggtaccgccacctcacggaggacggcggcctcgtagccgacgatcggaagtccgagcgcgccgagcgctggatgcaagcggcggcggtcgatggtggcgagcgctgccacggcggctggctcgaggtcggcctcctcgagcgccgcgtcgatggcagcgcgcaggtcatcggccgttgcccgctgttccagcccgaccccgaccacgaccgtgcgcgcgatgatgcggggtgcggcgagaccgcgagactcaccgacgttgacctcgaccgctggggctcggcccggtcgtgcacggcgagcgagccagtcggagatcgcaaggccaggccgcggtgcgaagctgagggcagcgccgtcattgaggcgttgctggagccgtgcagggagcggttctgggccgagagcaggcagctcgtcgagcgcgggtgcatcgatgagatcggcactcgtcgtcacgaccgcgaccgcgcccgtcgcacgggagacggcctcggcgaggtcgttcgcacctcgatgggcgcccgtcagcacgacgcagtagcgccgggcgctgtcgagggcgacgatcgcgggcgtgacgcgcttcggggcgaggccgacctcgacgatcgcgcgtacgaccaccgggatcggggcgacgacgacgagcgcgtcgtagctgacgagcgcctcacggagcatggccatcgacgcgtgggcgaccgacgcaaagccgagcgtcttggcgaggtcagcgagctcggctccgatggcgaccacggcgccgccggcggcgccggtgacgctacgcgaactggggcatgaggtggacggggtggtctcgatggcttggcagcctacccgcttggcgagggcaggacgagggagcgcctcctctgcgaccgagatcgccggacgcccgtggcgatggcgggcacacggagcacctcgttgctagagtcgcgctgtggcgccgctgacgagctggatcgacacggatctcgagcacggctacggcctcgaccacctgccgctgggggtggacgccgagggcgtggtggtgcgcatcggggatgtcgccctacggctcgcgccgctcgtcgacgacgggttgctgaggagcgtgtcgcacgggctcgttgctgcacggacgctcggtccgctctttgcggccggctcggccaccatggcgcgactgcgagacgagatcgtggtcctcgcgagcggacgcccggacgacgccgtcgcacgtcggttggtctcgatcgatgcgctcgagctctctgtgccgatacgaccacgcacctacgtcgacttctacgcgtccgaggcccacgccacgaacgccggcaggatcttccgtcccgacggggatccgctgccggctgcgtggcgtcggctcccgatcggctaccacggccgtgcgtccaccgtcgtcgtgtcaggcacccccatcgtgcgcccctggggtctgcgccgcgagggcgagggtgtcgtgctcgggccgagcgcgatgctcgatctcgaggccgaggtgggattcgtcgtcggacgcgcgagcgagcgtggtcggccagtgtcggccggcgcgttcgcggagatggtcggcggcgtcgtgctcgcgaacgactggagcgctcgcgacatccaggcgctcgagtcgttcccgctcggccccttcgccggcaagtcgttcgccaccagcattagcgcctgggtcaccccactctcggcactcgacgcagcgcgggtgacgccgccggtgcaagatccggcaccgagtgccaacctcgtcgatccggacccatggtgcctcgatcttcggctcgagcttcgcctcaatggaaccgtcctcacgcgtccgccggccgccacgacctactggaccccgggccagctccttgcacacctcaccgacaacggtgcacccgtcgagccggaggatctcttctgctctgggacggtgtcgggcgcggcgcccgacgaggtcggttcgctgctcgagctcacctggggtgggacgcggcccgtgcgcctcgatgacgggcacatgcgtacctggctcgtcgacggcgacgaggtcaccatcacggccacggcaccggccctcgacggcggcttcatccgactcggcgaggtgacgggccgggtggtctcggccatcgcgtcgccttggtgagtggctctcgggactcgctgctggcggcggagctcgcgcattaggctcgcccgcgtgcctgttccatcgcgcttgctggtcaacaccggagatggcaaggggaagtcgtctgccgcgttcggggtcatgggtcgtgcatgggcgcgcggctggacggtgctcgtcgtccagttcttgaagagcgggacctggaaggtcggcgagcgcaagctcgccgagcatctcggcatcgagttctacgcactcggggacggcttcacctgggagtcgacggacctcgagcgtactgcggaactggggcgcgaggcctgggcattcgcggccgagcgcctcgcgagtggtgcctacgacctcgtgatcctcgatgagctcacctatccggtgcgctacggctgggtgagcgaggatgcggtggtggaggcgttgcgctcgcgtccttcccgtaccaacgtgatcgtcaccgggcggggggcgcccgagggcgtggtcgagctcgccgacaccgtgaccgagatgcgcaaggtcaagcacgcctacgaccaggggattcgtgcgcgcaaggggatcgagtactgacccggggcctcatcgtcggcgccgcacgctcgggcgcgggcaagaccgcggtcacgctcgggctcgtcgcagcgctgcgcgcgcggggcctgcgcgtcggggtggccaaggcgggtcccgactacctcgacacacgcttgttaggtcgagccgctcgccgtccggcgttcaacctcgacgcgttcctgaccggtcgtgacgggccggcgcgttcgctcgcgttggcggcgcgaggtgccgatgtcgtgatcgccgagggtgcgatggggctgctcgacggcgcgccgaccgccagcacgccacccgtcgcctcgagcgcacacctcgcgcgcacgctgggactggggctcgtcttggtcctcgatgcgacctcaacggcgcagacggtgggggcggtcgcgctcggtctggcgacggcgtctggcgtcgcaccgctcggtgtcatcgcgaaccgggtgcgctcggcgcaccatggggacctcgtagctgaaggtcttgctcgtgtcggtatcgcgctcctcggtcacatcgccgagggagcgctcgacggtcttgcgcagcgacacctcggcctcgtcgacccgagtgagctcgacgggttcgatgcgtggctcgagcgtgctcggtacgtggtggaggagtcggtcgacctcgaagccctggtgcgtcgggcgcctgagctccgcctggtcgaccccgaactcggcgaggcgcggtcccgggtgccggtcgcactctccgtggggccgagcgcgcgctttcgctacgaggagaacctgctcaggctggaggcagcgggagctgagctgctcccgttcgatccgctcgaggaggtccccgacccacacgcacggctgctgtggcttcatggcggctatccagagcattaccaggcggcgctcgccgacaacgggccgctgtggccggcgctgcgtcgggcggcgaacgagatcacggtgatcgccgagtgcggtgggtatgcgctgctcgcacgctcgctcgagggttctcagatggcaggtgtcgtgcccgtcgccatgcggttgggctcgcgtccggtcctcggctatcggtcggctcgcctggttgacggtcctttcggggctcggtcgctgccggctcacgagttccactacctggtaccggaggacgacccaggtgagatcgacgtcgtggacgcccgaggcgagccgcgcccaggcggggtggtgagcccgaggctcctggcgagcttcctgcacttccacctcggtgtggacccggggcttgcgggcgatctgctgcgtcgtgccggcgggggtgggtcgtccgagacggcgtaggatgcgccccgtgagtgggctcatcagcttcgtgggtgcagggccgggcgcgtccgatctgttgacgcttcgtgcggttgagcgcttacgcgcagccgacatcgtcgtctgggcgtcgtcgctgatcccagacgacgtcctcggcttctgtgcccctggcgcacagatccacgattcggccctcatgaccttggaggacgtgctcggcgtctacgcggccaatcccgaggcggccatcgtccggctccactccggcgatccgtcgctctacggggcgatccaagagcagctcgactggtgcatcgccaatgatcgcgccgtcgagatcgtccctggcgttacgagcgttgcggcgtgcgccgccgtgctcggacgcgagctcaccgtgccccaggtcgcccagagcgtcgtaatcacgagggtggcggcccgtacgagcgcctcgatgcccgaacgcgagcgactgcgggcctacgcggcactcggtgggaccctggcgatcctgctctcgggtgcgcatcccgagcgtgtggtcgaggagctgctcgcggagggttcggccttcaccgcgtcgacgccagcggcggtcgtcgtgcgggcgagttggccggaggagcgcttcgagcgcaccaccatcgcaggcatcccggaggccgttcgccgtctcggggcatcgcgcagcgtgaccatcgtcgtcggggatgcgctcgtcgcgcccggagcccgatcgcacctctacgcaccttcgttctcgcatcgtttccgagcacgctcgacggcgggcacgacgcaggggcgcccgcgggcccgcctgcgtcgctccgttcggtgagggcgtcgtgccaggcctgcggaccgggttcacgaccggtacctgtgcggccgcggccgccaaggcagcggccatttggctcgtccatcgtgagcacgtctcgcgcgttgagatcgccctgccgacggggcggcgagtcgagcttccggtcgagtgggatgcgctcgggcgggcctacgtcgagaaggacgcaggtgacgaccctgactgcacccacggggctcatgtgacggtgtcgctgaccccgctcgccgaggcacagctgcgcttcgtggccggtgagggtgtcggcacggtcacgcgccccggtctcgggctcgaggttggtgagccggcgatcaacccggtgccgcgccgccagatcaccgacgccattcgcgaggtgactgacgagggcttcgcggtcgtcgtcagcgttccaggtggcgaggcgatggccgagcggacgacgaacgcccgcctcggcatcgtcggtggtatctcgatcctcggcacgacggggatcgtgcgcccgttctccacggcgtcgtatcgcgcaagcgtcgtgcagcagatcgacgtggcggccgccgccgggcttggcgagatggtgctcgcgaccggttctcgcacggaggcgagggccatggccgagcgttccgatctcgacccggtcggcatcgtcgaggtcggtgacttcaccggcgtggcggtccgacgggccgcccaccaccacatggacccgatcacgtggtatgccatggtgggcaaggtgacgaaggtggcccaaggtctcatcatgacgcacttccaccgcgccgacgtggacacgtcggtgctgcgggaggccgcgatcgcggcgggagctccggcggcggtggtcgaggctgcggatgcgaccaacacggctcgacacttctacgaggtctgtcgtgaactcggcgtggttgcgccgctcgagctgcttgccgaacgcgcggcggtcacgttgtccgaggcgatcgggggccgggccacggtcgaggtcgtgctgtgcgacgtggacgatgccgccgtcgtcgtgcggcgttcggtgcctggcgagcgatgagcgtcgtggtcggctgggtcggtgacgacccctcgaacttgacgggtcgccagctgggcgccctcgagcgcgctcgtctcgtcgtggcgcctcgacggttgcacgaggtgctcggctcactcgcgccgcaggcgacggtcatcgcttatccgacaccgatcaccgagctcgtcgatctcgtccacgagaacccggacgtggtcgtggtcgcgagtggggacccgggattcttcggcatctcgcgcgtgctcgccgatgcgggcctcgacctcgagatcctgcccggaccgacgaccgcagccgtcgcggcggcgcggctcgggcgctcctgggagggcgcgagcgtggtgtcgttcgtcggtcgtgaccatgacgtggccctccaggtcctcgacgaggtgctcgctggtgacggtccggtgatcgcgctcttgtgtcccggccaggcactcgtcgacctcgcgaatgctgtggcggcttcgggtcgacggtcctggctcgccgttgccctcgggacggcagaggaggtcctcgacgaggcgtggcaggcccgctccgaggcgccgcgtgtgccgagtctgctgtggatcgatggagctctctcgcgccgtgaggtggtccatcggatgcgcggtctcgacgtcttcgccgatcgacctcgagactcggacggcgtcttcacgagtctcgaggtacgcctcgtcgcggtcgcacgactcgctccggatcgactcccaccgggcgcgcgggtgctcgaggtcggcgcgggcacgggatacgtgggtctcaccctgtggcgcctacgtcccgacatcaccatcgtgcagctcgagccccgcgcggagcgtgcggctcgagcacgcgagcatgcgcgagcgttgggtgcgcgtgtcgaggttctcgaggcacgcgtcgaagagcatgctcccgagggcgactacgacgccgccttcgtcggcggtggcgggccgcgtgcgctgcgagcgacgctcgatcgcgtccgaggtgggggtcgcgtcgtcgccacgttcgtcgatcccggacgagccgcggtcgcccgagagctgctcggcaacctcgaactcatcgaggtcgcggacgcgtctcctgtcgcgccggaaggggtccgcttcgttccccgtagtccgatcttcctcgcgtggaggtaggagtcgggggagctggctcgagggccgaccgtgcgagctcgtacagtgatggatcgttgcccgcgctcgatggatcgtggctctcgcggttcgacgacgagccggcgcgcggaggcccgtgccgggctgagggagcggtcctcgctcaggtagccgttgtgggtgctgccacggtcgggcgtggccggtgacccctccagcgaatgttgacgggggtcagagggagctgggcacgcgcgtccgctccggcacggtgtcgacaggcacggccgaacggtggtggggctggaagcgagtctcgtcgctcctctctcgcgcggcaacgatgccaacggatcgatcgggtccgagacctctggcgaggcttcgtaccggcgcgacaaccgtgccgctacgcggctcgctgggggggaccggggaggtagcgatgcgtcacagtggctcgagcacgacgcctgcgtaaggtggggcttgccgaatgccgatagacagtgggtcctcggcggactcgcggatcaggggtgcgggtgcggttgcgaggtgccggaggaggtgcgcacatgacgtcgtggtacgggcggagtcggttgcacgctgggatattggtcgcggtcgcggggatcgggctcgccgcttgcggacaggcgacctcgtcgacgcattccacgagctcgtctcgctcgtcgtcgactccgaagcgttcctcctcgcagacttcgtccactcgctcatcgtccgggtcgtcatcgacccccgcagcggtcgccccatgcgatacggcggcgttgtccgcgtcactcggccaaccaagtggggcggcgggaacgacctactatccgctcctcctgacgaacgtgtcgtcgcggtcgtgcacgctctacggctacccgggggtgtcgctcgtcgtgtcggcgagtggttcgcaggtgggccgatcagccagccgcgtcgcggggagcgagcagacggcgacgctcgagccaggacagtccgcgcaggccatcctcggcatcgaagtcgcgcagaactacccgacctcgacgtgccagccaaccaaggtcggaggcgttcgcgtctaccccccggatcagacgactgcactgtacgtatcggcgcctgagctctatggatgcgccaaccgctcagtcgacctgctgaccatcgaaccgctgacacgggcccaatccggtaccggcagtggttcggggggtgcgacgtcctgaagcgtcgggatggggcaacagacgtggtggagaggggtcgcgaactgctccaacagaagtccgtgcaacccatgcgtacgcagagtcgagtgcgagcgtggccctgtgaacctgaccgagtgggcacgtcgccaggggatccacccgcagaccgcctccactggatccatgctggtggctagctccctgcaacgagaccccccgctctgtgaggagcccgaccagcatggacaggcggagggagcgcacatgaagggcacgaacgccacacctcggagcagatcctccggaggctggccgaagggggacgagagccaacgaggggccacggtcgccgaggtcgctcgcgccctcgcacatcaccgagacgacctggcagcggctggaagcagaccgacggccccatgaaggggcccgacgtgaagagggtgaaggagctctcggccgagaaccggcgcccgaagaagctggtggctgatctcgccctcgacaacgacagctctgaggagctggccgagggaaacgtctgaccccggaccgccagcggggagccgtgcacctactccgccagcggttcgcaggtcacctgagcgacagcgtgcgaggcgcaggtcgggcgggccacctgactgcaccttctcacagcctcggccaagcgttggaaggctgctacggtcgagagcatcggcgcccaacgggaccagcgagcggacgtgcgcgaacgtggtctcgcggggaaggcggacgtggttctggagccggccagcgacaccacggtctcgggcgtgacccaggtcggcagctgcctccggcgttcgactcgactgcctggttagagtgcttcctatggttgcacccggcatcgatctcgacgacctcgaccccaccgttcgccctcaggatgatctgttcggtcacgtcaacaaccgctggtttcaacggacggccatccccgacgatcgagcacgctacggcgcgttcagcgagctcgccgacgctgcagagatcgcggtgcgcgaactgtgcgagcaggcccgtgaggctccggccgggtctgaggagcgcaagctcggcgacctctacgcgagtttcatggatgccgaacgcatcgaagagcaaggcgccgcacccatcgctccgctccttgcggcgatcgacgacgtcgccgattacggatcgttctggcacctgctcggcagtctcgagcgcgatggtgtgcgcggcctcgtcgacctcttcgtcgacacggatcctggtgacccttctcgctatctcgtcttcgtctcgcaaggtgggatctcgctgccggacgagcgctacttccgtgaggaacgcttcgcatcggttcgtgccctgcatcgacagcacgtggcgacgatgttcgagcttgctggcctgacgaacgcggccgcgagggccgcagcggtcgtcgagctcgaggcggcgatcgctgctcgccatctcgacaacgtcgcgagtcgcgacgcgctcgccacctacaacctcatgacgtacgaggacctcgtcgggttggtcgcgcagggccaccgcgaggccgaggcgttcctcgaggcctggatcgacggtatgggcgtcgatcgtgcggtggtccgtgaggtcgtggtgcgccagcccgccttcctcggctcggtcggtgagctgttcgaggatggtcgaatcgatgtctggcgcgactggctggcctggcacgtcattgcccacagtgctccgctgctctcgacacgcttcgtcgaggagagctttgccttctacggcactgcactcaccggtgctccgacgttgcgggcgcgctggaagcgtgcggtgtcattcgtcgagggggcgatgggggaggcggtcgggcgcctctacgtcgcgcgccacttctccgagcctgcaaggcatgcggtgcgcgagctcgtcgaccacctgctcgatgcgtaccgtgagagcatcgcctccttggagtggatgcgcgaggagacgcgggccgaagcgctcgccaagctcgaggcgatcgtggtcaaggtcggctatcccgacgcctggcgtgactacggcgcgctcgtcgtcgacccggaggatctcatcggcaacgctcggcgcgcggcgtcgttcgccatggacttcgaactcgccaagatcggtcggccggtcgatcggtcggagtggttcatgacccctcagacggtgaacgcgtactacaacccaggcttcaacgagatcgtcttcccggcagccatcttgcagccgccgttcttcgatgccgaacgggacgccgcggcgaactacggggcgatcggcgcggtcattggtcacgagatcgggcacgcattcgacgatcagggctctcgttacgacggtgagggccgtctgcgcaactggtggaccgacgacgatcgggcgaacttcgagcatcggacgaaggcgctgatcgaacagtacagcgcgctcacacctcgacagatccccgagcaccacgtggacggggcactcaccgtgggcgagaacatcggcgacatcggtgggctcgcgatcgcgtggcgtgcctacgagctcgccctcgacggcgcggagccccctgtactcgaggggacgtcaggtggagagcgcttcttcttctcatgggccatctgttggcgagagcaacgccgtgacgaagaggcgctgcgattgctcgcgatcgacccacactcgccgccagagtttcgctgcaatcaggctgcgcgcaacgtcgacgccttccaccagacgtttcacaccgatccgtcgtcggggctctggcttgaccccgaggagcgcgtgcggatctggcgtgcctagctgaccgcgagaaccgagactgcatgcccgagtgacgtctcgcgggctgtcggccccggtgctaccatcggctcgagcacaggggggaccatgccgtactaccgtcgcgtgggtgaggtgccgcgcaagcgccaccagtacgtacgtgcgcacacaggcgcgcgtatcgccgaggagctgatgggcaaggagggcttcgcggcggagtcgtcgctgctctaccacctggggcggccgacggccatcgtggatgcagcacccgtcgcgattgcgggcaccaccctcgtcgcgaatcgtccactgctccctcgacaccttcgcacgcccaagctcgccggcctcggtggcgacgctgccacggaccggcacctcttgctcggcaacgacgacgtgtggatctcgtgggtggtggcggatcgtccgagctcgctgcagcgacacgccgtcggggacgagtgctactacgtccatcgtggtacgggcgcgtgcgagtcggtcttcggcaccatccgagtaggtcccggcgactatctcgtgttgcctgcgtcgacgacctatcggctcgtcccggacgaaggttcggtcctcgagtgtctggtgctcgaggcccggggtcatatcgagatcccggaccgctacctctcccagcggggtcagctgctcgaggcggcacccctgtgcgagcgagacctgcggggccccgagggcccgctcgtcgtcgagggcgaggacgtggacgtgatcgtgcgtacccgtctggacgccacgcgttacacctacgcgacacaccccttcgacgtcgtgggttgggacgggtgctgctatccgttcgcgttccagatccgcgacttcgagccgatcgtgaagcgattccacgcgccaccgcccgtgcatcagacgttcgccggaccgaacttcgtcgtgtgctcgttcgtcccgaggccgttcgacttcgatccggaggcggtcgcggtgccctaccaccatgcgaacgtcgactccgatgaggtcctcttctacgccgacgggaacttcatgtcgcgggcgggctccgggatcgaggcgggttcgatctcgctgcatccgtcgggcttcgtccacgggccccaaccgggttcggtggacgcagcacggggtcagccaggcaccgaggaggtggccgtgatggtcgataccttccggccgctcatgctgtcggagacggcactcgcgatcgacgacgacgcctacccgtggacctggtcgaggcgcggtcctggagcgcagtcgtgagcaccaagccgttcgcctcctcggcagacctcgcgcccaagcacgaggtcctcgagcatctcgccgatggtgtcgtcgccttgaccgccgaaggtgaccccaacgtcggtgcgatcgcgacgagcgaggggctggtctgcgtggaggcgcgtgcgacgccagtggcggctcggcgctggctcgagcgactgcacggcgtgctggatgggccggtgagctacctggtgctctcgcactaccacgctgtgcgggtgctcggggcgagcgccttcgacgcgggtgcgatcgtggcacacaccgccaccgccgaactgatcgaggagcgaggtgccgaggactgggccagtgagcaggctcgcatgcctcgactgttcgaagagccggcgtcgatcccgggcttgacgcggccgacgctcaccttcgccgacgagctgcgtcttggccgtgggggtggacgaggcgacatctggctgtggtggcttggtcggggccatacccgtggagacatcgtcgtgtggttgccgcgcgagcgggtgctcttcgccggcgatctcgtcgaggcccgggccgcgctctacacgggcgatgcctaccaccgcgagtggtcgggcccgacgctcgatgcgatcgccgacctcggtgccgaggtgctcgtcgggggtcgaggggccgtcgttcggggcagggaggccgtggcggcggcgatcgcgcagtcgcggcgcttcctccaggtcctcatcgacgagtcctcgcgcgcgctggacgccggtggcggcctccgcgaggccttcggcgcctgctacgaggctctcgcgccgacctatggctcctggccgatcttcgagcacaccatcccgttcgacgtcgcccgtgtcgtcgaggaactccaaggggtcgagcaccccacgatctggacgacggagcgcgatcgggccgtctgggacgagctgcaggggtcacggtgacgagggcctggccggtcgcgatcgtcggtggcggtccggtcgggctcaccctcgcactgtgcctcgcgcgccagggcgtgtcctcggtgatcctcgagcgcaacgacggcgcgacgggcgagggctcgcgcgcgatctgtcagcagcgcgacgtgctcgatacctgggacgcggtcggtgcgtcggcgatctggcgagagggcctgacgtggtcgagggggcgtacgtacgtgcgcgatcgggaggtgcgcacggtcgagctcgccgatgtgggtcgcagcgagctaccggcgttcgtcaacatctcacagctgcgcgtcgagtcgatcctgcgcgcgctcgtcgctgagcgtccgatgatcaccctccggactgggttctgtgccacgagcatcgtcgacgacgacgcgggtgtgcgcgtcgtcgggtctcgcggtgaggtcgtcgaggcagcgtgggtcgctgtgtgcgctggcgcgcacgccgatggcctgcgacgtgcactcggcgtcgagctcgctggcgagacccaccccgatcgcttcttgatctgcgatgtgaaggtggatctcgacaccgagagccctgagcgtcgcttctggttcgatcccgagtggaaccccggccgacaggtgctcctccacgcccagccggacggcctcgtacggatcgactggcaggtacccgaggcgttcgatctcgaggccgaggcgcacaccggccgactcgacgagcggatccgagccgtcgttggcgaacgcccctacgacctcgtgtgggcgagcgtctatcgcttccatagtcggctcgccaccggtttcgtcgtgggacggagcgcgctcgtgggcgatgcggcgcacctcatggcacccttcggcgctcgcggtctcaacagcggggtgcacgacgcggagaatctcgcgtggaaactcgccgcggtcctgcggtcgacagctcccgcgtcgctcgttcgcacctacgacgaggagcggcgccaggccgctcggcgcaacctcgaggtgaccgctgcgaccatgcgctttctggcaccgagggacccccacgaccgccagcgacgcgaggcgatcctcgccggcgccttcgctggcgacgccgaggcgatggccgcggtcgactccggtcggctctacgagccggcgtgctacgacggatcgtcgctcaccaccgacgatccccggcgcgcatggttgggctatgacgacgccggtcgacccatcggtccggcggcgggcatgctgctccccgacgtaccgacggccgacggtacccgggtgcgcgcgcagctgcgcttcaccggcgggatcatcggaccgggctgggttcgcgaggcaaccgagcgagtgcacgcagacctcggcctcgcgatggtcggcctcgagcgggctcacgccgaccccgacggcgtcctcgcagacgcgctcggactcgaccccgacgaaggggtcgtcgtgcgtcccgactgccacgtcgcgggctttgcgaccagcccgtcgtcggcggtcgcggtcgccgcacgcgcttggggctggggaggaggtgtcggcgggtcgtaggctgggccgacgtgactggcgcgctgctcgtggtcgggaccggctcgaacgtcggcaagtcgaccatcgtcaccggcctcgtgcggatcctcgcgcgccgtggggtcgcggtcgctccgttcaagggtcagaacatggccctcaacgccgccgtcaccgtcgagggaggcgagatcggcagagcacaggcggtccaggcgcgtgcggcgtggcgcgacccgagcgtcctcatgaacccgatcctcgtcaagcccaccggtccaggccgcagccagctcgtcgtgctcggcaagccggccggcgagctccgtgctgcggcgtggctcgagggacgtcgggggctgtggccgatcgtgctcgacgccttcgacgagctgcgcagcagcgtcgacgtggtgatcgccgagggtgcggggtccgcagccgagatcaacctgctcagtggcgacctcacgaacctcgccctcgccgaggctcgtggcgtgccggcggtactggtgggtgacgtcgaccgtggtggcgtcttcgcgtcgatctacgggcactacaccgtgctgccgccctcgctggctcgccacctgcacggcttcgtgatcaccaagctccgtggtgaccccggcctcctcggcccgggcgttcgcgagctcgaggatcgcctcgcgacccgttgctacggggtcgtgccctggcacgagatcgccctgccagcggaggactcgctcgtgcgccaccgcgccacggcgccgcgggcaccagggcagctccgtgtcggggtggtggcgctcccgcacctcgccaacgagaccgatctcgatccgctcgttgccgagggggtcgcgctgtcgtggatcgacgacccgagtcgtctctcgggtgtcgacctcgtcatcgtgccgggatcgaaggcgaccgtggccgatctcggctggctccgagcctcaggcattgcggccgccctcgaggaccaccttcgtgagggcggatggctcttggggatctgcgctggctaccagatgctggtcgacgtcatcgacgatccggtcgaatcgggggaggggaccgtggcaggactcggcctcgtgcgagggagggtgcgttttgggcccgagaaggtcctcgcgctcgtcgaagggtccctgcggtggccagaggctgcctcggttcgtggctacctgatgcaccatgggcgcgtggtgagcgaggaagagccgttcgtcgcgctcggcgacggtcagctcgagggtgcccgacgcggtcggatcctcgccaccgccgtccacgggatcctcgacgacgaccgggcgcgccgggcgctcctcgaggccgtcgccgaggatcgaggtcgcacgctgccccctccggtggccttcgccgcctaccaggaggcgcgcatcgacgaggtggccgatctgctcgaggaacacctcgcgctcgacgcactctgggggctcctcgggtcctaggctcgctgggccgtagggtggccacgagggggccacgaggggagggacgcatgcgcatcacggtcgcgacgaacgccgacaccgaggtgcttgcgctgcgcatggcctgggaggatctcccctcgaccatcgagctccacgtcgccgcgctcggcgagctgctcgagacctggcatcccatcgagggcgacgtgctcgtcgtgcgcgcgctcggcgggatcgcggcggtgcccgacccggcacagctcgcgaccagggcacgcgctggaggagctcacctcgtcgtccttccgggcgaggcgaccttcgacgtaccgacggcacaggcttccacggtgccgatggccgtcgtggagcgcgccttcgcctacgcccgtgaggggggtgctgccaacctcgcgtcgctctgtcgctacctcgccgtccggctcggcggtgtcgaactcgacgtcgcagagccggtgagtatcccgttcgtcgggagcatgggccacacgtcctggtgcgagcgtcatagcgggccgcgcatcgcggtcgtggtctatcgcgcccatctcatcgccggcaacacgcagttcgtcaccgatctcctcgacctcgccgagcagacgggcgtcgcgctcgaggcctggtgggcctactccgcacgcggagaggcgggtcaggtcctcgcggccgagctcgaggcgtccggtgtcgacgtcgtcatcaccacggtgctcgcgggcggcgagaccgaggggctcggttgggatgcgggtccgctcggcgggctcgacgtgccggtcgtccaggcgccgatctcgaccgtgtcgcggcaggagtgggcggcctctgctatgggtctcgtcccgttggacgtcgccatgtcggttgcgattcccgagtacgacggtcggatcatcgcggtgccgatcgcctacaaggagctgatcgatgccgacgaggtcttcggggcgccggtgcacgcctatcgcctcgatcgcgagcgagcgcatcgtgtcctcgaacttgctcgccgcctcggtgcgctgcgccgtcgcgccaacgacgccaagcgcgtggccatcgtgctgtcggcgtacccgaccaagcgctcccgcatcggtaacgccgtgggtctcgacacgccccagagtctcgtgcgcctgctgtcgatgctcgcggagcggggttggcggctcgagacccccgacgatcccgacgcactcatggcgcgccttggtgcgttgctcgatcccgaggccccgagcgagcgtgctcgcggaggcgcgaccctctcgatcgatgcctacctggcgtggtacgcgacgctccccggtgagctccgcgacgaggtcgaggcggcctgggggccgccgccgggctcgcgctacatcgcggagggatcgttgtggttccccgcgatctggatgggcgatgcgctcgttgcgatccagcctcctcgcggctacggcgagcacgagatcgcgatctaccattcgcccgagctcccgccgtcgcatcactacctggccttctaccactacctcacggcggttgctggcgtcgacgccgtcgtgcacctcggcaagcacggcacgctggagtggttgccgggcaagagcgtcgggttgtcgtcgtcgtgctggccggacgtcgcgctcggctcggtgcccctcgtctacccgttcgtggtcaacgacccaggtgagggcgtgcaggcgaagcgtcggagccacgcggtgatcgtggaccacctcgtaccgccgctcacccgagccgacagctacggagccatcgccgatctcgagtcgctgctcgacgagcaccagcgggtcgcggccctggacccatcgaagctccccgagctgcgagcggcgatctggtcgctgctcaccgagtcgcgcatccacgaggacctcggtatcgacgaggccccgagcgtgcgcgacgacgccttcgacgacctgctgctcgacgtcgacggctacctgtgcgagctcaaggacgccacgatccgtggtggcctccacatcctgggcgcgccaccggtcggcgaggcactcgtcgatctcgtggcccagatcgttcgggtgccgcagttggacgtgccgagccttgccgaggagctcgatcgcctcgaaggccgtctcggcgacgggagccgtgcggcgcgcgacgcctctgacgggcgcctccacgagatcctgtgggccctcgccgagcgcgattgggatccggaggtgctcgatgacgccgagtggtgtgcgagcgtcggtcttgaggccgccccggacgacctgcgtacggcgctcgcctgggtcgccggatcgctggtgccgaggatccgcggggcgagccgagagctcgcggccgttgcggacgcactcgaggggcggccgatcgcacccggtccggctggtgcgccgtctcgagggatggcgcacgtcttgccgactggtcggaacttctacgggctcgatccacgagcggtgccgagtcggctcgcctggcgtaccggccagcgtgcggcagccgcactgtgcgagcgctttcgacgcgacagcggcggcgagctccgtcacgcgagcatcgtgctctggggtaccgcggcgattcggaccggtggtgacgacgtcgcgctcgccctcgcgctgctcggggtggagccacgatgggacgcgatctcgggccgtgtggtcggcctcgagctcgtgccgctcgaacggctcggccgagcgcgtgtggatgtgaccgtgcggatctctgggctgttccgcgatgccttcgcccacgccattgcgctcatcgacgaggccgtcgagttggtcgccaaggcagccgacgagggcgatgcgaacccggtggctcagagcggggcgggccctcgcatcttcggcccaccgccgcgtgcctatggttcgggggtgctcgagctgatcgagcacggggcatgggagagttcggcagatctcgggcgcacatgggtgcgctggtcgcagcatgcctacgggcgcgggcgcagcggcgaggaggcgactggggcgctctgggatcgacttcgtagcgtcgaggcgatcgtgaaggcgcaggacaaccgggagcacgacatcttcgactccgacgactacctccaagagcacggcgggatgatcgccgcggcgcgcgcagccggcaacgtctcggttcggggctacttcggtgacacctcgcgaccggatgcacccacggtcaggagcatcgaggaggaggctgcgcgggtcgtccgtcagcgggtcgtgaacccgaagtggctcgaggggatgcgccgtcacggctacaagggcgcgttcgagatggcggcgacggtcgattatctcttcggctacgacgcgaccgccggggtcgcgcgcgactggatgtacgacgcggtgacggatgcgttcgttcgcgatcgcgagaaccgatcgttcctgctgcgcgtgaacccctcggcgctcggggcgatctgtgcgcgcttgctcgaggccgctcggcgcggcctgtggcacgccgacgacgaacgcctggctgcgctcgcggagggcagcctcgaggcagagggggccgaggagtgatccgcatcgacagcgtcgagggcaacgacgaggccaagctcgccatcgcactgctcgcggtcgatccgaccattggcggcgtcttgttcgtcggacctcctggcgtggcgaagtcgacgctcgcgcgttcgctcgccgaccttggcgaggacgcccccttcgtcgaggtgccgctcggtgcgaccgaggacagggtcaagggttcgatcgacgtcacgagtgcgctgcgcgacggcgacgtggtgctgcgccgaggtcttctcggcgctgccgacggtggcgtgctctatctcgacgaggtgaacctccagcccgatcacatcgtggatctgctgctcgatgcggcggcgaccggcgtcaatcgcgtcgagcgagacgggctgtcggccacggagccggcacgtttcgccctggtcgccaccatgaaccccgaggagggggccttgcgtccccagctacgcgatcgcttcgccatgctggtcgaggtcgggccgccccccacgcgagaggcgcgcctgcgggcgcttcggcgagcactgcgcggcgagaacccgagtgtcgacgccgaccgcagcaccgtcgtcgccgcacgagaacgtctctcgcaggtcgacatcggcgacgccatcgaggcagcggtcgacgccgcgatcgctgccgacgtagcctccttgcgtgcggacgtcgcgatggtgcgagcagcacgtgcgcacgctgcgctctcggggaagacggccgctggagccgacgacgtgagggcggtcgcgcccctgatcgtacgcgggcgaacagggagcgcaccacgcgtctcgtcggcgacgggagcctcccgcgctccgtccacgacgccacctccgccagcggtgcgttcgcccggggatgctcgcggtgagctcggcggtggggcagcggatcgcggcggctcggcgagctcggtgacgtcgtcctcggcgcgtcgaggtcccgatgaccgcgagggggtctcgtccgagggggtctcgtccgagggggtcgcgtcgacgagtgcgggtggcgaagccggcgacgctgccggcaccgataccgatggcgaggctgtagctggggagcgatgggcggcgggccagcgccacccgctggtcgggggagcgctctcgcgtgtgcgcgctcactcgggggcgttggggcgcgaggcccacgaactcggtgcctccaacgacgccggtgccatttcggtggcgcggagcgtgctcgcgcgactcgagcgtcaagggggaggcccgctgggtccggaggacctgcgccgaaccgagcgagcacgccgcgaggcgcgctgtgtcgtgctcctcgtcgacgcctcgggctcacaggctgccgaggtcgcgttggagatcgcttcgcaggttgccgaggaactgctcctgcatgcctaccaggcgagggcacacgtcgcggcggtggccttcggcggcgacggtgccaccgtcgtgctgcggcccacgcggtcgatcgaggtcgcccgggcgcgactcggtgcgatcgagcgccgcggtgcgacgccgctcgccgctggtttcgacgtcacggccgagctcgtggtgcagctgcgccatcgaggcatggagccgctcgtggtcgtggtgaccgatgggcgtccgacggtcggtgggcgcgggctcgggccgatcgaagcggccctcagcgctgctcgcgagctgggtcgcctcggtgtcgacggagtgatggtggaggtgggtcgcgcgtcgcgtgatggcctcgaactcgccgcgcgactcgcggccgaggccggtctcggtcacgtcgtcgctgctgatgcgtgagccagggcgtcggcgagcacggtgtcgagcatggctggcgtgaggcgtcgaggcgcggtgttctgcggactcgggtggtagctcgcgaggacgaggcggccacgtccgagttcgatgcgttctccatgtcggaaccggccgagcggctcgccgagcgctgcggccagagccgaccatgcgatcgcaccgagcgcgaccgcgcttcgccacggcacgagctcgagctcgcggacgaggtagggtctgcaggcggcgagctcgccagcacgaggccggttgtcggggggtgcgcagcgagcggcggcgctcagccagacgtcggtgaggacaaggccgtcgtcgcgactggtcgaggtcggctgattcgcaaggccgagtcgccacagcgctgcggtcaagaaggcggccgacgggtcgccggtgaacatgcggccgtgcgcgttcgcccctcggcgcgacggcgcgaggccgacgacgaggatgcgagcagccggatcgccgaagcctggcaccgggagggcgacccagtcggattggctggtggttcgccgccactcgacgagacgatcgcatcgacagcacgtgaggatgtcctgagcgagctgctcgagtgccgtggccatgtgcggagcctatccgtcgcggccggaatggcgacggccgcgcgagtgttacagacaataggcacaccgttgaggtacgaaaggagacgctatgcacgtccttggactcactgtgctggtagcacttggtatttggatcatcgtcgcgcttggagcacggtggtacaggtctgccgttgaggcccggtcgctggttgcgctggtgctcggcgtcgtcgtcgcctggctcgccaacatcgatctgtggcgcttgtggtcgctgcccgacctccgctacggctgggtgggcgtgacgctcaccggcctcgcactcggcgggctcgccctcctgtgggatggcgtgatcggactcgtgagcggcctgtaccgcaaggtcgaggacgaggccgagaccttggagcgacgtgatctgaagcgcgtcgcctgagccgaagctccacttcagcgggcgtcgtcggacgacgagcgtccagatgccagtcccgaggcggcaggcgtgtgcctgccgcctcgctcgcgtcgagcgcccgatcgcctcgcggggttcgtgcgctcggcggtgatggcagcgacgaggcgctcgagtagctccttgaggccgacgggttcgtcggcccggccgcactggtgttcgtggacctcggcgagctcctcgaagctcgcaagatcgccgtagcgtccctctcgctggcggagccacgaggcgatggggcagcgctcgtcacgctggtgcgcaaggggccgaccggcgcgtgctgcgacgaggctcgccagcaggggcaggtcgtcgagggggaagggcgcgatggaggcgaggagcgcccgtgcaccggagcggagcctggtcgggaccgtcggttgtggacgaccgagtccgtagccttggacgaagcgtcccccaatcgctcgccacatggcgaggtcctcggtggtctcgatcccttcgccgacgacctcgaccccggcgtagctcccgagcgcgagtgcagagagcgagcttgcgaacgaccgtgggtccgtcgcgagggaggccaccagcgagcggtcgaccttgagctggtcgatggggaggctgtggacgtaggccatcgacgcccagcctcggccgaagtcgtcgatcgcgatgcgagccccgagggcccggatcgcctcaagccgactcaccgcgctcgcgagatcgtcaccgagcgagtgggcctcggtgatctcgaggacgaggcgctcggtcgatgcggtgcggatgacgcgcgcgacgtcggccgcgaaggtgggcgtgaggaggtgacgcgccgcgatgttgacggccacggcgggcagtgaggggcgctcggcgaggagcgtgcaggcgtgctcgagcgcgtccaggtcgaggcgtcgggccaggtatgcatcgcgctcgaccacgtccatgaacgcatccgcggggacgacctctgccccgtcgtaccaacgcgcgaggagctcgacgccggcgagacggcccgcgacgaggtcgacctggggctgataccagaagcggacctggtcggtgccgatcgccgaggcgagcttcgtgcgcagacggtggcgacgatcggcaagccttgccatctcgtcttcgaagatgcgtgtgcgacctccaccctggctcttggcgtggtacatggcctcgtcggcgtgcgcgagcagcgtctccacgtcgacgccgacaggaccccagagcgcccaaccgaggctcgcgctgagcggtccgccgggggtgggcacggcggccgcggcgtgcaccgcctgcgacagggtcccgagatccatgctgtcgaggcgcgcgaggagtccgaactcgtcgccgccgaggcgcgccacgtagagctcaggagggagtgcggcgagcgacgcgccgacctcggcaaggatgcggtcgccctcggagtgtcggtagacgtcgttccattccttgaacccgtcgaggtcgaggatgccgagtgcgaggccgacaccgtcctcttcgacgcgacggcagcgtgcctcggcttcttcgaggaacgcccgtcggttcggcaggccggtcagcgcgtcgcgcagcgcgacggtccgttgggcatcgcgttcggcgcgcaaggtcgcctcgaggcggatgcgtgctcgctgggccgcgaggctggcggcaacgcgctcgagcagcagcaactcgcgattgccactgaccgggctgcgcacggctcgagcgcacaggacgaggtcggtggcgtcggggaccggggtggcgaacagccagtcttcggcaccggcacgggcttcggcccatcggacgggtcgtggcgagaggcggacctgtccggagtgaccttcgcgtcgcactcgctcgcacagacgtgacaaggcggtgcggcacggggcggcgaggtcgcgctcggacgagcgcgagagcccgagcgtcgtcgaaccggcgacgagcgccgcaaggtcgaagacgcctgtgtccacgaggctcttcgtcgtgacgtcggcgagttcggtctcggtccgacaggcaaggaggcgatccgagccggttgcgagcgcgtcgaagagtgccgcgagcgccacgcgttctgcgaagccggccgcggtctcgagcgcctcggtcgccgtgcgtccgatctgctcgagcagcgcggcgatccgttcggggtcgggcgccccgggttcgacgagcgcgacgagcactgctcggacctcgtcggcgaggacgagcgggatcgcgaccgcgagcggcacctggcggaggcgtggttcggctcgccagtggtcggggagctcgaggtgggaggccggtcggcgcaccacgtagcagcggcgcgcgtcgcgcgcgaggtcggggatggtgagctgtgtgccgtcggttcgtggttcggggagcagtccgacgacgctgcgcatcgtcccgtaggtggcgaggcgctcgaagcgtcgctccccgtcgctcgtggcgagcgcgtcgacagcaccaacgccgggcagctcggcgaggtggcgcgcgagctcgaggatcgtcgactcgggaggttggtcggtggtggagcggagccaggcgaccagtcgatccgtcgccgcctcgagctcgcgcgcccgcgcgcgacgctgctcttggtggagctcggctgcggcctgggcgagggcgtcgagcaccagcgccgtctcggggggcaggcgcgccaggtcggagcggtagagcgagaggagatagcgggtcccgtcgtcgcaggccgcggccgccgagagcgaaccttcgatgccgaagggtcgggctcgctcacgccagggcgcaaagatcgcatcgtcgaccgtggccacgacgggggagagcgaccggagggtcgtgcccgccggcccctgccccgagagcgaggtggggtcgtcggagagctcgaggtccgcacagtacgccttggccgtgccactggtggcgagaatggtcgcgtggtgctctccgggatcgaggcgcgcccagaacccggcgagcgtgggtgggacacacaaggtctcgagggcgtcggcgaggcgttcctcgaagcttcgtccgtcggcgcgccggagcacccgctgggcctggaaggcctgcagcacgagctcgaggaccgctgacggtcgctcgagcgcggggtcgacgacgctcatggtactcctcgcatacgctgcaactcagtatcgtacgccccagggcgctcttgagccctcggcgacggtcgagccctcggcgacggtcgagcccccggcgacggtcgagccggtgcggtaggctcccaccatgaacaagaccgagatcgtgcgagctcgcatcgacgacgacgaggttcgagcgccgatcggcacacttctcgtcgagctcgtggggcgcgacgtcccgcacgtgtgctatcacccgcagctcggcaccatcggtacgtgcgatacgtgcctcgtcgaggtcgatggccagctggcgcgagcctgtgaggtgtcgctccgcgaggggatgcaggtgcgtacgcgaggtgtggatgtgcgtgcggctcgcctgcgtgccgccggcgccctgctcgccaaccacgagctctactgcaccgtctgcgacaactccaacggcgactgtgtgctccacgagagcgtccgcgacctcggggtgaacgaggagctggtgccctttacgcccaagccctacgaggtcgacgcctcgcaccccatgtatcgctacgacccctcgcagtgcatcctctgcgggcgctgcgtgcaggcctgccaggaggtgcaggtcaacgagacgctcagcatcgattggtcgctggagcggccgcgggtcgtctgggacgggggcaagcccgccggcgaatcgagctgcgtgagctgtggccattgcgtgagcgtgtgtccgtgcaacgcgctcatggagaagagcatgctcggtcgcgccggcaccctcacggggctcggccgagctgcgctcggtccgctgatcgagctcaccaaggcgaccgagcctgcgatcggcctcgggcccatcttcgcgctctcggacgccgaggcgcagatccgtcgcggcctcgtgcaacggaccaagaccgtgtgtacctactgcggcgtcggctgcagtttcgatgtctggacgcgaggccgcgacgttctgcggatcgcgcccgagcgaggccccgccaacgggatctcgacctgcgtcaagggcaagttcggttggggcttcgtcgacgcgccagaccgcctggtgcggccgctcgtacgacgtgagggccacttcgaggaggcgagctgggacgacgcgctcgacgaggtcgccggccggttgcgtgcgatcgtcgccgagcacgggcctgacgccgtcggcatcatcgcctcctccaagtgctcgaacgaggaggcctatctcgcccagaagcttgcgcgggccgtcatcgggacgaacaacatcgacaactgctcgcgctactgtcagtcgccggccaccatgggcctgtggcgaaccgtgggctatggcggtgacgccggttcgatcagcgacatcgccgcagcagatctcgtggtcatcgttggctccaacaccgccgagagccaccctgtcatcgcgacgagggtgaagcgcgcgcacaaggaggggcgatcgaagttcatcgttgccgacctgcgccgccacgagatggcggagcgagcggacctgttcttgcgtccccggccgggtacggacctcgtgtggctggcggccgtgacgcgactgatcatcgaggagggactggccgacacgagctttctcgacgagcgcgtcgagggtttcgacgcctacgtcgagagccttgcggccttcgacctcgcgaccgcgacgcgcctcactggcctctccgaagagcagctgcgcctcacggcgcgcatgatcgccgaggccgaacgcgtgtgcgtgctctgggcgatgggagtcacccagcacgagggtggttcggacacctcgacggcgatctcgaacttgctcctcgtcaccggcaactatggccgaccgggcacgggggcctaccccttgcgtggccacaacaatgtccagggcgcgagcgactttggcgccatgcccacgtacttgcccggctatgagcccatcgccgacgacgaggtccgccagaagtggtcgacgctgtggggtgtggaggtcccggatcgacccggactcgacaaccaccagatgatcgacgcgatccacgccggctcgctgcgggcgctcgtcgtcatcggcgaggagctcggcatcgtggatgccaacgcgacctacgtccaagaagccctcggctcgctcgagctcttggtggtggctgatctcttcctgtcgcgaacggcgtcgtttgccgacgtcgtcctcccggccgcgccatcgctggagaaggaggggacgttcaccaacaccgagcgtcgcatccagcgcttctatcgggcgatggatccgctcggtgaggcacgtgcggactgggtctggctctgcgacctcgccaaccgcctgggcgccgggtggagctacgaccatccaggggccgtgatggccgaggctgccgcaggggctgcgatcttcgctggcgtcgactacgaacgactcgaggggtatgcgtccctccagtggccggtggcggccgacggaaccgattcgcccctgctctataccgagcgcttcgcgttcccatcggggcgcgctcgcctcgttcccgtgccctgggtcgagcccaccgagcaggtcgacgatgacttcgatctccatctgaacaatggccgcttgctcgagcacttccacgagggcaacatgacctatcgcaccgccgggatcgccgaggtgacgccggggcccttcgtcgaggtgtccgaagagctggccgccgaacgacacatccgcgacggagcgctcgtgcgcttggtgtcgcgccgaggtgccgtccgggttcgtgccctcgtgacggaccgtgtgcgaggacacgagctgtacttgccgatgaacgggcgtgccaacgaggaggcggtcaacgtcttgacgagctcgtcgaccgaccgggcgacccacacgcccgccttcaaggagctcgcggtgcgcctcgaggtgctcgacgaccccgtcgccgtcgcgctcccgaggcggaactggcgctacggccagcggacgccgcaacgaggcgtggacatcgccgctcgccgtgcccgacccgactacgtcgatcccacactgatccaaggaggtcgtcgccgtggctgaaccgctgacacgtgtgcccgcccgcgcggtggcgagctcgctggagcgcgagcgagccgacctcgcgcgtctcgtcgagacgatgggcgccccagcacgcgacgccgtcgcagcactcgctgcacggctcgacacgcccgcaggacgtcggggtgtcgagacgttgtcgtggctcgtacggctggtggtgacgctgccaccggagatggtcgctggacttgcgcgaggcctcgcagcggcgaatggcgccctctcggactcgtcgccgccgacggtcgccgagctcattcggctggcgagaagccccggggttcgtcggggcgtcaaggcgatcctgagcatcgtccacgagctcggcaccgccgaagcggcgcgtcggctgtaaccgcggacgcgtttcgaacgtcggacaagaggtgctgtgtcgaccgatgtcgtcgaggtgacatcgagcggcaacagggcgccttgcccgagcggcgttctctggttaccatgaggacgtggctcgggcggtggtgatcccacgcccgcggcccaccagcgcgggcggctccgcacagagcgtccggtggcagagcccagaaagggggtcggagccgatggaggctggcacgatcgaggagcagttcccgctcctccagcgcctgaacgaggatggtgaactcgtcggcgatctcggtgtggtcgacctcgaccgtctcgccgaggtctatcgccacatggtgatgttgcggcgcttcgacgagcgcgcgtggaacctccagcgtcaaggcgtcatcgggacctacgcgccctacaaggggcaagaggcggcgcagctcggtgcggcccacggcctcgcggagcaggactggttggtgccgacctatcgcgactgggccgcctcctgggcacgaggggtcccactcgagcacggcctcttcttcgcaaagggccatccccgtatgggcctggtgccagaggaggcgaccgtgctcccggcccaggtggtcatcgctgcccagacactccacggcgtcggtgtggcctggtcgctgaagctccgccacgagccgaaggttgcactcgtgacgttcggcgacggggccgccagccagggcgacacgcacgaggccatgaactttgcatcggtgtttcgagtcccgctcgtgttcttctgtgagaacaaccactgggcgatctcggtgccgctcgagcggcagatgcattctgagaccatcgcccagcgagccgtcgcctacggcatggagggcttccgtgtcgacggcaacgactacgtcgcggtcgtcaacctcgttcacgatctcgccgaacgcgcgcgccagggcgagggcccgttcctcgtcgaggcggtgacctatcggctcggggcgcacaccaccgccgacgatccctcgaagtatcgagagagcgcggaggaagagcgctgggaggcgaaggatccgatccggcgcatcgagcggctgctccagcgagagggtcgcctcgacgatgacgccatcgccgctgcggaggcgagcgctgccgaggcggtcgaaggcgtgctggagcggttccacagcgcgctcgacgacgagccggccacgctgttcgaccatgtctatgccgagctgaccccgcagctcgcggcccagcgcgatcggttcgtcgcgcgggtcaaggaggtcgagcgctgatggcgaagctcaccatggcccaggccctgaatcaagcgctcgcccaggcgctcgagggtgacgagcgcgtgctgatcctcggcgaggacgtcggacgcgacggcggtgtctttcgcattacggacggcctgatcgaccgattcggtcccgagcgggtcgtcgacacgccgctcgcggagtccgggatcgtgggaacgtccgtcggcctggcgatgggcggcatgcgacccatcgccgagatccagttcttcgggttcatctacgagaccatggaccagatcgcctcgcaggcggcccgcgtgcggtttcggtcgatggggcgcttcagcgcgccgctcgtgatccggaccccctacggcggtggtgtcaaggccccggagattcactccgattcactcgaggccttgttcgtacacacgccgggtatcaaggtcgtcacgccgtcgaacccctacgacgcgaagggtctcctgctcgccgccgtcgacgatcccgacccggtgctgttcctcgagccgatgcggttgtaccgtgcgttccgcgacgaggtgcccgaggaaccctatcgggtgcccctcggcgtcgcgaatgtcgttcgcgaggggcgcgacgtcaccttgatcggatggggcgcctcgatgcccgtggtgctccaggccgccgacgagctgatcgcacgccacgacgtcatgcccgaggtgatcgaccttcggacgctctctccgctcgacgaggcgacgatcgtccagagcgtgcagcacacccagcgagccgtggtcgtgcacgaggcggtgcgcaccgggggactcggcgcggaggtcgctgcgctcgtccaagagcgcgcgttcttgtatctcgaggcgccggtcggcagggtctcgggctacgacacgccctaccccatgaccatgttcgaggacctgtggctccctgacgcgacccaggtggtgagcgccgcgctggcagcggttcgctactagcccacgggcgctgggactcgtcgtcgggatcgttgcggccgtggcgccgcgtgagaggagcgcgcatggagtggaagtttccggacgttggcgagggcctgcacgaagcacaggtcgtcgcctggcacgtccacgagggcgacgcgatcgaacgggatgccccgctggtcgacgtcgagactgacaagtcggtggtgaccattccggcgccggtggccgggacggtcgagaagatcctcttccacgagggcgacaccgttcacgttggtgaggtcgtcgtggtgttcggcgacggcagcgcgccggcgccatcgccgctccagccgacggcgtccccggctcatgtcccggcaccgccggttgctccggcgccgacgcccgcgagtgagccgctagcgcgtggggtcgatcgaggcatcgtgctcgcgacgcctgccgtgcggcgcctcgcgcgagagctcggtgtcgaccttgcgagcgtcgtcgggagcggagaacgcggccgagtcctcgccgacgacgttcggcgcttcgcggcgtcgcccgagagcaccgagtcggccgtggccgcggtgtcgacgctgtcgaccggggcgcctcgcgccgatcgaggcgccggcgacgacggtgtcgcgccgctggccgtcgaggccgacgagcgtcggccgctggtcgggatccgcaagcgtatcgcggagaacatggcgcgttcgtggtcgcacgctgtgcaggtcacggtcgtcgaggaggtcgtcgtcgacgagctcgtggcgctccgtgagcgcatcaacgcccacctcggcgagcaacgcatcagctacctgccgattttcgtgaaggccgccgcgagcctgctggcgcgcttcccagagctcaacgcatcgctcgacgaggaggcatccgagctcgtctaccacgcccatcgcaacatcgggatcgccgtcgacgatccccaaggtctcatggtgcccgtggtgcgcgatgccgatcgccgctcgatcagggagctcggcctcgagctcgagcgcctcatccaaggtgcccgggcgcacaccttggggccgcgggacctgaccggctcgaccttcacgatcacgaacttcggttcgatcggcggcatcgtggcgacgccgatcatcaactatcccgacgtcgcgattctgggcgtcgggccgattcgccgccgtgctgtcgtgggcccggacgacgtcatcgtgccggcgtcggtgctgttcgtctcgttgaccttcgaccatcgcgtggtcgacggcgggacggcctcgcgctttctcgtcgcgctctcggagctgctccgagacccggctgccctcgtcgcggagctcgtgtgatggtggtcggggagctgatcgagacggtcgatctcctcgtcgtcggcgggggtccgggtggctacaccgccgcactccgagccgcacagctcggtcgggacgtggtcctcgtcgaggagggcgccatcggtggcgtctgcttgaacgtcgggtgcattccgtcaaaggcgctcatcgagacctcacgcgcctggcacggcctcggtgagctcgccgagcggggcgtgatggtcgcagacgcgtcgctcgatcgtgcgcgcgtccgccagagcgtcgaggcggcgcgcgatcgcctgacgggcggggtcgcgcagctgctcaaggcggcgggcgtcgaggtcgtcgagggccgagcggccttcgtcggcgcgaaccacgcgcgcgtccagagcgcgcacgaggcgacccaggtccagttccgtcaggcggtcgtggcgacggggtctgcggctcggcgtgtgccggggctcgaggtcgaccacgagcacatcctcgactcgacggatctgctgttccgggacgcaccgatcgagcggctcatcgtggtgggcggcggctacatcgggctcgaactcggcgcggcgtgggctcgtctcggtgcgaaggtcaccatcgtcgaggcgatggacgatgtgctcatgggggccgagccggaggtgcgtcgcgcgctgcgcgacgggctgggtcggctcggggtcgaggtgcggacccgcgcggtggtgtcgtcggtcgaggcggtcgccgacggggtcgtcgtcgggatcgagcagggcgcgggcgtcgacaagctcgcagccgacgtcgtcgcggtggtcgtgggtcgagagcctcgcctcgagccagagctcggcctcgaggctgcgggcgtcgcggtcgccgacggcagggtcgtggtcgatgtggcgcgccgcaccacgaaccccgcgatcttcgccatcggcgacattacgcccggtccgatgcttgctcacaaggcctacctcgaagccaaggttgcggccgaggcggcgagtggccacccgagcggcttcgatgctcgcgtcatcccggccgtcgtgttcgccgaacccgaggcggcctgggccggactcggagaggccgaggcacgggctcgctacggatcgatcgtcgtcggtcgcttcccgtatcgggccaacggccgggcggttgcggtgggctcgacctggggcgaggtcaaggtgatcgcacgcgccgatggcgaggtggtcggggtctggatcgtgggtgcggacgcctccaatctcatcagtgaggcagccctcgccatcgagatgggcgccacactcgacgacatcgcgctcaccatccacccgcatccgacgctgagcgagatgctgcccgaagccgcagaggtgggtctcggccggccgacgcacatcatcgtccgtacgcagtcgggcggtcgttagggggttcccggcgcatagctccgggggcggctatgcgcgcccgtggtcggcgcgagcgtcggctgcgagttcgtcgcgagctcgcggatcggcgaccatggtgatgatgcgttgcgcttgttcagtcgcgctcgcgccgaagaggtgggcgacaccgtgctccgaaacgatcgcggagtgctggaacgacgtcaccggcgtgtcgaggcaggcgcgcacgttcgaggcgtcggttggggagtgccaggagcgcagtgcgatgatggactggccctcgcgcgcatggagcgcaccgacggtgaagtcgggttgtccgccaaagccggagatgacgcgagggccgaggtggcacgcgttcgcctgcgcgaacagatccacctggagggcggcgttgatcgcggtcatgcgtggctggcgcatgatcatggcagggtcgttgatcgtctcggtccgaaggagacggagcctcgggttgcggtcggcccacgcatagagttcagccgagccaaagaggaacgacgcggtgatgggctcgctccgatcgagggcggctcgccgctccagggcgaggacgccgtcgctgatcatctcgctccagatcctcaagccacgtcgatcctccaagcgcgccaggacgcgatcggggatggcgccgataccgagctggagcgtggcgccgctcgggacaagacgtgcgacgtgctcggcgatggctgctgcctggggatcgtcggcgttgcgcgcgtccggcgaggacagcggcgcctctgcctcgatggcccagtcgatggcgtcggtctcgatctctccgtcgccgaagacgtagggcacatgagggttgagctgggcgatgacgaggccaccgtgcgagcgaacggcctcgatcgccgcaggcaagatgttgacctccgttccgagtgagacccgacccgcgatcggaagggacgtctggaccatcacgacgtcgggtacgagcgtggtggcgaggagggtcggcaccagcgacaggcgcatgggcagatagcgcagggcgtcgccttggtcgcggatggctgggccgaggaagggcgactcgtaggtgatgcccgggcgagccgggatcgggtgctgggcgttcaggatgaacaggcgccagcgttcgagttcggcctcggcggcgccgaggagggccgttggggtgaggaagttcccgcctgccacgatgcgcggctcacgacggccgatggcggcgagccgcttgcgtaacgtgtcgtctccgatgatctccatggcgggtgctcctacgggattggtcaatggttgggatcgtggtcggacacgtcggggtcgggtcggccgaggttcgggtcgatccgatcgagctcgagcgtcacgtcctcgccgcgctggacgcgcagtgagacgtaggcggcgacgccgacggggatcgggagccagaagttgaagatccgccacgtgaggacgccgaggatcgcgacacctcggggcgcaccgaatccggtcaggagggtgatcgcgagggtctcgacgaccccgagtccgctcggcgtgagcggcagcaccgcagcgacgttggcgatgccgtaggcgacgatgagcgcgaccgggttcatgagctggccgaacgccgccagcatgatccacagggtcgttgcatcgaagagccagttggcgagcgcccacgctgacgcgcgccggaggagctgcgggtcgcgcccgagtgcgcggagtcgctcggccgtttgagcgatggcgtgttcgatggagcgacgacgatgggcgagcggagggacgtggtcgatcaccgtaccgaccgcgtgctgggtgcgacggttgccacgggtgagcaggatcacgaccgcaatggagatcgccatcagcgcgacgccgaggacggcgacgacgaggtagacctcgttgaagccgtagaacgggagcgacacgagcagggcgagccacagcagtgcgttcaagatgagggcagatccgacgctctgggtcgcgagcgcgacaccggtgtcggccccgcgaacccccaggttcgacagcagccgcgcggtgagcccgacgccgctcgcggagccaccagggaggacgtgcgagaccgcaaggcccgcgaggtcgaccttggcgagctgcccgatgctcggcgtggggcgcgggagtaccgtctcggtgagcttcgcatacgcgaacagcgacagagcctcggccaaggcggcgagcggtaccagccaatagttggcgcggtcgaggagcgacagcgtcttgcgaaagcccgcgaattcgggaacgacgaggtactcgatcacgagcaggatgacgaaccctgcgagccctcgaatcgcgaagtgtcgtatgagcttgccgaggctcctacgggttccgcgcaggaccggtcgcggtgatgctgagtgtgatgccgcacgcgacgacgcagatgacgacccagaacgtgatgacgcagcgcgcccgagcgcgggaagcgtcagaccgagccacgaggggccgagtcgagcacgcggcgatgccccccgtccttcggtgctcacaacctcgtcagtctaacctgtcgagaggcgtcttggggcaatcggcgaggaggactcgatggtcgagcgacggagcctctcgctccgtgacctcctcatcgccgaggccgtggccgccgggctcggcgtcgcggtgtgggcgttcgccgtgcttcgtcacctcgagctcgagatcgtcgtggcgggtgttctcgcgctcgtcatcgaaccgatcgtctcgaggctcgtgcgtctcggactgccccgtgtcgtcgcggtgctcgtcaccgcggtgttggtgctcgccgcgctcgtcggcctcgcggccgcgttcgtcgttccgctcgtgaacgccggtcagcggctgctcggagatctcccgggcctgctcagccgcttgcgtgcccatcgagccgcgatcgaggcgctgctcgtgcgccttcacctccagcacgcgctcgacgtgggtgcgcagtcgatcgcccacgcggcgcagttggcggtgaccccggcgctgtccgtggcgagcggtgcggtcggttcgctcgccacgctcgcggtgatcggcacgctcgccgtgttcctctcgctcgaggcgccgaaagcgatcgcctggctggtggcgcagctcgatgcgtcgcggcgtcctcgtgtcgagggcgtcctgcacgacgtcgcgatcgcggtggcgggctacgtgctcggcaacctcgcgacttcggtggttgccggtctggtgatcggggtgacctatgcgatcctcggtctcccggacccagcactcatcggactgtgggtcgggctcgtcgatctcctgccgttggtcggtgggctcgcaggcggagtaccggcggtcgcgctcgcgctcgtcggcggacccgaggacgtcgtcatcgtgctgatcgtggtcctggcctaccagcagatcgaaaatcacgtgctcaatccggtcgtctatgcgaagacggtccggttgagtcccctctgggtcctcgtggccatcttggtcggcgcacaggctgcgtcgctgccgggagcgctcatcgccataccgatcgcgagtgcgatccaggtgatcgcgcgtgagacgctgcgcgatccgttgcggcgttggcttgggcgtggctcaggcgccgtggtcgcgcaggggaccgatctgccaaccccgagcacggacacgggcgacgagctcgtccaggctggcgagggtggcaaggggagccccgggggcgctggtgacgtcggagtcgtgcagcagcagcgtggcaccggggccgagccggtgcgtgaggtcggcgaggatcgaggtgctggacgcggcaaaccgccagtcgcgcccccagcttgaccaggtgacgaggcgaacgccttgctcgtgtgctgccagtcgcgttcctcgactcacgaccccgtaggggggtcggaaccacgtcggacgctggccgaccacctcttcgatcgcaccgacggcgcgggcgaggtcataacgcaccgagcgcgcggaacgcccgagatggttgcggtgccagtggccgtgcacggcgatctcgtgtccgcgctcggccaccaggcgcgcgacccatgggtagcgctcgacctcagagccgagcaggaagaaggtcgcgtggacgtcgagccgctcgagcgcgtcgaggatccgaggcgtggtcaccggactcggtccgtcgtcgaaggtcaaggcgacgtggtcgtcgaggccgatgccagcgacggctgggttgagccgccgtgcgatccaccagtggtgggtgagcgccgggccagcgtggttgacgagcgctgccgtacccacgacggcggcggcatggccccacttcatgggtgcgacctcacgcgctcagctccggggcgcgcgcgagctcgctcaccggagcgccgacgaggtggcgtgctgccagcgcctggcgggtggacgccgcgagcgccagtgcactcgcgacggaggcggtgggatcagcgacttcgacgatggaaccgggcgcgatcgtgcttgcgagcgctcgtggcgggatgatgcgggcggggatcacgctctggtggtgcagcgccgcccaggcgagatcgaccgcgttgatggtgttctgcggcacgtacacgttgacggggctgccaaggacggcgctgagcgccgcgcgtccgagctgaagatcattgacggggacgatgaggctgaggtcgccgatacgcgaacccgcgcccccgttgacgagcgcgacgcccgctgctccggccatcgccacggcggctgggtcacgacgaaccccgcgttcggtcacgacgacggcgatgtggtcgttgtgcagggcggcgtcgagtgccggcgacgcgaggtccggtgtcggcaggagcgccgcgagataggcaacgtgggtcggccgtgcggctgcggacaggttgaggccctcgtagccgatgaggcccgatgcgacgttgaccgcgacgaagacggacgcggcgctcgcgaccccgacgagtcctcgacggagcacaacgcgctggggggagagtgctggtcgcggcggagcctctgtcagcaggtcgaggatgggtgcttcgggggttgcctggaactgtgcgagcgccgggagcgtgagctcttcgggcgcggaggcgtagtggacgaccgcgtcgcggagttcgcgtacgttgcgtgcccagaacgtcacgccgctctcggccatcgcggcgacgttctcggcaccgtggccgacgatcggttcgtaggagatcaccggacggcgtgcggccatcgcctcgagcgatgacagtcctcccgcgttctggacgaccacgtccgaggcggcgagccagaggtcgacctcgttcgtccaaccgacggcgacgatcccgtcggccgcggctgcgcgcgctcggagctcctcgttgtgaccggcgagcacgacgggcaggacgtcgcccgtgctggccaacgctgcggcggtctcgacgagtttgcccaccccccacgaaccgccgacgatgagggcgatgcgcgcgtcaggcggcaagccgaggtggcgacgcgcgctggctcgctccggcagcatccggaagcgctcgtcgacgaagggcccgacgcgcacgacgggtccacgcaggtggccgcggcgcttggcctggacagcggcggtctcggcgaccgcgaggtggacgtcgatgtcggggtggatccacatcggatggacggagaagtcggtgaggaaggtgacgaggtggcggtccgcgacgcacgggtcacgccgcctgcggaactcgccgagcagctgcgcggggaagggatgggtcgcgatgacgatgtccgggtcgatcgtctggagccattcgcgaaccttcgcgccgaaggctcgtcggaacactgcgcgcgcgaccttggtcagtgcagggatgtgtgaccagagctcgaattcgagccgatacgcccagggcgcacgctcgacctcgacgcggaagacggtctcgagcatcgtgccgagacgtggggctgcgtcgaggaagtcgacgatgctgacgtcggcgccgtgacggccaagatgatcggcgatggcccttgccgccccgtcgtggccgccgccaaggcgcgcggacacgatcaggacgcgtggttgggacatcggggccagtgtatcgcatcgccgtacactgggcgaacagtggctctcttgctcgctctcggcgcggcgctcgcgtttgcgggggcgaccgtgctgcagttcgaggcgagccaggctgcgccgcgatcggcgtcgttgcggatcggactcgttcgccatctggtcggcgatcgtcgcttcaatctcggagcattgctcgacgtcgccgggggtgtggcacagttcttcgcgctcaaggtggggtcggtggaggtggtgatgccggtggtggcgagcggtctcgtgatcgcgatcgtggcgcaccacgtccaacgtcggctcgcgatcgtcccccgcgacgccgtggcgttggcggggtcggtcctcgcgctcgtcgtcgtgttggtcgtggcgccccagggaggctcgcgcctgggatcggtcgcggcccagctcgccgtcgccgcggcgggactcggtggcggcgccgtcgcgttgacggtcgggcgtcgggtgctgctgcgtcggggttggtacctcgccgcggccggcgggctcctgctcggggtggtgagtgtcgtggaacgctcggtcgggctcgtgtggagccaacggggaacgctcggcgtcctcgagagctggcagctgtggacactgctcgcagtgggtgcgctcgcgctcctcgtcgtccagagcgcgttcggcgctgcacggctgctcaccgtggcgccgatcgtcgcggtggcagagccgatcgtcgggagtgcgctcgccgtgtgggtcgagggggctggtccaggctttggccctggcaggctcgcgatcgtgttcggagcgatcgtgctcgaggcggtgtcgatcatcgcgttggcgcgaggagcccgcgacgagggaggggtccggtgagcggagtgcgcaaggtgctcgcgctgcacggtcagccgggttcgggtcggagtttcgatcctgtggccaggtggctcgggcgtctcgaattcgacgctcccgaccgaccgggatggggatccaatccattggcgcctcgggagctcgtcgcgcaggcatcgtgggccaaggagcggatcgacggcccgacggtgctcgtgggctactcgttcggtgcggcgatcgcggcgctcgtggcgccgacgtgcccggcggtggccggtgtcgtgctggtggctcctgccgtgacccgcgccgcgttggtctggagcgatcgcctcctcgccagggccggcgtcggacacgtcgcgggatcgttgatcgccgcagtggcggagcggtccgtgccggcggcgctgagtgcgcgggctcgccaggcgttcctggtcgagcagcgatcgctgctcgacaccatcgaccaggtggagacgtcgcttcggcggctcgacgtcccggtcatcgtcgtcgcgggtgctcgcgaccgcgtggtgcctccgcgcggcgccctacggctcctcgagtgcgtgccacaggctcggctcgtcgtctcccgcggtggtcacgatcagcttgcggacgaggcggccgtcgtcgccgatgccgttcgatccctggcctccgaacggagtgcgtgaccggggtgggaggtcttctgtatacgaatgggatccgccggctcgggcgatcggataacattggtacggacgaccggagcagtgggggcgtgctgcggacgtcgtggtgcggggggcacctggagcggcgaaggagccgggtgtcgtggagtcgatgaagctggcgacgtgggactgcgaagattggcgggtgcgtgcgcactgtcgcgacgttgatccgggtttgttctttcccgtgggcgtgacgggtgaggcagaggtccagatccgccgggccaagcgcgtctgtgcggactgtgacgtgcggctcgaatgcctcgagttcgcgttgcgcaccaaccaggagttcggtatctggggtggcaaagacgaggaggagcgtcgcgtgatacggcgtatccgtcgtttgcagcggcgagccgtgtcgcgagcgatctagccggcggcccggtttcgcctcgggcacgcggcggagccgtcgcgggtcctcgggccctggcgcactgtgatgggagcgcgggcgagtccgtcgaccgatctggacagcgctgtgtgcgtccgctgcgatgcgtgcggttgcgcggagacgacggcaaccgctgacgtcgggacgtcgccccgcgagtgtcaaggaggtgagcgccgcacggtaggacgtcgcgctggcgagccccaggtgtcgacctcacaacgtcggaaccggtgctccgtgcagtcggacacggtcggcgtgcgcgtagagacgaaatccctcggcacggagtccgccgacgaggacgatcccggcgtcctcggctgtggtgatcgcgcggtggctgggcgagccgagggcgatcaccgatcgggccccgatcgccgcggccttcaagacgagatcggtgccgatgcgacccgagaggatcacgtccgaaccggtcgcaagcgtgccggccagtgcagcgtgaccgatcgccttgtcgagggcgttgtggcggccgacatcttcgcctacagcgaccggcgacccctgtcgtgcaagaatcgccgagtgcgcggcacgtgtcaaggcaaacaagccgtctgcctcgctcacgagctcgtggagcgcgagaaggtcgtcgacgtcgatcggttccccgtgcggcgacgcggagacctggtgcaggcgccgttccagatcgtcggtaccgcaccagccgcacgagctcgtccgtacgctcggctgaggtgggacggcaaccgggtggcggaggacgaccgtcgcctgacggtaggcgggttcgcccgcactcggtggcggacagagcgacactccgacgacgtcgcgtggcgagatggcgagttcggtcacgacgagacccacggcgagcgcggtgtcctcacctggcgttcgcagtgtcgtggtcacaagctcgggcgctgcgtcagggcctttgacgaggatcgcaagtggctcctccgcgatcacccgctcggcgcggagccgaacgccacctgtccgatcgacaagtgtcacgcgtcttcgtggcgacgcgctctcgactgaccggttgcgctccaccgcaccatgctagctcaccggctcgatagcctgatgaccatggatcagctcgagctcttcgtcgacccggtctgtccgtggacgtggctgacctcgaggtggctcgagtccgtggaggccgagctcggcctcacagtgcgctactcggtggtctcgctcctcgagctcaacggcgacgatccgtcgaatccgtggatcgaggcgatgcgccagggtcgacgcctccaacgagtcatggtgcggctgctggcggccggtgatgacgctcgcgtgagcgcgctctaccgtgccgcaggtcgcgcgacgttcgagggtggtcgtacgctcgacgccgagctcgtccgcgagctcggggagggcctggggctgagcgatgaggacatcgcggccgcagacgatggtcggctcgacgccgccgtggtcacagagcaccagcgcgcgatgcgactcgcaggtccggacgtcggctccccgatcctggctcgtcgcggcggcgagaggggcttctacgggccgatcgtcgaccgccccctggcgccggacgaggcggttcgactctggcacatcgtcgaaggagtgctggataccccggcgttgttcgagatcaagcgcggacgggccgtcgagccccgattcgcctgaacgagcctcctcaggtaactgtggccccgaccaggtgaccaatcccaaaggtgacggcggcggccaacgcggcgagggcaagctgtcgaagggcactcgagacgaccggccgagccgacaacgctccgagcgcgcccccgaggccgagagccgcgagaccggcgagcccgatcgagagtcccgtcgcgagggtgccctgcgtgaagatccagggaacgagcggtacggctgcaccgagggagaacagcgcgaacgatgcgagcgccgcctggacgggagatccggtggcttcgggagcgacgccgagctcctcttgggcgtgaatgcgcagggctacgtcgggatcgcgcatgagatagcccgcgacggcggcggcgagatcgctcgggacgccacgctgctcgtagagctgctggagctcgagtgtctcggcttcgggtcgatgacggatctcggtgcgttccacgtcgagttcgcgctcgaggagttcacgctgcgcacgcatcgacacgtattcaccaatgcccatggagaacgccccggccacgaggccggcgataccggtgaggagcaccgtgtgccctgcgtgggaagccccgaggacgcccaggatcaacgcaacgttggtcaagagaccgtcggaagctccgaacaccgcagctctcgcgccgccaccggtgacgtcgcggtgctcgacgtggtgtgcctccatagctcctgaggctagccgcggaggccgagttcgccgagcgattcgtgccgcggtaggctgggcgtatgcgtgaactgaagctgatcgatcggtcgcaacctcagacgctggtgatcgcgtcgatcttgctgtatctgaacgccttgttcacgctgttcgagatgctgttcgtggggctctcgccgctcgagctgttgaccatggtggtgctcccgatcgtgggcgcgtacggaatcgcgaactctcggcgcatcggctactacctcgcgatcgcggctgccgcgatcccgttgctgacctacctctacttcggcatcctcggcgggatcggaaccatcctgtcctccggcgtgatcatcatcatctttgcgatcgtcccgttcgctctgttgctgcacccgatgtcgcgtgagtatcagcgcgtctggttccactagtcctcttcggcgcccctcgctggcgccatgtgaggccgacgaggcgtccgtagcctctgtctgcgtaccgacgggtgggggcgccggctcgtggtgcattcgacggtgtctcttcacaggccgctggtcacgggcagccgtgcagccccgcgcgcatgcttggcgtgccttcccacctgacgcgagcgtggcggtagcgcgatgagccccgacggacggcttcgccgagctcggctggtggcctcgagggcgttggatggccgcggtctacggcgccgcggagcgatcgacgggcggtgggagggcggcctgggtggcgccgcgtggcgtccgctcgccgtcggcgctctcggcaccctcgacgatctcggcgcgcaggcgtggcaggcaccacggataggtgcgctgcaggtaggcgatcagccgctcacgaacttcgcactggagattccacgacgccgtggagtcccgggcgctcatgaggaggcgcagctgcatcgtggacgtcccgaggctcgtgacctggaggcgtgcggtcttgccgtcccagtcgggagagtcagccacgatgtggaggaacgcctcgcgaatggcgtcgacgggagcggtgtagtcgacctcgacgtgcacccatccgaggatgtcggcggtggtcttcgtccagttctcgaaggcgttggaggtgaagtacgagatcgggagcacgaggcggcgcaggtcccagacccggaccaccacgtaggtcaggttgatctcttcgatccgaccccagtggccgtccacgacgacgacgtcgtcgaggcggatcggctgggcaagcgcaatctggatgcccgcgatgacgttggaggcgatcggtcgcgacgcgacgccggcgacgagggagacgatgccagcgctggcgaggaggccggctccggcgatgcgaacgctcgggaacgagaacagggcaagggccagtgcaacgatgacgatcacgacgaggaggatccggcggaagacgcgcagctgcgtctggaggcggcgggctcgaaggttgtccggaccctcgatgtggtagtggtacaagatggcgtcttcggcggcttcgagcaggcgagcgagggcccaggttccgaccgcatcgagtgcgagttcgatcccgtgggtgaggtcgccgatggtggcaccgggcaagcgcagcgagcgcaccaccatggccatggcgaggagcgggatcccggagcgcaccggtccgatgagtcggcgcagcgcggcggtgcgcacgctgttcgggtgccgacggttgacgacccgggtgatgcgcacgagggcagcagcgatgacgagccccacgacggtggcggcaccgagcgacggtaggatcaccaacagctggtgggcgatgctcacggcctgctcctttggctcgcacctcggcggcatcaggctagcgttggcatcacggctgacgaggcggcttcggagcggcctgctaccatcggctcatggcgtcaacgtctgtcgactcgctcgaagcgctccacgggctcgtcggtacccatctcggctactcggcctggttgacgatcactcaagagcgcatcgatcagtttgccgaggccacaggtgaccaccaatggatccatgtcgacccagtccgagcagcgtcgggaccgtttgggaccacgattgcccatggctacttgacgctgtcgctggtctcggccttgttgccggaggtgctcgacgtacgaggcgtcggtatggtggtcaactacggcgcgaatcgcatccggtttccagcgccggtgccggtcggatcgcgggttcggcttggggcggtgctcgcgagcttgagcgaaattgccggcggtgcgcaatcgcaggtcgacgtcacgatcgaggtcgagggatcgaccaagcctgccttggtcgccgagatcttgtttcgctactaccaggtctgacgggacaccgagccagcagctaggctcgtgtccgtgaagcggcgcgtgctctcagctgctctcgcggatgcgaccctcgtgccgcctcgccagggacgatctgaccgtatcgacggtgtcgatctggatcgcaccgaggccaagcgcctgcgtgcctgggcgacccgtcacatcacggcgcggcaggaggccttgtgggccgaggggcgacgatccctccttgtggtgctccaagggcttgacacggcgggcaaggacggcacgacgcgagcggtgtttcgcggggccgatccacaaggcgtgcgggtcgcctcgttcaaggctccgaccgcactcgagcttcgtcacgatttcctctggcgagtgcacgaggtcgccccagcggccggcgagatcgtcgtcttcaatcggtcgcactacgaagacctcatcgtgccgttggcgaacgggcagctcgacgacgcgggactcgacgagcgtgtggccgcgatcgaggcctttgaacgccatctccttgactcggctacagcgatcgtcaagttcttcttggacgtctcctacgaggtccagggcgagcgactgttggctcggttggagcgcccggagaagcactggaagttctctgagggtgaccttgccacgcgagagcgcttcggtcggtttcgggcggcctacgacaccgtgctggctcggaccagcttcgacttcgcaccgtggcgtcggatcccggctgatcgtcgctggtatcgcaacgcggtcgcggccgccatcgttgcccacgtcctcgaggtgatggatccggcgcctccggccgtggcgatcgagcatctccaccacatcgagcacgtcttgcgttccgaactggcgacgccgggagctgagccgtgatcgggttcgtcgttcgcaactggttccgtgactcgctcgagaccatgttcgtgatcgctatcggtggcatggtgacctcggtcctgcgccaggcccggcgtgggaacctgccgatctatcgctgcgaggcctgtggcggtgtgacgtcgcgtgcgtacgcggtgtgtcgtcactgcggtgcgccggtgcgctcctgaccgttgtggccgatgcgcaggaatgccacgccgggtgcgtaggttggcgggtctgatgagccaactgatcccgcccaagttcgagtcgcccgacgcaaagttgcgcgcggtcggcgcgatgttcgatcgagtcgcacctcgctacgacgcagccaatcgtgcgatgacgctcggactcgatctcaggtggcgtcggcgtctgctgcgtgagctcgccctggcccccggtgcccgcgtcctggatctcgcctgcggtacgggcgatttcttgcgcctgctcgccgaggagggtgccgcgccgatcggcctcgacctctccggtagaatgttgcgtgaagtccctccccacttcgatcgggtccaagccgcgggtgagtcgctcccgtttcgcgatgagagcttcgatgctgtggtgacagggttcgctgttcgaaactttgcgtcgccagaagcggtgttctcggaggtggcacgggtgctacgaccgggtggagcgctcgggatcatcgaggttgccactccacactggaggccggctcgtgccgttcatgcgtggtacttccagcgcgtggcgccgatcatcggctgggttgtcggtcgcgaccgtgaggcgtatcggtatctgcccgcgtcggtggcgttcttgcccgagccgttcgcgttcgctcgcatgctcgtcgaacgggacttcctgccgccgaagcggatgctggtcggcatgggtgcttcccagttgctcgtgacgcacaagaggcacggatgaggcagctcgtcggcctccgcgaggtgcgctcgctgggagggatgcggtccctctacggcatcatccatcgggccgagcagctcggtcggcccttcgaactcgtggaactcgacggtggtatcgtgctcggactcggggagccgagggtggccgagtccggagctccgggtccacggttccatgcgctccggttcggcgagtcgaccctcggccctggtcgctggtatcccgtggtcgtcgcggcggattggtcgcgcatcgccgtggtcggctacgaggccgaggacggcgcgttctcgagcgagcctgcggtctgggacatcgaggagcttgcctacgaccgagcgccgctcgtcggagcgttgatcgaccacgacctcgcgggtgcgcgagcgcgcatcgaggcggccatcgaaatggtgcgccagggcgcgctgcgcaagatcgtggttgcgagttgggcgtgctggcaaccctcggagcgtttctcgatcgctgcggcggcatcacgcctgaagcgtgagcacccgcacgcgcacctctatgcgagcccccactgggtcggtgcgaccccggagctgctcgcgaagacgtcggggtcgtgggcgcgtctcgagccactcgcggggacggcgcgtcggggggcgcaggcacgcctgctcgcgtcccgcaaggaccggctcgagcacgagctgatggtccagcagctcatcgaggatctcgctcaggtggccaaggagctgaagcgccccagcgcgccgttgctcttcgatgccggcccgtttgtgcatctcgcgacacccatcgcggccacgctcctgccaggtctcggttacgccgacctgctcgcggcgatcgtcccgaccgcagcggtcggtggtgtcccgcgtccggtcgctgctgacctcctcgccacgtgggagccgtggcgagggcagtacggaggcgccgtcggcgtgagcgatccgtctggtgacggcgagttctacctctcgatccgaggtgcgacgatcgacgacggcgggtgcgtccgcgtcgcagccggcggaggagtcgtcgagagctcctcggtcgatggcgaactcgccgagaccgtcgcgaaaatcaatgccgtcgctggcgtgttgggcgccgccaccttgtatgcctgagtggatccgcgttcgcggcgcgcgagagcacaacctccagaacgtctcggtggacgtgccacgcgatcgtctcgtggtcatcacgggtctgtcgggctcgggcaagagttcgctcgcgttcgacacgatcttcgccgagggacagcgtcgctacgtcgagtcgctgtcgtcgtatgcccggcagttcctcggtctcatggagaagcccgacgtcgatgtcatcgatgggctctcacctgccatcgcgatcgaccagaagtcggcttcgcacaatccccgctcgaccgtcgcgaccgtcacggagatctacgactacctgcgtttgctctacgcgcgcgtcggtcatccccactgcccatcgtgcggacgtgaggtgagccggcagacgccccaggacatcgtggactgggtcctcgcacgttatgagaacaggcgtttgctggtcgtggcgccgctcgttcgcggccgcaagggaacctacgacgagctgctcgaccgactggcgcgcgagggatggtcgcgcgtgctcgtggacggggtgctgtggtcgctcgacgaccgaggctccatcaacctggcgcgctacgaggcgcacaccatcgcggtggtcgtcgaccggatcgtgcccaagtccgccgaccgccagcgtctgaccgagtcggtggagacggcgctcaaggccgctggcggcgtcgtcgaggtcgtgccggtcggcgacgacggcgagctcggagcgggcgagcgcttctccgagacgctcgcctgtgccgtctgcggcatctcgctgggcgagctcgaacctcggagcttctcgttcaacagccccttcggtgcctgtccggcttgtggggggctcggggtccgcttcgtcgtcgacgaggatctcgtcatgcccgacccgaatcgctcggtcctccagggcggcgtcgtcgcgctcgggacgctgcgggccgatctcgttcgtcggcagatggagcgcgccctgcgcgccgcgggtttctcgctctcgactccggtcggcaagcttcccgaggcggcccgacgcctcatcctcgagggcgcttccgagccgatcgaggagcgctgggtcgatcgtgccggtcgtgagcgcagggcccaggtgacgttccagggcgtcgccgccttcctcgagcgacggcggagcgaggccgagtcggaggtggctcgtcagctcgccgagagcttcatgcgtgaggtgccgtgcgatgcctgcggcggcacccggttgcggccagaggcccggagcgtgaccgtcgatggggtgagcctcgacacgctcgtcaacgcctcgatccgccgtgcggtcgaggtggtggatgcgatgcgcttcggggagcgcgaggcgaccatcgccacccctgtgctgcgcgagattcgcgcacggctgcagttcctctgcgacgtggggctcgactacctgacgctcggtcgggcggcgagaacgctgtcgggcggggaggcccagcgcatccggcttgcctcgcagatcggctcgggcctcgccggggtgctctacgtgctcgacgagccgtcgatcgggctccaccagcgggacaatcgacgcttgatcgacacgctggtgcacctacgggatctcggcaacacggtgatcgtcgtcgagcacgacgaggagacgattcgcgccgcggactgggtggtcgatgtcggaccgggcgcgggcgagcacggcggcacgatcgtgcacgccggcacggtcgccgaactcgagacggtcgagtcctccctcaccggtgcctacctctcggggcgccgtgcgatcgacgtgccggtggctcggcgcatgcccgagcggggatggttgcgggtgctgggcgctcgcgagcacaacctggccgacatcgacgctgcgttcccgatcggccttttgacctgtgtgaccggggtatcggggtcgggcaagtcgacgttggtgaacgagatcttgttccgggcactcagggcgcagctgcaccgctcgcacgacgtccccggtcgccacaaggccatcgagggcatcgaactcgtcgacaaggtgatcgacatcgatcaggcaccgatcggccgcaccccgcgctcgaatcctgcgacctacaccggtctgttcgaccacgttcgccgtctcttcgccgagacacccgaagcgcgggctcgtggctatcgaccaggtcgcttctcgttcaacgtcaagggggggcgctgcgaggcgtgccaaggcgagggaacggttcgcatcgagatgaacttcctcgccgacgtgtacgtgacctgcgatgtctgtggcggctcgcgctacaaccgtgacaccctggagatccgctaccgtgggctcaccatcgccgacgtgctcgcgctctcggtcgaggaggcgttggcgttcttcgcgaagcagccggcgatcgcgcgccacctcacgacgctggccgaggtgggacttggttacgtccgtctcggtcaggcggccacgaccctttcgggcggcgaggcccagcgcgtcaagctcgcaaccgaactcgcgcggcgagcgaccgggcgaacggtctacatcctcgacgagccgacgacgggactgcacttcgaggacgtgcgcagcttgctcggggtgctgcactcgctggtggatcagggcaacacggtgatcgtgatcgagcacaacctcgacgtgatcaagacggccgactggatcatcgatctcggacccgaaggtggcagtggcggcggcaccgtcgtggcgcagggtacgccggaggacgtggcccaggtgcccagctcgcacacgggggccttcctcgctccgttgcttgggcgatgatggaccgtccggatctcgcagcgattcccgaggcgccaggcagctaccagttccgcgatggcgaggatcgggtcatctacgtcggcaaggcgcgcaacctgcgcgcgcgggtcggaagctacttccaagacccccgtcagctctcgccgaagacgcgggcgatgctcgcggtcgcgagccggctcacctggatcgtggtcccgagcgagcaggacgccctgctcctcgagtactcgctcatcaaggaacaccatccgcgctacaacatccgcctgcgagacgacaagtcctacccgatgatcgccgtgacggtcggggagcgctggccgcgcgcgatgatctatcgaggcaagcgtcgacgtggcgcccgctacttcggaccctacgccgacgccggggccgctcgcgaggtcctcgagctgttgcgtcgggcgttgccgctgcgcacgtgctcgccggccaagcttgcccagcacgaacgggccgggcgtccctgtctctacttcgacatcggacgctgcgtcgggccctgcatcggcgccgtggacgaggcaacgtaccgaggcctggtggacgaggtgacggggtttctcgagggccgagccggctcgctcgtcgacgccctcgagaccgagatgcacgccgccgcctcccgcctggagttcgaagaggccgcgaggctccgcgatcggctctcggcgatcgaagcggtgctcgagcgccagtcggtggcgctcgggcacgagcgagacctcgacgcgatcggggtgcatcgcgacgaactcgatctctacctcgaggtcgtgcgcgtacgccacgggcgcatcgtgggcgtgggtggcgcgcgggccgagcgagactcgggtgcgatgctcttcgacgaactcctcgacctggttcggagctactacgacgaccaggccatcgacgttcccccgaggatcgttgcgcgggtcgaggtcgccgaggcgagggaggcgacggacgccctgacctcgctccttggacgcccggtgcgcgtcgtgacgccgtaccgtcgtgagctcgccgtgctcgtcgagatcgccgagcgcaacgccgccctcgcgcaccagcgtgcccgcagagaacgcgccactgacctcgcgacgcgttcgaggggcttgaccgagctcggcgagctggcgggccttggggcgcctccggtccgcatcgagtgcttcgacatgagccacctgcaagggcgctcctacgtggggtcgatggtggtgatggaggacggcctcatgcgccacggggcctatcggcacttccgggtcagcgtgccgcacaacgacgacgtcggggccatgcgcgaggtgctctcgcgacgtctcgatcgtctcgatgaccggcgcttcggtgggcgccccgacctcatcgtgctcgatggcggggcaccgcagctcaacggcgtgctgcggctgctcgaggagcgcggcatggccggcacggtgcccgtggtcgcgctcgccaagtcgttcgaagagctctatgtccccgatcggagcgagccggtgcgcgtacctcgcgggacgctcgcgctctacctgctccaacagctccgggacgaggcccatcgcttcgcgatcacctatcaccgccggcgccgccagctcgatgccgagcgctccacgctcgagtccatcccgggactcggaccggcgagacgggcgcgcctgctcgccgagttcggatcgatctacgagatcgccgaggcaagtgaggcggagctcgtccgtgcgggtgtgccggctcgggtggcgagtgctgtccgcgagcgtctcgggccgctctatcgtcgagagcctgagagcgaccccgatgaggaggtcagatgaacctcgaggagttccgggccatgccggacgccgaggcgatggtgcgcgacctgtgggagacgcacgctcgctggtggcacgaccacttcaccgagggcgctgacgtcgagtacgtcgatcaggtgatccccgaggtgctggctcgggtcggtcaccctcgtcgcgtcgccgatatcggtggcggtgaggggcaggtcgcgagggcgatcgcgcgcgcgaccgcggccgaggtcgtggtcgtcgagccaagtggagcccaggcggccgcggcacgttcgcgcggatcgcaggtcgtccgtgggagcgccgaggccgttccgctcgcgtcgtccagcgtggacgtcgtcaccatcgtgctcgtgctcgagcacgtcctcgaccatgcggcggcgatgcgcgaggtcgctcggatactgcgaccgggaggtcggctcgtgttggcgctcaaccatccgatcatccaggtgcccgactctggactcgtcgaggacgtcgacgcgggcgagacctactggcgctttggtcactacctcgcgagcgacgcatcggtcgaggaggttgccgacggggtgtacatcccgttcgtccatcgtcccctcgaggcctacgtgcgggccgcgctcgatgcgggtctcgtgctgcgcgacttccgtgaaccggcgccgccggagcgatggctgcgcggccagagcggcggcggcttgctcgctgcgttgccgcgcctgctcatcaccgtgtgggagcgtgcgtgaacgcggtcgccttcgtcaccggcatgtccggagcgggccgctccacggtggccgaagcgctcgaggatgccggctggtacgtgatcgacaatgtgccgctctcgttggtgtcgaaggtggtggagctcgcgacccagggcggtgaggagcgcctcgcgctcgtcgtcgggcgcccgtacggggccgagttcgtgcggctcacggaactgctcgacgagctgcgcgctgccgacgtcgcggtgcgcgtgctgttcctcgacgccgaggacgacgtcttggtcgctcgcttcgaggcgaccaagcgccctcacccgcttggcggctccggcgggatcgccgccgccgtggagcaggagcggcgcctcctggagcccgctcgcgaactcgccgacaccatcgtcgacacctccgagctctccacgcacgagctgcgggcacgggtgctggccttcttcgagggccccggagagcggccgtcgctgcgggtcctcgtgtcctcgttcggtttcaagtacgggacgccccgtgacctcgacctcctcttcgacgtgcggttcctgcccaatccctactggcgccgcgagctgcgagcgctgagcggacgcgaccaggcggtgagggagttcgtcctcgagagcgccgatacgcgtggtttcctcgagcggctcgatgggctcctcgccttcgtcgtgccgcgctacgtggccgaggggcgggcctacctccacctcgggatcggatgcacaggcggtcgtcatcgctcagtcgtggtcgccgacgaggttgcgaccatgctgagcgctggggggctctcggtcgaggtccgtcatcgtgacatggagcggggctcgtgaacgcggtcgtcatcggcggtggccatggcatcggtgcgaccattcaggccatgcgggcgctcggcgcctcgatgagcgtggtggtcggggtagcggacgacggcggttcgacgggcctgctgcgcgctcgcgaaccggcgctccccgggatcggcgatgcgcgccacgcgctctcgagcttgatcggtccggacgagccgttcgcgcgcctcctggagcaccgtgttcgccacgcgtcgctccagccccatcccatcggcaatgcggccctggttgcgctctgggagcagacgggctcgctcgtggaggcactccgcgtgctcggggacctcgctggcgtgacggagcgactgctgcccgccgcagaggcgccgctcgtgctgcgagcgacgacggccgatggcgggaccatcactggtcagctggccatccaccttgcccggggcgttcgggaggtctcggtggatcccgcggacgcggtgtgtccgctcacggtggatgccatcgtgcgtgccgatgtcgtggtgctcggtccggggtcgctcttcacgtccgtcctcgcggccgcggtgtcgccggggatccgcgaggcgctctcgatcgcccgggcccgcgtcgtgttcgtcgccaatctcgcgcgccaggaggccgagacgatggagctcgatgccgacggtcacctcgagcgggtcctcgcacacggggtgcgcgtggatgccgtggtcgcggaccacggcttcacgccgagggctgcacgccatcgcgacgtgctcgtacgctcgtggcgtcttcgcggccaggagggcgcgcacgaccccacgcggctcgccgaagcgctcggggaagtgctcgacgcgctcggcgtccatcgatcgggggatcgcaaggggtagcgcgctgcgacgccacgtggtgtcaccaccgtgcttgactaaccttggggcggcgagtgggccactcggctgctcgagggaaaggagaggcgcatgcgggtcgcgatcaatggctttggtcgtatcgggcggatgttcctgcgcgcgatcgagcgaaccggttcggatctcgaggtggtggccatcaacgacctgacctcaccggccgtcaacgcgcagctgctgcggcgcgactcgacgcatgggccgttcccggcgcacgtggcgatcgagggcaacgatctcgtcgtcggagagcggcgaattcgtgtgctcgccgagcgtaaccctgctgacctgccgtggaaggagctcgaggtcgacatcgtcgtcgagtcgacgggcatcttcaccgacggcgacaaggctcgggcgcacctcgaggcgggcgctcgctccgtggtgatctcggcgcccgcgacgaacgtggacggtacgttcgtggtcggcgtgaacgacacgctctacgaccccgaacggcaccacatcatctcgaacgcgtcgtgcaccacgaactgtttcgtccccatggtcaaggtcatcaacgacgcgttcggtatcgagcgcggtctcatgacgaccgtgcacgcctacacgaacgaccagaacctgctcgatctgccgcacaaggacctgcggcgcgcacgggcggcggcgatcaacatcgtccccaccagcacgggcgcggctcgcgcgacgtcgctcgtcatccccgagatgcaggggcgtctcgacgggggcgcgatccgtgtgccggtcgtcgatgggtcgatcaccgacgtcaacgtggtggtgcgggccgaggtcggccgcgacgacgtgaacgaggcctttgcccgagcagctgcggcgggaccgctcgtcggcaagctcgtctactcggaggagccgctcgtctcgagcgacatcgtcgggtccccggcctcgtgcaccttcgatgctccgctgaccatgacgatgccgctcggcaacgggacgacgctcgtcaaggcgttcggctggtacgacaacgagaccggctactcgcaccggctcctcgacctcgtcgagatcgtcgccggtgggctcggagcgcgttgatggagctgccccgcatcgaggacctcggtgacctcaggggacgtcgggtcctcgttcgtgctgatctcaacgtcccgctcgccgtggaacgcggtgagtgggtggtggccgacgacttccggatccgcgcggcgttgccgacggtggagttcctgcgcactcgcggggccgacgtcacgctgtgctcgcacctcgggcggccgaagggtatcgatgctcgctactcgatggcgccggtcgccaaggttctcgagcagctcgcgcctggggtcgaggtactcgagaaccttcggttcgacccccgagagaccgcgaacgatccgagctttgcccaggagctcgcccacggccacgatgcgttcgtgctcgatgcctttggctctgcccaccgagcccacgcttcggtggtcggggtcccagcgctgctgccatcggcggcagggctgacgttgctggacgaagtagagcacctcagcgtgctcctcgaggacccgcctcggccctacgtcgcgatcgtcggtggcgcgaaggtctccgacaagctcggactgctcaccgcgcttgccgagcgtgtcgacgcggtgctcgtggggggtgcgatggccttcacgttcctcctcgctctcgggcacgaggtcggggactcgctggtcgaggaggaccatgtggaggcgtgtcgtgccctgatggaccgcgcgaccatccacctgcccgaagacctcgtcgtcctcgagagcaccgagccggtcggggccgaggtccacggccctgccggcagagtggtgggccgtgacgtgccgcgtggcacgcgcggcctcgacgtcggtcctcggacggtcgagcgcttcggcgaggtgatcctcggggcgcgctcgatcctctggaacggcccgatgggcctcttcgaggatccgcgcttcgccgtcggcactacgggtatcgcgcgagcggtcgctggttcgtcggcctacagcgtcgtgggtggcggcgactcggcgcgagcgctgcgcgaggctggcctcgccgaccaggtgagccacttgtccacgggcggtggggcgtcgctcgagttcctcgaacacggtgatctaccgggcctcgccgcactgcggcaagcggcggagcggcgtccatgagtcggcgggctcccgagcccgagccccaggcgggatccggacgggtgcgtctcgtcgtcgccaactggaagctgcaccacacgcacctcgaagccatcgcgttcttggagcggctgtggcacctgttggatgtcgaggactaccggcgcgcggagatcgcgatctgccctgcattcacggcgctgcggtcggcgcagctgacgatcgagaccgatggcatgccctatcggctcggtgcccaagacgtcttctgggaaccctcgggggcctacacgggggaggtgagcgtccccatgctcgccaagctggacgtcaagtacgtgatcgtggggcactctgagcgccggcgcttgttcggcgagaccgacgacgtggtcgccaagaaggcggcggcggtcgcgtccggtgggttggtaccgatcgtgtgcgtgggtgaggtcgccgaagagcgcgctgggggtaccacggaggccgtgctcgagcgccaactcgacacggtgctcacgacgtatccggtcgaggcgctcggagagctcgtgatcgcctacgaacccgtctgggcgatcggttcgggaacgcccgcgacgcccgaagacgccgagcacgtcgctcgcttcctccgggaccgcctcgcgcgccgggcgagcgaggcggtggctgctcgcgtccgcatcctctacggtggctccgtcgacgtgggcaatgcggtcgcgttcctcgcgcaggccgacatcgatggtctcctcgtcgggggtgcctcgctcgatccggagcgtttcgcgcagctgctcggcggccgaccccgcatcgcgtcgacgtcctagactgccattgttcgcagggaggaggactcatgttgaccgtcgtgctcgtcgtcgtgcaggtcgtcagcgcgatcgggatggtggtcttcgtcctgctgcactcgggcaagggtggtggattgtcggacctcatgggcggctcgagcttgagctcggccgcgagttcgtcggtggctgagcgcaatctcgaccacatcaccatcgtgctggcactggcgttcgccctgtcgagcatcgcgctcgggctccgcctgtagcgcgctcgggctccacggcgtgcgctggcgctgtcgtgcggctgtggcgggttctcgggtccctagggttgcgggtactgcggcgtgcgtctgctccggcggccagcgggtgcgggtcgagcagcacgggagcacggcgcgaaggtgtcctctccgccggcgggcatctctggggcgttctcgtccgaggtgcgcggcggggtggtggctctggcgggtgctgtcgcacgggtaccgacgccttcgggcgatgccacggccgaccgtcgtgggtgaggcgagatccgacgtcgcgcatgctcgtggcgaccccggtgagcagggtattgttggtgctttgcgactcaacctttggtgaaagtcgtcgatacgtccactatggaagcgttcgaggcatacctagctcggtgcccacgcgcactggtgctcctcgaggaggggctcgtgcgctgggtgaacgaggccgctgcccgattgcttcttcgtgacgcgtccgcgctgatcggtcagccattggacctggtcggaggggttcgcctcgaagagcttggcgatacgagtgtcgaggttgcgctgtgggcaggcgatggatcgctcctcgactgcatcgccgaggtcaccgtgctgggagaggcggtcatggtcgagctggacctggtcgagctgagtggtgtcgacgatgccggtcgagcactgcgggcgctcgccgatacgttgtcgctcggcgtgttcatctccgatcggggcctgcgactcgggtatgtgaatgcggggctcgcgacactgctcgccacgtcacgtgagcgactgagcggagctggctgggtggacatcttcgcaccggaggatcggcctgtcgttcgggagctggcgctgcgcgcactcggtggtgagcgcgtggaggcgatcatcgacgtgcagctcgagtccggtccacggcgtgcattggaggtcacgatcatgccggttcgtgcgagcgatggacgtttgagcttcgtcggcacggtcgctgaccggagtgtgcagcggcgagacgacgagcttgggagccggcccgcgacacgacaaggatgagcgtccatggagattcgcttcgatatcacctccggggatgcggtcgtcctcgctcgcttccttcggaccctcggcgatgacgaggccggcttcgccgagctcgctcaggtggcggctgcagaccccgggctcgctgcgagcatcctcaagctcgcgaactcgtcgtactatggactcgccggctccgtcgagcgactcgagttcgcgtgtgcgatcgtgggcatcctggggcttcgctcgctgaccgtggccgaactcgcgcggcgccaggggccctatcccgaggggcttgcggccttcacgacgttgctggccgcccagatggcggagcgctcgccccacacgagcgtcgacccgcaagtggcgctctcgaccgggctcgtggcgacgctcggttggatcctcgccgcgcagcaagatcccgtcggctatgcgacgtggcacgacctcgcgctcgaggatcgtcgagccttcgaggtggagcgttggggacgaccacttgcgagtctctcccaagaggcgcttcggcactgggcgtttcccgaagtgatcctcgatgccgtcggcgaactcgacgcggccggcgacgtgtcgaccctcgggcgtctccttcgagagagctggcgcgcggcgagcgagcgtctcgggcccgatggggccatgttgatgagcgtgtgagtccaaccaggcacgcggtcgccggaggcggcgtgcctagctcgggagtaccgtcaccagcgtgccgatgtggacctgcggatagagcacccccgcggtcgcgatgggcagctcgacgcagccgaggctctggggaaagccgtacgaggcacgggggaacccgtgcacggcgacggagccgttgaagtagttgatccagtgcacaaggtcgtggtagggggtgccgttcgggttcgtgccgctcatgtagttctcgacgaagcggaggtagatcggccaggtgccgacgggggtgttgagcccagcgatgccggtattgaccggactcgtcagcgtcacctgcccgttcacgtacagccagagcgtctccggtcgaaccttggacacgaggatgtaggagtagggatgcggatccatcgtccccgtcatcgcgtcgtgaatcagggtgggccagaggagcggattggagagcccggtatcgtcgaggccctcggcgtgctcgaacgacatgatcgcaccttgggtcatcaccgtgtcctggccgggctgccacaggctcgtgagcgcactcggcatcgtccagcgccatgagaacgtgccttgtggcgcgtccacgctcgcggcggcctgcgccgccagcgtcgatggggccgcctgggtcggcgtgaaggtcaaggggaggtagccgagctgagcgagcagctcctggaggcgcaggatcgacggggacgctccagcgagggtcacggcgtcggtggtctggccgagcgtaccgctcgagctcgccaacgtgacggcgtgagggaggtgcagtgtgaacgtctcaccgggccagaaatcgggcgtctggggggtgaagacgagggtgtagggggtcggtcgactccaggatcccgagaccgggtcggcgccggcgacagttggcgtgatggtggggttggtcgcgccgaagaccgtcgaggtcggggcggacagcgtgatcgagatcggcgtcgacggcgtgagaccggaggttcccggggagataatcgcgatcggagacgccgacccggtgcggaagaacgtcagctcgctcggtgcggcgagtgactcccacggggctggggcggccgcgatcgtgacgacgccagcgtgcaggccgctcgccgacgacacgacggtcaggcgccgcgatggctttgcgaggtggatgacctgcgaactcgtcggcgtcgtgatgcgcacggtactaacgggcgtcgagaagtagccagcgatcgacccatgggtcgagatcaccacgggatcgaggaggcgcgtcgtcggcgcgatgatcgtctgggtgacgttggtgcgggacccgaggagccaacgcagccagctcggcggtgcgagcgtcgcacgcacggtgatggtggtgccctgcgcgatggcgacacgggggacgatgcggccccggcgatcgacgacggagatggccttgccattcgcctcggccgagatcgccacgatgcgctcggcgatgccttgatgttccaggcgtacgatcccacgctcgctcgcactgagggacgttcgtggcagttcgagatacgcgatgccagcggcggccgcggcaacaacgacgccggccccgaccacgatgcgggtgttgcgccttcggacacgtctcgaacgatgcacgcccctcggtacctcctcgtcccctcgcgcagtcaacggcgcgggtggagtgtcgttgctagtgtaacgacactcggtggcgatttcctgagagacagggcggctgggaggggatgtggtcacgaagttcttcgtcgaggctctggtgacgttgctcgtgatcatcgatcccatcggcaacatcccgaccttcctggtcgtcacccgtggtcgggaccagcgtgcgcgccggcgcctcgccacggaggcggtgctcgtcgcggcggcggtgctcgcggtcttcgcgctcgccggttcccagatcctcgactatctcgggatctcgattcccgctcttgaggtgtcgggaggcctgttgctgctgatcgtggcgctcgagctgctgaccggtcggggtgggtcgatcggtaccacggaggagggtatctcggtggccgtggttccccttgcaaccccgctcatcgcgggtccgggcgccattgctgcggtgttggtgctggccaagcgagctgcgacagcgccactttcggtggcgctcgctggggcgttggtcggttcgatggtcatcttgtgggtcgtcttgcactacgcctcggccttggtccgcatcctgaaggagtcgggcatcgcgctcttgtcgcgggtgttcggcttgctcctggccgccatcgcggtccagctcgccgccgagggaatccgcggcttcgggctctagctggtccacggcggcctcgcgcggagccctcggtctggggggtcgggcaagaggacgtcgaacgagtctcgctggcgctgtggagtcgcctgtgatcgggatcgaggacgtgccccgatcggcccgaccgcgaccttggtgcgcggtgacgtacatccatggcgcagcccatcgaggcgagcgcacgagcgtgggctgggcgcagcgtgccacgttctcacgggaccgcgacgctgatcgcgtcctgcccacccgttcggcgagcacgcttgccgggaggtcgtcgaactctgcgcgcagggcccttatccgggtctcgtcgctcgcgaaggatctgtcggtcggggttcgccgagagctcggcggctcgctccgagcggccagcttgatgatccttgtgcgcgagatccccagacgcgcggcgatgcgagccttggggacgccctcggctaccagccgcctgacgagtgctcagtcttccacggtgatcacccttccctgttcgggtgttcactgttcaccggcgaagtcgttcagtccttgaacggctcgacagtcgcggccgggggccacccgtgtggggccgtgacgatgaccccacggcgtcgtgggagcgaggctctcgcgacgatctgtgcccgagcctggtgtctcggtgcgctggtcgagccgcgcgcctgtgtgctggtgaggtggccgggtgctcgcgcacgacgatgctcgcgcgccgcagcgagccatgaggtcggggcgccagctcctgggccgtcgagagcacgccgcacgcgccccaggcagcagcgtccctggcgtcgctcacgatcgcgcgtgcatgcgcctcgatgcggtcgcgcacgcgtcatctcagcgaggatggcgcgagccgcgatctgcgctcagaaggcctcatgagctccggtcggcgggtgggagcccgtgcggcgcgatctggtcgtgcgacgatgtcgaggctccgtgggaggctgcctcgcaggcgtggcattcgaactcgagcgtcgcgtgggtgatcccgtgcgcacgcgcgagccgttcgcggatcatgtcggcgagcagctgcgtctggtggagactgagacccgagcgtgcaacgatgtgggccgagagcgcattcgtctgttcgtcgaggcgccacaggtggaggtggtgcgccgcgatgacacccggcgtcgcctcgatcgtggctcgaactgcgctcggcgcgacaccacgtggtgcgagatccagcgagagtgcgacggcatcgcggatcatgcgccatgacgtggcggcgatcgtcgcggcgatgatggtggcagccgccgtttgggcgtcgtgaccgaggcgcgtctgtgtgagggacgctgcaaccagtgttgcgactccagccgcgaggtcggcaaggccatggaggccgagcgctcgcgcggttccggatgtgcggtggagccatgcctgcacgatcagcggagccgcgggcgcgagtgagagaacgcctgcgacgacgaggaccgagacggtgctcggcgtcgcggcgcgagcctgaacgacgacgccccacacgctcgcgagcgtgagggcaagggcaagggtcgcgcccacgaacgcgtccacgcgatgccagccgaaggtattgcgctcgtcgggcccgtgctcggcgaatcgtcgcgctgcgaccccgagggcgagcgtgccgaggtccatcgccacgtgcaccgcgtcttcaccgacgagcgcactgtgggctccgatcgcgagcaccacgagcgcgacggccgcgacgacggcgagcatgacgctcccgatggcactcgcgtggcgatgcatggctcttctagtctaggtcgtcgccgtgggcgacctcggggaatgatcggccgcgaccatcccgcggcgcgtgtggccccgccttcaggtgggagtggagtcacggtcgcgaggtggttgctcccgcgcacgagcgcgtgaatctggtccgtacgcagcgggctaggatcgtcgttggtagatgtccgggtgagccgacgaaaccctaggaggatcgcagtgacagcagatgctcagacgctgggcgtgatcaagcttggtgatattgcgcccgactttgaggccgagacgacgaagggcaagattcgcttccacgagtggctcggcgatgcctggggcatcttgttctcgcacccgcgcgactttacgccggtctgcacgacggagctcggtgaggtggctcgcctgcgctcggagttcgagtcgcgtggtgttcgtgtcatcgggctgtcggtcgacgacgtcgagtcccaccacacgtgggaggccgacatcgccgacatcgccggcgcggagatgtggttcccgatgatcgcggatccagaccggacggtgtcgtcgctctatgggatggtgcaccccaacgagctcgactcggcgacggtgcgctcggtgttcatcatcgaccccgccaagcgcgtacgcctcatgatcacctatcccgcctcggtgggtcggaacttcgccgagatcgtgcgggtgatcgatgctctccagcggacgtcgcgctacccagtggtgaccccagccaactggacgccaggccaacgtgtcatcctcgcgacctcggtgccgaccgatcaggcgcgtgcggcggtgggccacgacgccgaggagattcggccgtacctgcgtctcgtcgccgacccaggcaccaactagtcgacgacgctcgagcctctctccgtcgagtcgtgccgcggggccgtcccgcggcacgacggtattcggggcccctgcgaggtcctggaggcgtgggcgctgtcgtggcgctggccgagtcgttcaccagtcggttccagcgcgccgggttgcccaagcccagggctcggcacgtgctagcgtcgagcgcggagaggaggggcagtgcgtatcgcggcccaagtcgactacgccggggacgtgcgccaggcggccgacacggtcgctcgctgggaggatgcgggcgtcgacgtcgccttcgtgccagaggcctacggtcaagatgcgatcagccttctcggttacctggcggctcgtaccgagcacatgttgctcgggcccggcattcttccgatcttctcgcgaacgccagcgctgattgcacagactgcggtcggtctcgacgtggtctcggggggccgtgcggtgctcgggctcggtgcatcgggtccgcaggtcgtggaggggtggcacggggtcgcctacgatcgcccgttggctcgcacgcgagaggtcgtcgagatttgccgtacgatctggcgccgcgagcctctcgttcaccacggcatctacgaacttcccgcgaccgggcccggcacgacggggctcggcaagccgctcaagctcatcacccacccgccgcgcgagcggatcccgatctacctggccgccatcggggcgcgcaacgtcgcgctcgcggcggagatcgccgaaggttggcttcccatcctgttctcaccggagcgtgcggatgcggtgtggggcgagtctctcgaagccgggcgtgcggcgcgcgatgcctcgctcgggccgctcgacatcgtcgccggggggatcgtctcgatcggtccggatcgcgaggcgctccgtgatctcgctcggccgttcgtcgcgctctacgtggggggtatgggcgctcgcgggcgcaacttctaccacgacgtgctcgtacgttacggattcgaggaggctgcggacgcgatccaagagcgctacctggcccacgatcggcacggcgccgaggcggcggtgcccgaggcgttgctccgcgaactcacgctcgtcggtacggaggcagaagttgcggcgagactcgatgcctgggcccgagctggggtgacgacgctgctcgcgacgccggtcggtccggacccgctcgggacgctgaagcgtctcgcagcgctcgcgcggtagcggtgacgagtcgatcggtgctcgagcgctctctgggtgtgctcggcgtcgtggcaggtgcgtgtggtcttgctcgacttggcgatccgttgcccgtggcacgcgagacccctcgcggccatgtggtggtggccatccctgctcacaacgaggcacgacacatcgatgtcgtgctcgcctcgatccgacgacagcgctgcgagcacctcgatgtgcgcctggtcgtggtcgacgacgcgagcgacgacgagacggcggagcgcgcgcggcgcgccggtgcacacgtcatctccgcgggtcccgtcgccgacggcgtcaatccgaaggcagccgccctcgcacacgtcgacctcggtgatgccgactgggtgctgtttgtcgacgcggacgtcgagttcgttgcggacgacggcctggcgcgcttgatcgcgatggtggagaccaacgatggggggctcgtgtcggtccagccgcgcccacgcctcgacggctggtgggcaccactgacggcctggctgtggctggtgccgatggttgcgagtggggccttctggccgggtgcgcgccatcggtcgcgggtggccttcggcccggtgctcgcgatgcggacgtcgacctgtcggagcatcggtggtcacgcggcacttgcgagtgaggcggtcgacgacgtcgcgatggcggcggcggtacgtcgtcgtggcgagcgcgtcgtggtctgggctgggggcgatgccgtgcagatggacccgtacgagggcctcgccgagacggtggctggtctgcgcaagaacatcgtcatcggcgccggtgcggccggtgcgctcccatccttcggtgcggtcgcttgggtggtcggcacgatcggggcactcgctcgactgcgccgcggtgactggagggctctcccgacggcgctcggaggtcttggtgtcgcggtcctcggagcgcgtcggcttcgacttgctcgttggaggcacgtgtgcctggtcaccgcgggcctgggcctcctcgtcgcgacgaccgcgctgtcggtcgtcgacatgctccgggggcagacacggtggcacgggcgacggctacggcttcgctagcgattcgcgtcgctctcgccatcggctggtgggtgggcctcagcgtcgtggtcggctgggtcgcgtcgcgcctccggccccgaggcctcgcgttggtcggcaccttcttggcgactcgttcgttcgagggcgacggccatggctacgaacggctcggggtgcgtcgctggaagcgcctcttgcccgatgccggcggagccttcggaggccgccgcaagcgtctcttcgggccccgtgggaccggtgggcgcgaggcgctcgcgcgcgaggtcgaccgcgccgaggcggtgcactggtgcctgctcgtcgtgcaatgggctccggcgctctggttgggtccgctgtggtggctcggccctgcgtatgcgatcggtgcgaatgtgccgttcatcttggtcctccgctacgtgcgggcacgattgaccgcgctcgggcgcagacggccctgagtcggcgctgcagttccatgcgatcgtgcgagcgaccgtggcttcgcgtcgtcgagcagggctcgcgcgtgccctggccgccgcgtactgcgtccgccggcgagcgagggaggcggctccggcgcgctgatcgtggccgggctcctctgtgcgcgaggagtcgaacgtcctccgaccgactccggcgccggtgcacgtctcgatcaactctcggaggaggcgaaggtgacgactccgggaacgtcgagctcgccgtgtctctctacgacgattgaccgtctctgtgcagacggggctcggcggcttgctcattcctcgccgtctagcgggtagcaacccggagaagtgttggccaaccaccgggtgcgtccggtaggtgagcggtccccacagccagacgccccggtgcgagcccgggatccccacgccaactctcgctggtgccgctgagcgccgatcaggtcatgggtgcgcagtgacaccagtcactgcgacggcgaggacggaatcgagaggagggcctggttggcgggtccagatccttgcttgccggtgtcgcagacggcttggccgttggcggtgcggtgacacgcgccgccagggagcttggtctggatgacggcccggggtgacgggagcagcctcggaggcgtcggtctcggccggaacgtcccatgcgtgcacgagagagtcgaagtccccggccccgaggcgaggcggtgtcactcgcctcgtgcgtcgacctgtccgccttcgcgagggcgcagcatagagctgcggtagtagcgcagctcggcgatcgagtcccgtacgtcgtcgagcgcgcgatgcgcggggttcttctgcggcatgtgctcgatgacctcggggtaccagcggcgcgcgagctccttgaggctggagacgtcgatcgatcggtagtggagcagggcctcgaccttgggcatgtggcgcgcgagaaaccgacgatcggtgccgatggagttgccgcacaggggcacctggtggggatcgggaagatgggccttcaagaaggcgaggacggtcgattcggcctcgtcgatggtgagcgacgctcgccggacgtcttcgaggaggtggttggcagagtgcatctgcacgacgacgggctccatcaccgccagctcctcgtcggttgcgtggaggacgagcgggccgagctcggcaacggtttcgagttcgtcgtcggtcacgatggcggcgatctcgagaatgacgcaccgctcagggtcgagacctgtcatctcgaggtccatccatgcgagcacgcgcccaggctagccaacgaccaggctaccctggcccgtgggtcaaaggaggacgcgtggaggaggtgccgtcgtcacgaccatgggtcgtgatcccgacgtacaacgaagtcgacaacatcgggcccatgctcggagcggtgctcgcggcggtacccgaggcgcacgtgctggtggtcgatgatggctctcccgatggcaccgcggcggcggtgcgcgccgtctcggagcgggacgagcgcgttcgtttgctggcacgggaacagaagacgggactcggcggcgcctatcgagacggcttcaaggtggcgatctcggagggagcgaccagcgtggtcgagatcgacgccgacttttcgcacgatcccgcggcgattcctgcgctcctcgcggcgctcgacgacggtgccgcgctcgcgattgggtcgcgctacgtgcttgggggtcgctcgccaggattgtcgagagagcgtcttgcactgtcgcgcgggggcaatctctacgcggcgttcatgctcggcctaccggtgcgtgacgcaacggcagggtttcgcgcgtatcggacggacgtcattcacgaggtcggctttcgttcctcgcgtgccgatggctacggcttccaggtggaactcacgcgcctcgtcaacgacgcaggctatcggatcgtggagattccgatcacgtttcgtgatcggcgagcgggcacatcgaagatgtcggccaagatcgtggtcgaggccatggtgctgtgcacgatttggggtatcggacgtcggttcccgtggctcaacgagcaacggcaggaggcgctcatcgaccgcctcggcgccgtcgtcgatcggggagcgcgcctgtggtcgacgaggcgttgagtctgcgggtcaagcggctcagtcccggcgcagtgctgccgtcgtatgcacgggcgctcgacgcggggctcgatctcgccagcatcgaagagaggacactggcgccgggggagcggcacgggtttcgaaccggtctcgcgctcgagcttccggtcgggacgctgggactcgtcttgccccggagtgggagggcgcttcgagagggcctcacggtggtgaatgcgccgggcctgatcgacgcaggctatcgaggcgaagtactcgtggcgctggtgaaccttggcgaggctccagtcgtgattcggccgggcgagcgcatcgcgcagctcgtggtgctgccgttcccgagcgtacgggtgctggaggtcactgaacttgcggcgagcgaacgcggatccggaggctttggccacagcggctgagctcacgtgtgaagcaggctgccgacgcagctgttcgatcggccgggggcctcgctcgctatactgaggggcgctgcggacgtggctcagttggtagagcatcaccttgccaaggtgagggtcgcgggttcgagtcccgtcgtccgctctcagacgacctgcagcgatgcgggtcgtcgttcgttgtgggctgggcctgctcgtgagcaggcgtcgtgtgacgcgcggggatgccttacgccggcccgtgatccacggaagccggccgctgtgtcgttcgaccgctgtcgccgtgatgtggactgttctgcggacaccgcacgcactccttgcgccggagggcgtggccgtgacggtcgcgtaccgcgatggagcggccgtggctcggcgctcgctcggcgcgtcgtggcaggccattcaccgcccgaaccagcctggcgagtgtaacgggcgtgttacgttcgtcgggtggccttcggcgacgctgtggatcgtcgctagggtcttctcgggagggtgagggtggatgcatgtagatgatgcgcaggccgcgacggccacggttgatgatgagtatcgggcgtttcgggtcgagtcacgaggtatcgagctcatcccggagacggagcgacccatgcggccggcagacctgttctggatgtgggctggcggcatctggaacgtcgaatacctcgtctacggcgcgctcatcgtttctttcggtctgtcgttcgctcaagcagtgctggcgatcatcgtcggcaatgtgttcttcgcgttccttggtctcgcgtcgttgcaggggccgctcgcgggcacgactgcgttcggtgtgagccgggcgccctttggtcggctcggcaaccggcttccatcgctgttcaattggatcacccaggtcgggttcgagatcgaagggcttgtgctcatcgtgctcgtcgtcgaggcgatgttcgcccacgaaggcgtgtcggtcggcaccggcctcaaggttgcgctgatcgtggcggctgtgctcgtccagttcatcgtgccgttcctcggtcacgcgacgatcgccaagctgctcaggtacctctcgatcgtcttcatcatcgtgtttgcggtgatgggcgtgctgattgcgccgcacgtccatccctcgagcgaccacaagcatgcctcgtgggccatctggacgaccgccgtcgtgctgttggtctcggctggggggctcgggtggaccgagaacgccaacgactactcccgctatctcccctcatccaccccgaaggcctcgatcttctgggcggcgacccttggcggtgcgatcccagcgatcttggtcgagctcctcggtgctgccgcgttcttggtgagtccgcaggcgacggcggtcaccggcgtcccctcgtcgtttgcgagctggttcttctggccgttcatgatcctcgtgcttccgcaggtcttcgcgatcaactcgctggacctctactcgtcgggtgtcacgctgcaggcgcttggcatcccggtgaaccgctggggtgcggtgatcatcgacaccatcatctccgggctggtcacggcgctcgtcatcttcaagggaaacttctataccgatctgtcggggttcctcgactacatcgtcgtctggctcgcgccgtggttcgccatcgtcttcgtcgactatctgctgcggcgcgggcgctacgaccgtgcgggtcttgccgccgtacgcggtggtgtctattggcgcaatggcggcatcaactggcgtgcgatcgctgcgctcatcgtcggcatgggtgcggcgctcctgtggatcgatgcccagttctacgtcccctcgttcctcggaccgatctcgcgtgcgaccggcgggtctgacctcagctgggtgctcgggatcgtggtgggcggtctcgtgtactacgcgcttgcgcgaggtgaggtgcgccgggaggtcgaagcaaccgagcgaggggtggccggcgcagaggcggtggagtaggacgcgacgcggttcggcggggtcggtgctcgggcgatcgagggtcgaggaaggtcgctgacgcatgtcgccggagactcgctaaggtcctgttcgtcgagggaccagacggatcgcaggaggagttgacggtgggactgaccgctcgcgttggacgcttgctcggacgagtcgcgctggcgcccatcttcatcgtcgctggcttcgaggccctgcgagaccctgggcatcgtccggaggtcgccgcgaaggcgggcctcccgagcccggagctgctggtgcgcctcaacggggctgcgatggtcgcaggcggtcttggtctcgcgaccgggctacggcggcgtctcgcagcccttgggctcatcgcatcgctgggagcgacgacggtcgtcggtcatccgttctggcgcgaggagcccgggccaggccggacgatgcagcgagtgcagtttctgaagaacctcggacttctgggcgggctggccctcgtggtgtgcgatcctggtcgcgaccgcgacgcgtgacgtgtcgttgatggggagccacgtgggtgctccgcgacgttcgctggctgccacgatcgcgacgagttgtgacgctgcgttcacaggatgggactcggccggccttggtgtcggctctacgctggcggtgtgaaggagtggtcaggccgagcgcgtcgccagcaggctcgacgtgctggcgcatcacccgttggcggggcggggatggttggcttaccggcgcgtgccgtcgtctcagcggtggcggcggtgagctggatgatcgtcggggtcgtcatcgtggccgccgttcacgcgagctggcatgtcgaagccggactgttcgcgttcggcgtcggcgtcgtctgggcacggggggcgctcagagccgtcaacgcgcgttgagggcggaggtggcgtgaaccacgccgagggatcggtggtcgatcacttccagctggtggcactgctgggggtcggaggtttcgcggaggtgtggcgagcacacgatctcacgaccggtggcgaggtcgtcctgaagttccccactccacagctggttgccgaccccgtcctcttccagcgctaccagcgggagatcgccatctggcggaagctcgaccacccgggggtcgtgcggtgcgtcgacgatggccaacggcggagcgagccgtatctcgtgctcgagttcgtcgacggggtcacgctgcgacggtggctgaacgatcatccagggccggttccggtgaccctcgtcgtggcctgggctcgtcagctcgccgaagccctcgactacctgcacgggcgtggcgtcgtgcatcgcgacctcaagcctgagaacatcttggtgtcgtcgtccggggtgctcaagatcggcgatttcggaactgcggtcagtcgaggggcgcggaggctgacctgggggcagttgtctccggccatggggacacccgactatatgagccctgagcaggtgcggggacggcgcggcgatgagcgcagcgatctctatgcgtggggtgcgatcgtctacgagcttgcgaccggtcgacctccctttcgtggtgattcgtggctggcggtgatgactgcgcacctgcagcaggcgcccgaaccattgcgccaacggcggccggaactgccgccgggcctcgaggccatcgtcctccatgcgctgcggcggttccccgagcaccgttaccagcatgcacgtgaggtgctggaggatctcgaacgcatcgatgagcttggcagcgatacgtactcgttggcgccggagcagccgatcggtgacgtcgtggccgcgaccacgagcgggcgtcggctggtgtggttcgtggtcggggtcgccgtgggctttctcgcgctcgccgcggcggtgctcgtcgtggcggcgcaccactagggcgagccggttgaaggagggagcagggtgacgggacagcgaacgtggatgcgggcgtgtttcgtggatctctttggcgagctgcgctcggtgacggtgtcgggggtggaggtgacgagccacctggtggtcgatgcgtcggccatcgagggcgggatccgcgtcctcgagtctgactgctcactggatctcaccgccgcggctcgcctcgtaggtccggagggggagcgtctcgtcggcatcgtgcgctcaccggacggggtgccgtcgccgttggatacgcgcgccgcactcgcgcgcatcagtgcggagctcgatcccgagacgcgttggcgcgggatcgcggagctcgagtggtactgcttcgacgagcacggcgatccggtggacgaggcgggctacttcgacgatgtggtgggcatcggtggcgcgatcgcgcgagccgcctacgccaggttgtccgacagtggcataccggtgctagcgtcgcaccacgaggctgggcccggtcagtgggagctcgatctcggcccgctcgatgcgtgtgcactcgccgatgccgtggtgctcgcacgagctgcagtgcgtgacgctgccgtggagttcggggccacggcgtcgttcgcggcccgtccgctgccgggacaaccgggttcggggctccacctccatgaggtgctcgcgcccgaggtgaccgagtcgctgatccgcgcccgtgttgggggcctgctggatcatgcccctggcctgtgcgcgctcgccgctccgacggtcgggtcctatcggcgtctccacgccggcccggaggcaccgagcgcggcgctgtgggcgcacgagcatcgcggtgcgctggtgcgggtcgcgacggcggtcgacgggacccgatccatcgagtaccgcggtgcggacccgtcggcgaacccgtgcatcgcgatcgcagggatcatcgtcgcggcggcccatggcgcccaggagggtagcgaccctggcgaggcgatggacgaagatccggagggcttcgatcccctggcccgaacggcagccttcacgccgctcccgaggagtctcgatgaggccgtcgacgcgctcctggccgatgacgtgctcgtggacgcgttcgacgaccggctcattcatcgcatcgtcgatgccgagcgggcgcttgcccgccgcgcactcgcgggaggtcgtgatccagacgtgcgcccgggatcgatgtcgacgcgtgtgatcgatcggtaacgagctggtaacgctacctcgatgggtggcgtgtgggcgggtctacgatgcgcctagctccgctgcgatcggccgaccaggggagcgaggccagacgccgcaacggcgcggcctggcggtcgtccgaagggtgtcaccggaggtggcgtcctgatcgcgtaccgacaggtgaggagttgtgccatggcagcgagcgagcagcagatgcaccgaacgctcacgctcaccggtgtcacggtcaatgggatggccttgatcgcgcccggagcgtttctttggacaacgtttcaggaacaggcggcccagacgaaccacggtcagccgacgggccttgacatgtggacagggctcctcttcgccttcatcctcgccatgctgaccgcgtggagctacagccagctggctcggatctatcccgatgcgggcacgggctcgacctactacttcgccgaagccgccttcctcgaccagaaccacccgcgcttcaccgccaccgcgagagcggtgaagttcgccttcggctggatcagccacctgtactactggatctatccgggcatcatggtggcgttcatcggtaccctgatcggctacatcatcggcgcggtcggaggggtcacgctgtcgtggctcgaactctcggtgatcgccgtcgtcgccgccgcggggatcggctacatcgcctaccgtggcatcacggggtccacgatgacggcgctcgtcatcaacgtgatccagatcgtgaccctcgtcgcgatgacggctctcttcttcatcgcgttccgcgtcgcgcacccggacggtggctacgtgcaagcgagcgcactctcggtcatcctcccacacagcttcgtgaacctgctctaccagtcgaccatcgccatcttgttgctcgtcggcttcgagtccatcacggccctcggcgccgaggcgcgcaatcccgagcgcgacatccagcgtggggtcttgatcgcgctcgccatccagggaggcttctcgtacctgttggagtacttcggtgcgaacttcgcactcggctctgcgaccatggcaggtcaaccgggcgcaaacgtctttgccaaggccggcaacgatgcggcgccgatcggcacgatggtccagaacgctgccgatcgcatgttccatggcggcggagaggcggctgcgttgatcgtggccgccacggtcctcatcgcactcatcggcacgacgctcgcgtgcatcaacaccgcagttcgcgtgagctactcgatggccagggaccgtgagctgcccagcgtgatcgggtggttgcacgggcgcttcgccacaccccacggcggcatcctcgtgatcagcgcgatcagcgccgtggtggcgatctacggggtgcacacggtcgacaacctgacgcagatcacgctggcgtccaacatcgggacctttctggtctatggcatgacgtgtgtgatcgcgatcgtggcgttctcccgtcgcgccgatcgttccctgctcgctcatgtgctcgcccctggccttggggcgctcatgaatctggccgagctcgctggcgtggtctatctcgccatcgctggcggcggctcgggtgcgaccgatgcggtgaaggccatcggtgtggtgctggcctggaccatcgttgggctcgtgtggtactgggcgaacccgcaccgccatcatgccaagagcatcgtcggcgagcgcgccacgaggcgactcggcggggccgggcgcggcgtgtcggccgcggcggagacgccatagcgttcggtgctccggggggagctgccagctggtgatgcctctggcccgcaagggctggaggcatcacccatgaggaggagacgatggtacgacgctcgctcgaggccgacgagacgagtgggtcgcttcgggcccacgacggctcggtggcggcctgggtgagcgtgcggggtgtggtgcgggctgggaacgaggacgcggttgcggtcgtcccccctggcacctctggcgaggtgctggtggcgtgcgtggccgatggtgtcggcgggcaggcggctggcgaggtcgccagccaggcggccatcgaggcggccacgagcgcgatggggagcgggcgaggggcggtgcgggctcgggtgcgagctgcggttcgggctgcgaacgcggcagtcatcgacgcgcaacatcgcgagcgggctcggatggcaaccacgctcaccctggtcggggtgagtggccgcgacgtcgtcattggccacgtcggcgactcgcgtgcctatcgtgtcggcgacgagcggatccatcagctgacgcaggaccatacccaggcggccgagctgttgcgggcgggcttgatcgatcaggaggaggcagctcggcatccagcgcgctcggtgctgacgcgaagcctgggagcacagatggcggtggcgccggatctcgtcagcgtggcgctggaggatggggagcggatcctcgtctgttcggacggcttctgggggacggttccgcgcggcgcgctcttcgaggcgctgcgcggcgcgcgagagcccgacgcgctcgagggtgcgctctggcgactcgtcgggcttgcctacgaggcgggtgcgcccgacaacgtctccgtcatcgtggtgatcccgagtccgacggccacgagttcgggcgcgagcgtgcgcacctcgtggtggcggaggagccgaggaacctaggcaaggccgacgatacgcgccgccgcgtctcgtgcacgctgagcatcgctcgcggtgcggaccgcttctgctgctcggcgagcggtcgtacgctcgacggaagcgagcagacgggtgacgggtgcgatcgcgctcggcgtcatggacaagctcgtgatgccgaggcccgccagccagacggcggcgaggggatctgcggcgagctcgccgcagacaccgatggggatgcgaccgtcgacgtcgtcgacgaggcgagcgaggagtcgagcgagtggcggcgagaagggatcggcgagggctgcgaccgccgactcctcgcggtcggcggcgaagaggtactgcgcgaggtcgttggtgccgatcgagacgaagtcgacgctgcgggcgagctcgtcgccgagcaggcacagagcagggacctccaccatgacgcctgcactcgggatccctgcggcgtgggctcgctcgaccacctcgcgcgcttcgtcgatcgtcgtcaccatcggggccatgagaccgacctcggcaccggtcgcgcgctgggcgtcggcgatcgctgcgatctgggtgtcgatcacggccggcgccacggcgcgtgccctccatcctcggacgccgagcgcggggttggccgagcgaggcagatcgatgaacgcgagtggcttgtcggcaccggcgtcgagcgtgcggacgatgcaacggcggccccggaatggggtgaggatctcggtgtaggcctcggcttgctcggcgcgagagggagcctcgtcgcggtcgaggaacaagaactcggtgcgcaaaaggccgataccgaccgcgccggcgtcgatcgccccctgcgcgtcggcgacgccggcgacgttggccatgatggcgacggcgccgatggcggcacggtctcgagggagcgtcgttcgcgcgggcgtacgctctgcggctcgcagcccagtgacatcgtcgtcgttggggttcacgatcgcgaccgcgcgcacggtatcgacgagcacggtgtcgccgtcgtgcaccccgtcgaggcccaccacgccggtgagggcggggatgccgagtgctcgggcgaggatggcgacgtgggcggtcgggctggcgccagcgagcaagagcgctgccggccgttcgtgctcgatcgcgaggagatctgctgggccgagctcgttcgcgacgacgaccttgccttcgagcatcggtccttgggtgcccctgaggcgggcgatgaggcgccgttcgatcgcgccgaggtccgccgctcgttcggcgatcgcgccgccgacggaacggaggacgcctgcgacctcgtcgaaggcgtcgtggaccccgacggtggagggatcgtcggcgaggtgacgctccacggcatcgacgagcatggggtctcgcgcgatggctgcgtcggcggcgaggatctgggacagctcgccgctcgcacgtcggctggaagcctcgaggtcgtcggcgacctcctcgagcgctcggcgcacgctggcgggatcgacctcggtgcgctcggcgaccgcgtcgacgcggacggctgtcccgacgccggctccctgggagcctggttgaccgcgaagggtgtgacgttccggcatggaccctcctctccgggcgaggcgcctcgggaccaaagacccttgacgtcgtccacgacgcctgtcatgatacgagcgggcagagtgcacgagagcgcccggacgtgagaggtcgcgtccgggcgctcttcgtgttctggcccgggagcgatgcatgacagggggaaggaggccgtaggtggccacaacacaggcgcgaccggccggcaagaccggctggcgcgcaacgacatggggagagctgctctccgaatatctcggtacgttggtgctgctcgccttcgggacgggctcggtcgcggttgcagtggtgggcctcaccatgtccggccgcaccgtcgtcatcttccagggagcgggcggctggctgctgatcacctggggctgggccatggcggtcgtgatgggcgtctacgtggctggcggggtgtccggcgcacacctgaacccggcggtgacgctggccatggcgatcaagggctcgctgccgtggcgtaaggtgccgggctactggatcgcccaggttctcggggcattctctggcgcggcgatcgtctacctggactactacaaggcgatcgatgcgtggaaccttgcgcaccacgtcacgcgcgccagcgccggtgggttgacgaccttctcgatctttgccacgttccccgcgaagtacttcggcacgagcctcgtcgggccattcatcgaccaggtgatcggcacgttcttcctgctgctgttcgtgctcgccatcaccgacgcgacgaactcggggccgggttcgaacatggcaccgttcctcgtcgggatggccgtcgcggcgatcggcatgagctttggtacggacgccggttacgcgatcaaccctgcgcgtgacttcggtccgcggctcctgacgtggttcctcggctggggacacaacgccttcgccggtctcaacggttactggtgggtcccgatcgtcggtccgctcgtcggtggagcgatcgcggttggggtctatcgctggttcatcgaggacacgattcgtgcgcgcttcgcgcgccagagcacggaaggaggggcgcagtgaccacccgtatcctcgctcttgatcaaggaacgacgagctctcgagcgatcgtcttcgatctcgacggcaccatcctcggcctcggccagcacgagttcccgcagtactacccgcagccaggctgggtcgagcacgaccccgaggagatctgggagtcccagcgccaggccatcttcgacgccctgcgcgccgccggcatcgcgccaggggacctcagcgcgatcggcatcaccaaccagcgtgagaccaccatcgtgtgggatcgccaaaccggcaagccggtcatgaacgcgatcgtgtggcagtgccgacggacggcgccgatgtgcgacgaactccgtgcggccggccgcgaggatctggtccgttcccgtaccggtctcgtcatcgacgcttacttctcgggaacgaaggtggcctggatcctcgagcacgtgccggaggctcgtcgcctggcggacgagggccgattggcctttggcaccgttgatgcgtggctgatttggaagctcaccggcggacgggtgcatgcgacggacgccaccaacgcctctcggaccatgctcttcaacatccacaccggtgagtgggatcccgaactgctcgagatgctgggcgtgcccgcgtcgatgtgcccgacggtcgtcgactccgcaggcgtggtcgccgagacggaccctgagatcttcggtgccagggtgcccatcgccggcatcgcgggtgatcagcaggccgctctcttcggccaggcgtgcatcgagccgggcatggcgaagaacacctacgggaccgggtccttcctgctgcagaccacgggccacgatgcggtcgcgtcgcactcgggcctgctcacgaccgtggcgtggagcatcgggggtgagcgcacctacgcgctcgagggctccatcttcgtgaccggagccgtcgtccagtggctgcgcgacggactgcgtctcatcgcgcatgccgaggacaccgaggcgatcgccgccgaggtccccgacaccggtggcgtcgtggtggtccctgccttcgtggggctcggcgcaccggtgtgggacccgtacgcgcggggcaccatcgtcggcatcacgcgcgggacgacgcgggcacacatcgtgcgggccgcgctcgaatcgatggcctaccagacgcgtgacgtcgtcgaggcgatggcggccgactcgggccagcgactcgccatcttgcgggtcgacggcggtgcggtgcgcaacaacgtggtcgcacagctccaggccgacgtgctcgggatcccggtcgagcgtccgaaggtcaccgagaccacggcgctgggtgctgcctacctggcggcggtcggcgtgggtgcggtggcaggtcctggggggctgcgcgacgtgtggcaactggagcggcgcttcgagccaacgtgggacgaggcgacgcgagccgcggcctatcgcacgtggcagcgtgcgcgggaccgcgcccgagcgtgggtcgaggcgtaggctgcgagagggaggtagtcggatgaagaaggtcatcaacgaggtcgaccacgtcgtcgacgagtctctcgatgggctcgcggccgcgttcgcaccgtgggttcgccgcatcgagggtacccacgtgctggcgcgcgcggtcgcgaagccatcggggcgcgtcgggctggtctcgggcggcggatcgggccatgagccggcccacggcggctacgtcggtgagggcatgctcgacgccgcggtggccggcgaggtcttcacctcgccgacgcccgatcagatcctcgagggcatccgcgccgccgaccacggcgcgggggtgctgtgcgtcgtgaagaactacaccggcgacgtcatgaacttcgacatcgccgccgagctcgccaaggaggaggggatcgaggtgcgccaggtcgtcgtgaacgacgacgtcgcggtcgaagactccctgtacacctcggggcgacgaggcatcgccggaacggtgttcgtccacaagatcgcaggcgcagcagccgaacgtggggacgatctggcgacggtggcggcggtcgccgagcgcgtgatcgcgaacgtgcgctccatgggcctcgcactcgcaccgtgcacggtgcccgcacgtggagagcccaccttcaccttgggcgaggacgagatcgaggtgggcatcggcatccacggcgagcctggggttcggcgcgaaccactgcgtcgtgccgacgacctgaccgacgaactgctcgatcgggtgacgagcgacctcgggctcgagagcggtgcatccatcgcggtgatggtgaactcgatgggagcgacgccgctcctcgagcttgggatcgttgctcgccgcgtctaccaggtcgcggccgagcgcgggtggcacattcgcaccgcctgggttggcgagtacatgacgtcgctcgagatggccggctactcgatcacggtgcttcgactcgacgacgagctcgccgcgctgctcgaagcccctgcgtcgacggctgccgttcgggtggcacggtgagcgagcccggttcgctcgcctggtggcacgacgtctggcgctgtttcgcggcgtcggtgcgcgaccagcgcacctggctggacgatctcgacgctgcgatcggcgatggtgaccacggtacgaacctgaaccgaggtctcgagcgcgccctcggggccctcgagacctcgcagacgccgcgagcggggctgaggagtgttgggatggcactgctcggcacggtcggcggggcatcaggcgcgctgtggggctttggctggaccaaggcctcggcggcagccggcgacgggaccggcgccccaacgcccgacgaggtcgtggccacgctgtcgctattccgggacgcggtgctcgagcgtggccacgccgagctcggcgacaagaccatggtggatgtcctcgtgccggcgctggcgtcgctcgctgccgagctcgggactcagcgctccttcgccgaggcagccgctaccgccgcgtccgtggcctcggagcgtgccgagtcgaccatccccctcgtggcgcgcaagggccgcgcgtcgtatctcggggagcggagcgcaggtcacgaagaccccggtgcggcctcgatggctctgttcttcgcatgccttggcgaggtgagctgaggtggtgggcgtgctggtggtgtcgcactcgcggcgattggcgcagggggcgtgcgagctcgtcggcgccatggccaagggggttcggctcgagtggcgaggaggtgagccccccgagcttggcgtgagtgtcgagctggtggcagatgcgctcgagggcctgctcgaagggggcggtgaggtggtcgtggtcgccgacctcgggtcctcggtcctggcggcagaagcggcggtcgagctgatcggggcaggcccacgcgtccgcgtcctgcgcggcgtcccgatgctcgagggcttcatcgcagccgcgatggcgctcacggtgggcggaggcctcgccgaggccgtcgccgcggccgaggcggcctgtggtgcgctcgagggcgggcgatgacgcgccgccgggtcgtcgtgatcggggccggggccaccgggctcggcgtcggcgtggatttggccacccgtggcatcgaggccgtcgtcgtcgagcgtcacgcggtgggggcagggacgtcggggcggttccacggtcttgcacactccggcggtcgctacgccgtcaccgacccgctggccgctgccgagtgcgcccgcgagctcgcggtgctgcgccagatcgcccccggtgccctcgaggccaccgggggatggttcgtacgcacgagcgacgatgacgccttcgagcaggcgtggctgcgtgggacggcgtccgccgggatcgaggtccgcgaggtcccgctcgacgtcgccagggcgcaggtgccggcggcggcggcgcgagctcggcgggtgttctgggtacccgacggtgtgctcgaggggttcgagctcctgcgcggcctcgtgcgaacgctgcgacgtttcggtggcgacgtgctcgaggggtcggaggtgatcggcctcgtgcgcgacggtgccagggcggccggtgtggtcgtgcgccaaggcgatcgagaggtcgtcgtcggtgccgacgccgtggtgaacgcggcgggtccactctcgggtgtcgtcgggcgtcggctgggcgccgaggtgccggtcgcgccgtcgttcggcacgatgttgatctttgccgatcgccgactcccgctcgtggtgaaccatctcgagcgcccatccgacggcgacatcttcgtaccccatggcgagactgtcatcctcggtaccaccgacgtcccccacgaagacggcgaggcgctaccgccgagccggcaggaggtggctcggctcgtggagctcggtgcgcgcttcgtgccggaggtgcgcacctggcgaccgatgcgggccttcaccggcgtgcgccccctggtcgccgatccgggtgcgggcgggccgcgaggtctgtcgcgcagtcacaccatcgtcgaccacggcgcgagagacggtatcgccggcctgttcgcgatcatcggtggcaagtggacgacgtatcggctcatgggggagcagaccggcgacgccgtcgcctcctacctcgaggtcacggcaccgtcggcgacgcggtcgctcgtggtggtgccggcgcgagttcggggacgcgcgccgacgtcgtcggagacgttgtgcacctgtgagggcgtcggtcgtgacgagctcgtcggcgagggttcgctggatcgttggcgcgtcgagcattgggcgacgatggggccgtgtcaggggacgttctgcgcccatcggttggcggctcgcgcagctgaactcacgggcggcgccctcgagagcgaggcgctcgatgcgctgcgtgccgagcgcgcgcggggggtcgatgcggtggcctatggcgcacaggcacgccttcgggccctcgcgtccgagcagcgtcgctggtgggggtggggctcgtgagcgtcgtggtcgtcggggcagggccgagcgggctcctcgcggcgtcgctgctgctggacgagggtgcgtcgccgatcgtcgtcgcggccggcgagggttctcttggcttgtggccgggttggctcgcggccccacgggacgatggcgccgtcgagcgggccgtcgcgagcttgaatcgggccgacgcacgactgtcgagcgtcgacgagcgcgaccgactcatcggcccgctcggggtcgcgcatcggttcgcctgggctccgccggaactcgcgagagtgggacccgaggacgtcgtcggcttctgcggcttcgccgagatgaccgagacgcgggctgccgtcgcggtggcgacctggcagagccagaccggatcggcagccgtcggcttcgacctcgcgccgtggggccggcgggtgccgttcgaactcgctcgcttcctcgggcacctggagggggcgcgagcgctcgggcgcgccctcgcgccccgggtcgacggcgccgtgagcgtcgtcgcggtaccgggactgctcggtatcgaggatgcgacccgggcgctggcggtgctcgaggagatgctcgagcgccgggtcggcgaggtaccgctcgtcacgcctgccctggctggttggcggctcgatcgtcgggtgcgcaccgcacttgcggctcggggcgcgacctttcggcgcgccagggtcgtcgaggtcggtcggggaggcgtacggctcgcggacggtgcgcacgtcgacgccgacgcggtcgtgctcgccactgggggcgttgcgggtggcggcatcgcaatcggtccggatggctcgctcacagatagcgcgcgcggcgtcgcgatcggcgaccctgcggcatggatgatgggagaagacgtggggctgctcggttatcgcgaggtcgtcgtcgacgaggaggctcgggtcgtcgcggtgggcgcgctccgtgcgcacgaaggctccgggttcgcccaggttgcccagagcgtcacggaggcggtcgaggtgcttcggtcatggtgagcacggcaacggcgctcagactcgacaacgccgatgcttgcatcaagtgcggtctgtgtcagctcgtctgtcccgtgctcgaggtggacccggcctttagcgggccgaaggtgctcgggccggactggcatcggcgcttcgtagctggcgagcgggtgacggacgacacggccgcgcgctgtacgttctgccagctgtgcgagtcggtgtgtccggtgggtgtccccatcgcgcacctcatcgcggagcacaagtcgcacctcgaccacgacccgcgctcgaggatgcgagatgcggtcgtggtccggcccgatgtgctcgcgcgctttccgtggctgacccgggtgccgaggcagctcgcgccggtcgccggcctgtcgtcgacgacacggtggccgcgtccgcaccgaccccgggccgcgtcgagtgacggcgggacctctcgcgtcggcacggtcggagtcttcgtcgactgcttcagtcgggccttcgacggtgccacgatcgatgcactcgtcgtgctcctcgggcgtgcggggatcactgcacgtctggtgccggcggacacctcggtgtgctgtggcgccgcagcgtgggcgagcggtgctccgcacgtggccgaggggcgcgcgcgcgaggcagcgcgtgccatcgaggccgacgccggcgatctcgatgtggtcctgagcgtgaacgcaacctgcgaggcgacgatgcatggcgagtggcacgacgtcttcggcatccagacgtcggtgccgagcgtgagcgcggtcgattggctcctcgacactggtgtcctcgctgggctcgtggagcggcggcgaaggggcgatcggccgaagcggctcgctctccacacgacctgtcgcgcgacggtggccggagaaggcggcgccgacgtcgccgcgctcgaagcggttggctacgaggtcgtccagaccgagctcagctgctgtggcgcggccgggagctatgcgttcaaggccgagcatgccgagcgtgcgcggcgtatcgggtcgcgggtcggaccgccggccgagatcgtcggggtcgcggtcgactctgcgacctgcgcgttgcacctgggggacctctggggcgtgcgcgcgacacacccactcgtgtggatcgaggaggcgatgcggccgtgacggagaccccacgtgcgattctcgccatccgcgatcctgagctcgcccaggctacgaccgctgggctcgcgcctgggtgggtgatgctgctcggagggccggccgcgagcgtgatcgatgcctccatgaccctctcgctcgagggctgggtcgtgttcgtccacatcgacatggtgcgcggtctcgggcgcgacgccgacggcctcggggtgctctcgcgcttcggcgcaccccagggcgtgatctcgacgcatccgagcgtggtgcaggcggcacgggatctcgggttcgccacctccctgcggatcttcctggtggactcgggctcgttacgctcggggatccaacaggcacagcgcaccaagccggacttcgtcgagatcctcccgggtgtgctgccgcacctcatcgcgccggtggctcgagcgacggggctcccggtgatccctggtgggctgatcacgactccagcggatgcgtgggcggccatcgaaggcggtgcgctcgcgatctcgacgtcgtcgctcgaggtctatcgggcggtagtggaggcgccggctcccctggcgcacgagaaccacgtgcagcgctcgaggggtcaccgatgagtgacgtcgttcggcgccagctcatcgtcatcgaccccctgggactccatgcacgcgctgccgcggcggtggtcgcggcgctggggccgatcgcgggcgtcgtcatccgagcaggtgagcgtgccgtgcccgccacgagcgtgctggcgctcatgggactcggcatcgaggctggcgacgtgatcgtcatcgagggtcccgtcgaggcagagggagcgatcgcagaggcgctggcgacgatctctgcggtggcccagcccgtcgtcgagggcccgagtgacgacgagggacaccaggggcagtcgtcgtcatcatgaaggccgtgtaacgattcccgcctcgtgcatggattcccttgcgccgaccggacgcgacgagtaaagtagcgccacacgggccgtttcgacgcggaaagcgtgtcggaacggggagcctggatcaggaggggtggccagggtgcaacggtctcgagggcgcgcagctacggtgcgctaccgatgaccaccctgacccgtcgcctcgaggccgagcctggcccacgagccgttcgccgagacggtgcgctggcgcgcttcctcgccaatcgactcgccgtcggcgcgctggtggtgctcgtggcgatcgtcgcgttctgcttcgtcggcccgatcgtgcacccggtgtcggacgcagccaacctgctgcacgccaaccaacctccctccggccagtacctgctcggcacgacaccgaacggccgtgacgtcctcggacgtctcatggtgggaggccagtcgacactcgagctcggggtggccgtcggcgtgctcgcgacgggcttcggtctgctctacggcaccgtcgctggtctcgtgggcggtgtcacggacgcgatcttgatgcgcatcgtcgatgccctgctctcgatcccgttcctcttcttcgtcatcttgctcgcctcgatcgtgcgcccgacgctcggactcatcatcctcgtgatcgccggcgtgagctggctctcgacggcgaggctcgtccgagccgagaccctcaggctccgaaccctcgactacgtcgacgctgcccgtggtttcggagctcccccctggtggatcctcgtgcgccacctcgtgcccaacgtgctcggtgtgctcgtcgtgaacgggaccttgaaggtcgccgatgcgatcctcacctttgcggcgctcggctacctcggcctcggcgtgcccccgcccgcgacgaactggggcgcgttgctctcggcgggcgtgaacaacttcttcgacggctactggtggcagctgtggccagcggccgtgctcatcgtcgtcaccgtgctcgcggtgaacgtgctcggcgacgccctgcgcgacgtcgtggagcggaggctctcgtaagtgggtggaaggagcaaatggtggagggatcgatgatgaggcagctgcgtcggacgaggtggcatcggagcgcggcgtggaccggttcgctggtggcgctaggcatactggcggccgcatgcgggagctcgtcgggggcgtcgacgtcgtcgtcggcggcgaccggactgccggcgaactacgcctcgtttgcgctgcactcgggcgacacgttctcgtgggttctcccactgccgaaccaggccaactacgagccatgggaccagaacgcggagtacgggatgtaccgaccgctctacgtcgctggcaacgggtcctccccgaccatcgacgaggcgacctcgatggccaacccgccgacctacaacgccaccgacacgcaggtcacggtgacgttgaagccgtggaagtggtcggacgggaccccggtgaccgcccgggacgtccagttcttcttcaacatctatcgggccaacaaggcgaacatcgcgacgtacgtgccggggaacttccccgacaacgtcgcctccttcaccgtcgactcgccaacgagcttcacgctcacgctcacgcatccggtcaacccgacgtggttcaccgacaacgagctcaccgacgtggtgccgctgccccagcaggtctgggaccgtacctctcccggtggcaaggtcggcaactacgacgagaccacggcgggtgccgtggcggtcttcaagttcctcacgaagcagtcgaacgatctgtcgacctacgcgacgaaccctctgtggcaggtggtcgatggcccctggaagctccagagctacgacccgaccaccggtcgcacggtcttcgcacgcaacgatgccttcaccgggccggacaagcccaagctcgctgggtatgcactcgagagcttcccgagccagaccgccgaggtgaatgcgctgcgctccggtcagctcacctacggctacttgccgatctccgactacaagctggagtcgagcctgtcgaagagcgggtacaccatcgcaccgtgggtcaccgactacgtccagtgggccgaactcggctacaccagcccgaagtacgggccactcgtcaagcagctctacatccgccaggcgctccagcacctggtcgacgagccgctgtacatgagtcaggccctgcacggctacgggcagttcacctatggaccggtcccgaacatccccggctcaccgtacgtgacggcgacggagcagaccgaccccgacccctacagcaccgcagccgcgaagagcctcctcctcgcccacggctggacgctcgggtcccaaggggtgatggtgtgttcgaaccccgggaccgcggcgaaccaatgcggtgcggggatctcgaagggcgaggccctcaacctcctcttcatgtaccagagcggcaccccgacgctcgcggcccaggtggaggcgttcgcgaccgctgcgaagcaggcgggcgtcggcatctccctcgatccccagacccagagcaccatgttctcgatcggcggcgtgtgcccctcggccggcccgtgcaactggggcatcatcttgtaccggaccttcctgtggaactacggccaaggcgatgtgctcccgacggggggtcagatgttcggcaagggcaactactggggaggcggctacagcgatccgacggcccagtccctgatcgacgagacccacacccaaccagggctgagcgccttgttcgcctacgagaactacatctcgcgccaggtcgcagccctgtggttcccgacgtgggactggcagatctcggtggtctcgaacaagctgcacggctggaacccacagcagatcttcgggaatccgacgccgtcgaggtggtacttctaggcgatgcttgggttcgttgcccgacggcttggccaggcgatcgtcaccatggtggcggtgtcgatcgtcgtgttcgggctgctccatgccttgccaggggggctcgtgcgcgcccagttgggcgcgcacgtctcccaagtcgcgatccgtgcgctcaccgtgcaagaaggcctgaccaagccgctgccggtccagtacctcttgtggctgaagggtgtcctcgaagggcagttgggccagtcgttcaaactgggtgaaccggtgtcgacgttgatcgcgctctatgtcccgaggacgatcctgctcgtcggggtgtcgttgttgctcgcggtcgcgatcgcgatcccgctcggtctgtggcagggctaccgccgtaatcacccggacgaccacgccctcagcgccatcatgctcacgctctactccatgccgacgttcctgctcggggtcgtgctcatcatcgtgctcaactcctggctcggcctgttgccgtcgctggcatcgaacttcggcgcgagcatcggcaccgatgtgcgcgacctgggactgccggtgctgacgctcacgctggcgaacgtgagctacttctcccgctacatgcgctcgtcggtgatcgacaacctgctcgaagattacgtgcggacggcacgctcgaagggtgcctcggagcgtcgagtcctcctgcgccacgtcctgcgtaactcgctgacggcgaccgtgaccatgatcgggctcacgctgccctatacggtgtcgggatcgctcatcgtggaagcgctcttcaacttccccggggctggactcttgttctggaacgcggcccagacgcgcgacttcatggtgctgctcggcatcgtgctcgtgatctcgatcgcgaccatccttggcaatctcctcgctgacctcgcctatggcctgctcgatccgagagtgcgctaccgatgaccaccctgacccgtcgccccgaggcccaggtcggcccgcgagccgttcgccgagacggtgcgctggcgcggttcctcgccaatcgactcgccgtcggtgcactggtggtgctggtggcgatcgtcgcgttctgcttcgtcggtccgatcgtgcacccggtgtcggacgcggccaacctgctgcacgccaaccaggcaccctccggccagtatctgctcggcacgacaccgaacggccgtgacgtcctcggacgtctcatggtgggaggccagtcgacgctcgagctcggggtggccgttggcgtgctcgcgacaggcttcggcctgctctatggcaccgtcgccggtctggtgggtggtgtcacggacgcgatcttgatgcgcatcgtcgatgcgctgctctcgatcccgttcctcttcttcgtcatcttgctcgcctcgatcgtgcgcccgacgctcggactcatcatcctcgtgatcgccggcgtgagctggctctcgacggcgaggctcgtccgagccgagaccctcaggctccgaaccctcgactacgtcgacgctgcccgtggtttcggagctcccccctggtggatcctcgtgcgccacctcgtgcccaacgtgctcggtgtgctcgtcgtgaacgggaccttgaaggtcgccgatgcgatcctcacctttgcggcgctcggctacctcggcctcggcgtgcccccgcccgcgacgaactggggcgcgttgctctcggcgggcgtgaacaacttcttcgacggctactggtggcagctgtggccagcggccgtgctcatcgtcgtcaccgtgctcgcggtgaacgtgctcggcgacgccctgcgcgacgtcgtggagcggaggctctcgtgaccgttcgatcgagcggtggggggacctcggtgcgcaggacgtgggagcgccccgagctcctgcgcgttgccgaaggcgcactcgcgcacgcatcgacgatgccgctctggctcgacgatccggctcgaccggcggcgaccccaccactcgaagggcaggtcacggccgatctcgtgatcgtcggtggtgggctgctcggtctgtggagcgcgctcctggcggccgagcggcgaccagagtgggagatcgtcctcgtcgagggcggtcgcatcgccgctgcggcgtcggggcgcaacgggggcttctgcgaagcgagcctgacccatggactcgccaacggacttgccaggtggcccgatgaactctccgagctcgagcgcctcggcgaggagaaccttgcggccattcgggcggccgccgagcggtatgccgcgaactgcgacctcgtcgattcggggacgatcgacgtcgcgctcgaggactggcagctcgacgagctcgccgagctcgccgaggtggcgccacgctacggccacgacgtcgtcctcctcgagcgcgaggcgctctcggccgaggtacgctcgccgagctatcgcggaggcctgtggacgcgcaaccgcgcactcatgctcaatcctgcacgtcttgcgtggggtctcgaggcggcagtggcggggatgggcgtgcgcatctgcgaggggacgcgcgtcgttgggctgagttccgagggcccgttcgtcgtggtcgagaccggttcgggtgcgagcgtgcgcgcgagtcgggtgatcctcgcgaccaacgcggcggctcccctcgtggcgtcggcgaggtggcggttcgtcccggtgtacgactacgtcgtggcgacgcgaccgctcgcggcgagcgagcgtgccgagatcggttgggagcgacgtcaagggatctcggatgcgggcaatcagttccactactaccacctgagcgaggacggtcggatcgtcttcggaggctacgacgcggtctaccactacggttcggtggcccgccctcgctacgagggacgctcaccgacccacgtacgcctcgtcgcgcacctgtacgcgacgtttccggggctcgagggtgtcgagatcagccacgcctggggtggggcgatcgacacgtcgactcggttcgtcgcgtccgtgcatcgggcctttggcgggcgcgtgcactatgcggtggggttcacgggtcttggtgtcggggcgacgcggctgtacgcatcggtactcgtgggtcgtgcgatcggggagccccacccagcggagcggctccgactcttccgtgagggccccgtaccgtttccgccggagccgctccgctggatcgggatcgagttgacacggcgctcgctcgcctgggcggacgaccacggcggtcggcgcaacgtctggctccgtgcgttggaccgcttcggcgtcgggttcgattcctaggaaggggacctcgtgcaagagctcgtgcaagaggatgtgatcgtgcgggtcgaggggctcacgaccgatctcgtgcgtcacggtggctcggttcgggtgatcgatggcgtgagctatgaggtcgccaggggtgagacgctcgggatcgtgggggagtcgggttcgggcaagaccatctcggcactcagcctgctcggactcttgcctccccagatgcgcgtcgtcgctggctcggcacggctcgagggcgaggaactcatcggtgcgagcccgcggcgcctgcgcgagctccgcggtgcggccatcggcatgatcttccaggacccgctgagctcgctgaacccgtcgaagaccatcgggtggcaggtggccgaaccgttgcgcatccaccagcgtctcggagccgccgcagcgcgccagcgcgcgctcgagctgctcgagctcgtgggcatcccgagcccgaaggagcgcttgaacgactacccgcaccaactctccggcgggatgcgccagcggatcatgatcgccatcgcgctcgcgtgtggaccgaagctcatcgtcgccgacgagcccacgaccgccttggacgtgaccattcaggcccagatcctcggcctcctcggcgaactgcaggaccggctgggtacagccatgttgctcgtcacccacgatctcggggtcatcgcgggtcgtaccgaccgggtgctcgtgatgtacgccggtcgggtcgtcgaggctgcgccgacgcgcaccctgttctcggccatgcgccatccctacacccaggccctcctcgcgtcgatccccgtgatcgggatcgatcggagcgtcccgctgccggcgatcccgggcacaccgccgccgctcggcggagcgggggtgggctgtgcgttcgcgcccaggtgtccgcgtgccgacgagcgctgccgccaagagatgccaccactcgcggtgagcgctggccacgcagtggcctgctggcaccccgtcgacggacccgttcgacggaccaggctcgaggtcgctacctcgcttgcggcggtgccacgtgctatggagccgttggtcgagctggtcgggcttcgcaaggagttcgagatccactccaacgtgacgcggcgccatctggggacggtgcacgcggtggcgggggtcgatctcgtcatcggacgtggtgaaaccgttggcctcgtcggtgaatcgggctgcggcaagacgaccctcggacgtatggtcgtcgggctcgagcgcccgacgggtggtgagctgcgcatcggtggcgtcgacgtggttcgcctccgcggcagcgagcggcgatcgtttcatcggcggatccagctgatgttccaagatccgttcgcatcgctcgatccgcggatgcgcatcgcgagcgcgctcgccgaacctttgcgcgttcaggggctcgatcgtggcgaggagcggctggcgggactgctcgagcgcgtcggcttggcgcgcgaggcgctgtggcgctacccccatgagttctccggcggccagcgccagcgcatcggtctcgcgcgggcgctgacgctcgaccccgagctgatcgtggccgatgagccggtgtcggcgctcgacgtctccattcgctcccagatcctcaatctcatgcgcgagacccagcgcgagcgcggtctcagctatctcgtgatcagccatgatctgtcggtggtgagctacctcgccgatcgcatcggcgtgatgtacctgggccgtctcgtcgaggtcgggccgacggccgcggtgatcgcctcgccagcgcatccctacacgcgcggactgctccgttcggtgccgcttccggatccagaacgtgagtcggcaaagcgtcgtctcggagcggtgatcgaaggcgagctcccgtcggcgttgcgcccaccgacgggctgtgcgtttcaccagcgctgcccatttcgggtggcccgttgcgaggtcgaggcgcccgaggctcgcacgctcgacgatggcagggtggtcgcctgtcatcgcgtcgacgacgtcctcgccgagccgtggtcgctcgaggacgtcggacagatggcgagcgcgctgcgagcgtaggcgtttcgacgtgcgccgcggccaacgagggccacaagagtacgccgacgccggccaggcggtctcgtggctgtgcggaggcggcgtcggagcggttcctcgtagcggcgccagacgatgagcgcgatcgcgagtgccgcggtgaggacgaggaggtcttgccaccacggtccgccgtagtgatacagcgacacggtggcgaggctgcgcatgaccagtcgatggaccatgtagaaggcgaagctcgccgagccgagcgcgaccgctgccgaatgggcgatgaggcgtgagatgcaacctgcctggtgtgcaaagacccacacgacggctccccagacgggaagatagagcgcgctgaagcggagcgactgcggagcgaagggtcccgcgacgacgacgcccacggcccctgcgagggcagcgccctcgaggagtgaccatcgccagcgcgacccgccgctctcggggtgttcggcgaaggcaatggccgcaacaacgccggccagaaagtccgagagtcgggtgatcggaaacacgtagatgacccagctctgccaaccggtgtgaagcggaaccagcacgccgacgagggcgagccaggccgtcgccgcgccgaagaggagccagcttgtcgtgagtcgtggccgagcccactcgacgaggcgggcgacgacggggaagatgaggtagaaggttgcttcgtcgctcaagctccatgcgacgccgtcgaacgagaacgccgcggcgagcgatgggatgaagctctggacgaggaggaggttggcgagtgcgagcccgagccaggagccgatgccaccgtacatcgagggtggcgtcaagaacagcgaccaagcgaaggcgaggacgtagaccggatagatgcgtgcgagccgagagcggtagaagccaagcaccgggtttcgccgaagacgcgtgaagcggccctggtacgcgtaggtcaggatgaagcccgagagcacgaagaagaacgagacaccgacgtagccggtctggtaggtgcgcagccaacctacgtgccaacagaagacggcgagtgctgcgacgaaccggagactggtgagtgggcgtagctgtaccaacagacctcctttggccctcgtgcgccacgtagtggctcaagaccgcgagtggtcgcgtgtcatgacgttcgatgacgtgggtcgggcggttccgaacagcgtagagggctcggtcgttcaggtctgggttgggtcgtagtagctactcggagacgtctgagcgctgacgtacgacggttccggaactactgctcgcctcccgcgtgggcgtcgcgcgaggcaatcgagtcagcgaccgagggcgagatggtggagcgcgatggctgcggcggtcgcgaggttcacggagtcgaccccgttcgcgatcggaatggtgacgagtacgtcggcgtaggcgagagcgctcggtgagagcccgtgtccttcggatccgacgaggagcgcaacgcgcggtcgcggcaggtcgtgctcgccgggcgcgcgtgcgtggcgtggttcgccgatcgcttcggcgagctcgtcgaccgtgacgacaggagtgaggtcgcaggttcgctcggtacgcaggcgttgtgtcgacgccggtggcaccaaggcggcgatgcgaacctgcgaccgtgcaaggagtgccagtgcgctcggccatggtgtcgcgcgcacgagggggagcgtcaagaggtggcccgctgacacccgcaccgatcggcggttgcgtgggtcggccgaggtgggatcgagcaccagggcgcacgctccgaacgcggcggcgttgcgcccgagcgccccgaggttctcctggtcgaccacaccctctgcgacgagcgccgtctcacccggtgcccacagatcgaggaagtcctcgagtgcctgcacgggcgggcgctcggcgtgggcgacgacgccgcggtggagtgcgaagcccaccgtctcggcgatcacccttcgggatgcgacgaggatcgggacccgtcgggcgacggcacgatcgaccacctcggtggcgagtgcaacctggtggtcatcgaggaggacggagtggacggtgagcccggtcccgagcagcgtggtgacggccacgcgaccctcgacgatcacgtcgcgagctcctcggcgttggcgaagcccgttgccgcccttgaggtcgcgatacggctcgagccggtcgtcgtcggggtcgtcgatgcgtacggcgccgatcggcagaggagcagaggcggcgtcgtcgtggttggcgatcatggctcgacgtcgaggagggtgtcgtcggcaccaccggagacgagggtcgaggcgaggatcgtcggagccgagttcctcgagctgagcgcacagagccacccgtcgagttcggtggaggtgcgcaccgcgagcggttgccaacctcgtgcgagcttcgtggcgcgcctcgcgagcaggcgtgcggtcgatcgtgtcgagcgctcgaggaggagggcagcgatctggaggtcgtgggcgcggccgaggtgggtggtgagtgcgagtgctcgccgacggagcctcacgctcgtggcgggggcgatgggtgcaaggagttcggatgcgaggcggaggcggcgtgcgcttcgacgtagcgcatggagctcgtccatcccaggccgttgggcagcacgacgcgctcggcgctgccaggaacgcacgagggcttcgagatcgaccacgcgccgagtgtcgggtgtcgatgtcgggcccgggaggcagacacgggcggcgcgtgcgagttcggggaggcgctcggcgcgcttggtgcgctcggcggcgaggtcgggacgagctggcaggatcgtcgcggcgacgtcgagatcgcgcacgctcgcgagctggttcgcgaggcgagtgagtggagaggcgccgtggcgccccacgctgggggcgggcgcggtgccgatgagcgcttcggcgaccgccgcgcgtcggagtgcggctcgcgcatcgtggacgaggtcgggggtggtgcgccgctccagcgcgatgagcagctcttcgagcgccgcgcgtgtctcggcaagatgcgccgccaccgacggccagacctcgggatcgatgacgacacgggtgcgcatggtcgggcgtcgtcgaacgagtcgtgcgttggtcacgtcgggtcagtgggcgtgcaggatcgttgggtcggcgtcgatcgcggtgacgacgccgagcagatcggcggcgcggaccgccacgggtgtggtgccgtcgtcgtgctccgcgatgccggaggcggcgagggcaaagggaatctcgagtgccctggcgaaggctccgtccgtggtgaggcggtcacccaccatgatcgtcgatgtggcaccgaggtggggtcgcacaagctcgaccatgggccagtcgggcttgccgcagtaggtcggttccaccgaggtcgaagcgacgaggctcgcgacgagcgcgccggttcccgggacgacgagtcgttcgagcgggtaggtcgggtctcggttggtcgcgaggaatcgggcccccgcgcggatcgcgacacaggcctgcgcgagaagatcccatgtgaagcctcggtgccagcccatgacgaccgcgtcgaccttctcggcgtcctcgagggacgtgggcctcacgagcgtgttgccctcggcgacgacgctcgtcagtccttcctcgccgatcgccagcacgcgctggtcactgccgagcgcgagacgtgcggcaagggcggaggtgaggatctcgttggcgtcggcgtcgatcccgagtgagcggagcttcgcgacgtaagcttcgacggtgagagtggagttgttggtgacgaagcgcagatcgtcgccacgatcacgaatgcgcctgatcgctcggtcggagccttcgatgagggtgctcgagcgccacacgacgccgtccaggtcgatgagccagcgcatggtcctccagtcgccaatcgactgccgaagcgtcgcgggtcgctcggcgttggttgggacttggaggctagcatgacctcgtcgacacgagggaggtgctgagcgtggactacgagtcactgctgggcgaggaggcgaagcagctcctcacctacgtcgcgacggggatacccgcatcgagcctgatccaccccggccctcgcgtggtcgacgaggtgttcgcttccagcgaccgtaccaatcgcgtgttggtcgagctcgccaggctctatgggactgggcgccttgcggggactggctacgtctcgatcctccctgtcgaccagggggtcgagcactcggcggcggcgtcgtttgcgccgaatcccacctacttcgatccgcagcgtatcgtcgagctcgcgatcgagggggggtgctctgccgttacgacgacgctgggtgcgctcgggatcgtgtcgcggcgctacgcccaccgcattccgttcatcctcaagctgaaccacaacgagttgctcacctatccgagccgttacgaccaggtcatgttcgccaacgtgcgccaggcctgggacatgggtgcggctggggtcggcgccacggtctacttcggctcacccgagtcgacgcgtcagatccaggaggtatcggcggcgttccacgaggcacacgagctcgggatgttcacggtcttgtggtgctacctgcgcaaccccgcgttctcgaccccagacggagacctgcatacggcggccgatctcaccgcgcaggccaatcacctcggcgtgaccatcgaggccgacctcgtcaagcagaagcttccgacgaccaatggcggcttcgtgaagctcggctttgggcgcaccgatcctcgtgtctacgagcgctacgcgaccgatcatcccatcgaactcactcgttggcaggtcgtgaactcgtatgcaggcaggatcggcctgatcaactctggcggcgagtcgcacggcgcgagcgatcttgctgaggccgtccggaccgcgatcatcaacaagcgtgctggaggtgtcggcctcatctcggggcgcaaggcgttccaacggccgttcgaggaaggcgtggcgttgctgcacgcgatccaggacgtctacctcgatcctgcggtcgaactcgcgtgagcgtgtcgcggcgcgcgcctcaggccagcgccgcgagccgttctgcgacgtcgtagagcgacggatcgacctgggcgatcgcgcgaaaggcatctcgtgcctctgcgtagcgtccttgtcgctcgagcagggtcgcgagctggtagcgcagtcggagggcccggagcgacgtggtctgtcgctcgcgttcgagtgcccgacggatgacgtccaccgccgtgctgaggcggtcggtgtccgcgaggtggcttgcccacacgatacgcccctcgaccatggcgtccttcgacgggctcgcttcgcggagcgcgcgccaccaatgctcgacggcctcagcgtcgccttcggctcgagcacagtccatgaggatcgctccgtgcgtcagatcgccggtgaggtcaacgaaggtggcgagatggcgtgcagctcgagcgaaatctcccaagcggtagcgcacgagaccgagcagttcttcgatggggggcgacgcaggcgcgaggcgctcgatgcgtgtgaggatgcgaagcgcctcggcgtagcgatcctcggcatagtgctgtgctgcctcggcgagctgacgctcgacgactggccggagccgaggcggcgccgtcagctcgctgggctcgatcgcgacgggctctcctggcttcgcgcgtcgccggttcggcctcgtcggggcgaggtagcgctgtcggcgcgggctcgtggtgtcgaagcgcacctcgggcaggcgcccgctggtgcgcgagggctgcggctgcttggaggactgccctgccgtgcgagcaggacggtgggcgccatcagagcgacgctcacgcgcctcgccctcggggcgacgtcccccgccaccacgacgcgggccctcccaggaaccctctcgacgggacggccgacggtcgtcgtcgaagcgacgctcacgcgcctcgccctcggggcgacgtcccccgccaccacgacgcgggccctcccaggaaccctctcgacgggacggccgacggtcgtcgtcgaagcgacgctcacgcgcctcgccctcggggcgacgtcccccgccaccacgacgcgggccctcccaggacccctcgcgacgggacggccgacggtcgtcgtcgaagcgacgctcacgcgcctcgccctcggggcgacgtcccccgccaccacgacgcgggccctcccaggaaccctctcgacgggacggccgacggtcgtcgtcgaagcgacgctcacgcgcctcgccctcggggcgacgttgcccgccaccacgacgcgggccctcccagcggttggcagaggtgccgtttccggagcgatccgagctgcgttgccccgcggctcgggcccgagactgagggttgcgctgcccgtcgcgttcgcgtgctcgagtgtcgggacgggggcgctgtgtcggggtttgtcgatcagactgggaaggatcgtggcgttgaggtcgtgcgggcatgcgtaagggcttcttcctggcgatggagtgtgacgggtgcttcagtctacgtgccgattgcggcggcgttcgcggagagacgggagtccgctgccgacagcggccctcggcgacacgagagtagcggtcgctctgcgctcaccggtggcggtcgagggtggtcacggtgctgtgcgaaggcgcggtcacctcggcgaccctggcgcccatgttgagcatctcatccccggccagcctttggagaatctgccgcgtgtggtgcttcgagcgtcgtgggtgctcgctcccgcgtgtgcatcgtcctcgagatcctcgccgagcgagtggtcgcgtcttggaggtcggccgcaggcgagcgtcgcctccggtcggtcggtccgatcagcacctcggggcaggagaggaccggtctcgcagccctcgggatgggttgggtgtccgtcggcatgcggtcgtccctcgtgccggcgaccagggtcaccctcgctagggtcgtctgtcgagggtgcggtcggtgacgggcagtgccatggtggctcgcgagcaggatggtccgtgagcgggagcatccgcggctgcgtgcacgtgcttggcgcgctcgattgcgaggcgtgctttggcaaccccgacacgcacacgatctcgtgcgaacgcgctgcgtgccagcgcgggcgatggctggaacagagtcagttgccctgggtgctgtcgtgccatgaccctctgcttagaccgagggtcggacggcctccatctcgctggcgttgacggcatcgatgagttggcgcaggcgtccgaacgagcgccggtcgaagcggagggcgaggcgcgggagatccggatggtcgtgctctcgcacctcccacggcgtcgcgcggacgcttcggatgcgaccgtcggtggtgatgtcgccgaaggcgacctcgaggtcggcgacgcgcgcgggggagagtctcccgttcagtctgaggatgaggtctcggccgacgacgcggagcgagtggaagactcgatagaagccgaacacctcggccagggcgtcgtcgatgtcgtccgagcggtgaagcagcgtgagatcgtcgcggtcggcaagcccccggtcgacgatgcgatcgttgagcagctgccacacgccgtcccagtagtgggatccagcgggctcgagcaggatcagaggggcgatctgcgtcttgcctgtctgcatgagcgtgaggagctcgaacgtctcgtccaaggtgccgagcccgccggggagggagatgaaggcatcggactcgcgcaccatgagtaccttgcgagtgaagaagtacttcatctccaacagtcggccgtgttcggcgagttcgtgatcgcctggttgttcgaggggaaggcggatgttgatcccgaaggcgtgatgaggtcctgcgccgcgcgccgccgcctccatgatgcctgggccgcccccggtgatgaccatccagccagcctgagcaaggcgggcgccgagcgtctcggcgagctggtagctcggctcgtcagggtgggtgcgagccgagccgaagaccgtcaccttgcgctgggttcgaaacgggccgaacgtctcgaatgcgctccggagttcgcggagcgctgaggtcagcatcttgaggtcgagtcggtcgaggggcgcttcggtggccgcgagcgcctcatcgaggaggagctgcttgaggtcactgtcacgtcccgcgaccgccggtacctggttgcggtggtggtcggatgtcatgagtgcgtgctcgcgatcgtgacgtccatcaggtgctcgtagaacgtcgttcgttggacgaggtggcggcctcgctgcgctgcgatcgcaccaagctcggcgacggtgagctcgctcgcgtgtgccgccccggctgcgtgcgaaatcgactcctccatgagcgtcccgccgaggtcgttcgcgccggcgtcgaggaggagcacggctccggcaggccccatcttcacccagctggcctggacgttgtcgataacaccgtggtaggcgatgcgccccaccgcgtggaggaggacggcctctcggagcgtcggaccccggcgggcacggccagcgaggaagatcggtgcgcccatgtggacgaaggggagaggcacgaactcggtaaaccctcgtgtgcgcgtaccgagcgcccgggtgcgcatgaggtgccgtgcggtgtgcgtggtcgtctcgaccgtcccgaacatgatcgtcacgttcgatcgcaagccgaccgcgtgtgcggtctcgtggacctcgagccactggtcggtggtcagcttctcggggcagatcaccgcacgtacctcgtcatcgaggatctcggcggccgttccgggcaggcttcgcacaccgcgggcggcgagctcgctgaggtaacggtcgaggggccagccgagtcgtcggctcccctcgaagacctcgagtgccgagaacgcgtggatgtgcatggccgggaagcgttcgtggatggcttcggcgatgtcgaggtacgtgccgccgtcgaagcgaggatggataccgccctggaggcagacctcggtcgcaccacgggcggctgcctcggcaaccttggcgaggatctgctccatcgacaggagatagggtgcgccacggagcgccaaggagcgcgggccgcgcgagaaggcgcagaacccgcagccgaaggtgcactggttggtgtagttgatgttccggttctgaacgaaggtgacgacgtcgccgttcgtctcgcgccgcagcgcatcggcgaggtcgatgaccgcctgtgcgtcggttccgcgcgcactgagggcgtgctcgagcagctcgagcgagggaccctctcccgatcgtgacgccgcttcgagctcgtcgaaccaaccggccggagctcgtcggctgacggtcaccacgcgcggggggaggggacctggtcgaccggagaaccactggtgctcgcgtgcgaagccatcgcgatccatggacgcgcgcactgcgggtcggagcgcgtcgtcgacggcgtcgtcacgtcgcgcgtactcggggtagagcgcgaggcgcggcacgaggtcgcggcctgcctcggcgaggcgacgctcgaggagctcgatctcgggccacgggcgttcggggttgacgtgatcgggggtgacccgcgagatgccgccgagatcgtcgatgcccgccgagaggagcccctcgatgtcgtccgagaggttcgggggtgcctgaacatggacggtcggtgggagcacgagacgcgcgagtgcgatggtacgcagatgggcctcgtgatcggcgggcggggcgtgccgcagtcgagtaccaggttttgggaggaagttctggacgatcacctcttggaggaagccggtctcctcggcgatggcggcgagggcttcgagtgcacggaggcgatcggcttcgctgtcaccgatgcccacgaggatgccgctggtcgtcggcacgtgctggagtgccatcgcacgtaccgttgcgaggcgcagatccggatccttgtcgggtgcgttgcggtggaccgggaggtccggtcggatggactcgagcatcgtgcccatcgagacggcgtgcggtcgtagcgacgcgacctcttcgggcgtgagcgtcccgggattgaggtgagggaggagtccctcggcgatcgcgacgtcagccgcggtgcggaggtagtccagggtggttgcagcgcccagcgaacgcagtgcatcgcgtgcgctggaccatcggagctcagggcgctcgccaagggtgaagagcgcctccgcagcgcccaccgccgcccccttgcgagccaacgcgcggacctcgtcgaggctcaggaaggcagatccgagtcgggcgggcacggtggcgaaggtgcagtagtcgcagcgatcgcggcacagacgcgtcaacgggatgaacaccttcggggagtaggtgatcctcggcccgaaggttcgatcgcgccgacgagcagcttcggcgagcagtcggttggtggaccactcgagcagcgccttggtcatggggtcaccctagccatcatggctgacgatcgagggatcgagcgcgctcgccgcggcagagtcgaggagccagatcgtgtcgtcgcgggtgacgtgcacgacggggaggtcggcaccgccgagcgccgctgcgacgatggttgccttggaggctccgagcgccacgatcacctgagtctcgaagcgcgcgagagcatcgcgtgtcagcgagaggcgccagtggcggttgtgtccgctcggatcgtgattgggtgtgacgaggcctgaggcatcgagacctggggagcccgggaacaggctggcggtgtggccgtcggccccgatccccagatggacgagcccccaggtgggacgcgactcgagctgcgcgccgtagcgggcagcgagcctgtcggcgagcttcggcactgtggccgggtcctccgtggcgagggttgcgaggtccgcgggcgtcagtgcatcggcatccaccatcggcaagagggccggaccgcgtccggtcaggaccgggccgaggtgtgtccagttcgcttcgggcgagccgggctcgacgagcctctcgtcgacctgcgcgatcgtgccggtgcgtgggaggctcggcccgagtgcgtccaagagggcgaggatcgtcgatccgccggagagcgcgaccaaggtgtcgcgttcgagcgcgtcgtggatgagtgccgcaaagcgcgttggcacgtcgttgctgacgatgacgcgagccatcgaacctcctcgtccggtcgccttccctgctagggtaggcgacgcggtggctgcggtcgcaggcagcacaaggacatcgaccgcgcgagcagctaggggagcagggtggatgcgcgaggcagatgaggttcgagacgtcctccgggtcgtcgggcgttacctcaagcaagagaccgtcgatccgttccgcgcgatcggtgccatggtcgtgtggggcctcgttgggtctgtgctcgctgccggcggcttcgtgctggcggggatcggactgttgcggctgctccagaccgagacgggaacgaccttcgccggccatctggactggctcccgtacgtgatcgtggtcgtggtgctcgcagttgtggtggcgatcgcggcagcgcgcattgggcgccgggcgaaggcgtaaggcgggaggacacatggcaaccgaaggccgggtaacgctcagcgacgtcgaggagcgcattcgctcgctgactgagcaggcgtctcgctccgccagtgcggtgcggcctgcggtccctggcgtcgccgggatcgcggtcgccgcggtcgtggtcgtcgcgttcgtgctcggttaccggcggggtcgtcgttcgagcgtcctcgagatcactcgcctgtgatggctgcatcccggcgcgtgctgcggtcgcttcgacgacagcgttcccgcctcgtcggtaccgtgctggggctcggcgggccagtggcgggcgtggtgtggggcatcgtcgcgctgcgttggatcgatcgacgcctgggtcggcgtacgagaacggcgcgcatcgatctctcccgtggcccggtgaccttgcgactgcgcgagcgtcggtgagcggggcattccaggtcggcgattcggtcttgctggtcgaccatcgcggtcgcgagaccgtggccgaactcaccgaggccggcgtcgtgcgcacggccgtgggtgaggtcgcgatgggtgatctcgtcggtcacgagccgggtgaggcggtcgtgacctcgaagggcaagcggatcctcgccgtacgtccgacgctcgccgagacggtggtccacatgccccggggcgcacagatcatctacccaaaggacgcgctggccatcctcggcgcgctcgatgtcgcccctggtcagcgggtcctcgagtgcggtgtcgggtctgggggcctgacggtctggctcgctcggctcggtgcgtcggtcgtggcggtggagcgcaggcccgattttgctcgacgtgctgagaagaacgtggcgcatctcggaggctcggagcgggtctcgatcatcgttggcgaactcgccgacgtggctccgccggggccctacgaccgggttgtgttggacatggtccatccgtgggaggtcatcccctggatcggggcagaactcgcccctgggggtcgcatcgtcgcctacgtgaccaacgcgctccagattcacgagacggtggaggcgctcgaggcgagcggctacgtccgcatcgaggtccgggagctcctcgagcgtcgttgggtggcacggggcgagatcgttcggccggagctgcggatggtggcacacaccggcttcatcgtgtcggctcacatcacgcctcgagcgcgtcggttggccgctgaacggccgcgcgagatcagcgtgtcgggtgtcgtcgatgacggctcgctcgacgagagcgcggacggcgacgtcgacgacgagctcatccaaacggaggaccgaccctaggactcacatcctcgtcggcgcgttctctgcgcagtctcaggcatgtcgtgaggggccggcgagtcgtgccgacgcgagcggccagacgggtcgtacgctgggtcgaccctgacggtgggtggagcaacccttggcccgaacgtcgacctcgacgagttcgttcgtctctcggcccgtatccgtcccgtatccgcgctgccggggaccgcgttcgccgcggggggcgaaggttgcgagttgtcggggttcagtccgcctcgatgaagatgcactcgccggggcactcttcgctggcctcggtcacggcgtcttcgagctcgaccggaaccgaggccatctgggcagagcccccagggttgttcaggacctcgccgttgtccttgacgtaggcgaggccgtcgtcgaggagcgtgaagacgggagggcagatctcctcgcagaggccatcgcccgtgcagagatcctggtcgatccacaccttcatcgaaaccctccatcgattgacgtcgcccacttgagactagtgggtactcacccagggaatcacgggagcgcgggaccgttgacggtgtcatggtgtcgtgcccatgcggtagtgtcgcggtggagggaggttagccatgccacgcgatgagaccccggaacgtgagcacgctgagcagcagtcccgccaagcgctcgaggaggaggtgcgcgaactccgccgacgtgtcgaggaggcaccgagtcgagttcgtgccctggaggagaagctcctcgaggtgtcgggagcgttggctcagacccaggcgaagaacgagaagctgaccttcacgctgcagcaggcacgagagcacatccagaacctgagggaagaggtcgagaagctgacgcagcccccgtctgcgtacggcgtctacctggcggccaaccaggatggtacggcggatgtcttcaccacgggccgcaagatgcgcgtggccgtgcaccccgagatcgacctggcagcggttcgcgtcggtcaggaagtcgtcctcaacgagtcgttcgccatcgtgtcggtgcgggggagcgacgtgatcggagaggtggcgacggtcaaggatgtgctcgacgacgggagtcgtgtgatcctgctcggacgggcggacgaggagcgggtggcgcaggtcgctggtcatctgcagcacccgccgctgcgcgtcggtgattcggtcatggtggatccgcgttcggcgatggtgctcgagcgactgccacggcccgaggtcagcgaactcgcgctcgaagaggtccctgacatcacctatcacgacatcggtgggctcgatcggcagatcgaggagatccaggacgccgtcgagttgccgttcctctaccgcgagctgttcggcgactatcggctccccgcccccaagggcatcctcctctatggccccccagggtgcggcaagacgctgatcgccaaggcggtcgccaactcgctcgccaagaaggtcgagcaggtctcgggccggagcgtgcgaagctacttcttgaacgtgaagggtcccgagctcctcaacaagtacgtcggtgagaccgagcgccagatccggttgatcttccaacgcgcacgcgagaaggccgaggaaggcgttccggtcatcgtgttcttcgacgagatggactcgctgtttcgcacacgaggctccggcatcagctccgacatggagtcgacggtggttccccagctgctcgcggagatcgacggcgtcgaagccttgcgcaacgtgatcgtgatcggcgcgtccaaccgagaggatctcatcgatccggcgatcttgcgcccgggtcgtctcgacgtgaagatcaagatcgagcggcccgacgagcaggccgcacgcgagatcttcgcgcgctatctcacgccggaggtcccgatcgatgcgggcgaggtcacgaccctcggcggtggcgatgcggagaaggccatcgcggtgatgatcgagcggaccgtcgagcgcatgtacgccacatcggacgagaaccgcttcctcgaggtcacctaccagaacggcgagaaggagatcctctacttcaaggacttctcgtcgggtgcgatgatcgagaacatcgtgcgacgggcgaagaagctcgccatcaagcgcgagatcgcgggcgggtcgcggggcatctgcctcgatgacctcctcgcctccatcgcgaaggagttcaaggagcacgaggatctccccaacacgaccaatcccgatgactgggcgaagatctccgggcgcaagggcgagcggatcgtgttcatgcggatcctcctccacgaggaggagggacagacgggtgggcgcgccatcgagcgcgtcgcgaccggtcagtacctgtaggtaccgagtagggaggtgcgatggcggtcgcaaaggttctcggcatcgaaaccgagtacggcatcaccgtgccgggggtgccggaggcgaaccccatcaccgcctcctcgagtctgatcaacggctaccttgcccagctcgccgggaggacgagctgggacttcgttgacgagtcgcctggccaagacgcgaggggcttcagcgtggataccggcggcaacatcgagctcgagacgcacctcgtcaacgcggtcctcacgaacggggctcgcctctacgtcgatcatgcgcacccggagtattcctcgccggagtgtcgcacaccgcgggaggcgaccctctacgacaaggctggcgaggaggtgatgcggcgagcaatggctggtgtcgccgcactgaaccctcatggaccagcgatcgtggtctacaagaacaactccgatcgcaagggcaactcctacggttgccacgagaactacctgatggatcgtcaggttccgttcggtcggatcgtcacggagctggtcccgttcttcgtgacgcgccagatcgtggtcggggccggcaaggtcgggtccgaagccccgggggtgtcgatccgcgaggttcccttccagctctcccagcgggccgacttcttcgaggaagaggtcgggctcgagaccacgctgaagcgtccgatcatcaacacgcgcgacgagccacactcggactcgcagcgcttccgacgtttgcacgtgatcctcggggacgcgaacctcagcgaggtggccacgtggctcaagctcgggaccacggccatggtgctcgccatgatcgaggacggtgagctcgaggacctcgggatctccatcgtcgacccggttggctccctacggcgcctgtcgtgggaccccacgctcaaggccaccgtgacgttggccgatgggcgcaccatgcgtggtctcgacgtgcagtgggcctatcgagagcgcgcagagcgctggctcgatcgcttcggcggcgaggccctcggtggcgatgacgaggcccacgcgatcctcgaggagtggacggatgtcctcggcacactcgagcgcgaccccatgagtcttgccgatcgtctcgattgggtcgcgaagtggtccctcgtgcagggctacatggagcgacaccacctcgatatcactgatgccaggatcgccgcgctggatctgcagtaccacgatgtccgcccggagcgatcgctgcagcgccgtcttcgcatgcgaagactgacgaccgacgaggaggtcgcgcgcgcgacgacggagccgccgccgagcactcgggcctactttcgcggtcggtgcctcgcgcggtttccgtcccaggtcgcagccgcgaactgggactcgatgatcttcgacgtcggcagcgatccgcttcgacgcgtgccgatgatggatccactgcgagggacgaaggaactcgtcggaacgctcctcgagtcggtgggctcggtggacgagctactcgaggcgcttggggcctaacatacctagtgaggtgatcatcgtggctgagcgcgaacaggtcagacggagtgggacggagcgcgaggaggaggccgaagaggtctcgacgcagagcgcggcgagctctgacaagctcaaggccgagatcgacgacatcctcgacgagatcgatgaggtgctcgaggacaacgccgaggagttcgtccgcaactacgtccaaaagggtggcgagtagcggtcgggtgaactgacgggctcgagggccgacgacggtcggcctgagcacggggccgacgacggtcggcctgagcatgaggaaggatggagcaaggttggcgttaccgctctttgaccctcggcacgacccggggccggattttgccgcactcgtctcgcgggacgcggctcgcaccgtgccgacgtcgggcgatggttcgctcggcgctcaggtgccgcacgggaccaccatcgcggcactgcgctttgccggcggcgtcgtgatcgctggcgaccgtcgcgcgaccgaggggaacttcatcgccaatcgtaccatcgagaaggtcttcccggccgatcgcttctcgggcgtcgggatcgccggtgccgcgggtccggccgtcgagatggtgcggatcttccaagtgcaactcgagcactacgagaaggtcgagggcaaggcgctctcgctcgagggcaaggccaatcagctcgcccagatgatccgccagaacctcccgctcgcgatgcagggcctcgtggtgatgccgttgttcgcgggctgggacgcagagcgcagcgagggtcggatcttcaccttcgacgtcgcggggggccgctacgaggaggtcgcctactacgcgatcgggtcggggggtcgtgatgctcgcgcgaccttgaagctcggatggcggcccggcctcgacgaggcaggggctgtccaccttgcggtccaggcgctgtacgaagcagcccaggaggacgccgcgaccggtggacccgatgcgctgcggggcatcttcccggtggtcgcggtgatcgaccgcgagggttaccggcgcatcgacgacgctcgcctcgaggagatcgcggtcgaactcgaccaggccgtgagggagcgaggtgcgcggcgatgagcatgccgttctacgtcgcgcccgaacagctcatgaaggatcgggcggactatgcccgcaagggcatcgctcggggacgagcgctgatcggcgccgtctgggaaggtggcatcattatcgtcgccgagaacccgtccagatcgctgcacaagctgtcggagatctacgatcgcatcgccttcggcggcgtcggcaagtacaacgagttcgaccagctccgcgtcgctgggattcgtcacgccgacctcaagggctacgcctatgcacgagaggacgtcgacgctcgcagtctcgccaatctctacgcgcagtaccttggcacggtgttcacgcacgagatgaagccgctcgaggtcgagatcctcgtggcggagctcggcaacggacatcgggagtcgcagctgttccagatcctctacgacggcaccgtgatggacgagcgcgagttcgctgtgctcgggggcgatgccgacgcgatcgcggagcgcttccgtgcgctctacgacgcgagtggtccgagggagcggctgctccagagcgcgcgagacgcgctcagtgggcaacgtcctccgatcggggccgacgatctcgaggtcgtggtgctcgaggatcgaggcgagcgtcgctgcttccgacgcctcgaggtcgacgaggtgcgcgaggcgctgggcgatcagccggaggggagtgcctgagtgccccgcttggcacggcggatctacggcatcgagaacgagtacggcatcacctgcacccagcgtggccagcgtcgcctgagtcccgacgaggttgctcgctacctgttccggcgcgtcgtgagctggggccgctcctcgaacgtgttcctcgagaacggcgcgcggttgtacctggacgtcggcagccacccggagtacgcgaccccagagtgcgactccctgagcgatctcgtcgcccatgacaaggcgggggagcggatcctcgagtccttggcccattctgccgaggccaagatgcgcgaagagggcatccgcggtgacgtcttcttgttgaagaacaacaccgattcggccggcaactcctacggctgtcacgagaactacctcacggtccgcgtcgacgacctgacccggctcgtcgaggtcctgatcccgttcctcgtgtcgcgtcagatcatcgccggcgcgggcaaggtgctgctcacctcgcgcggtccgctctatgcggtctcgcagcgagccgagcacatctgggagggcgtgtcctcggcgacgacgcggtcacgtccgatcatcaacacgcgcgacgagccgcacgcagatgccgagcgctatcgacggctgcacgtgatcgtcggggactcgaacatgtcgcagtgggcgacctacctcaaggtcggagccatggcgatcgtgctgcgtcttctcgaagaggaggtcgtcctccgcgatctcacgctcgagaatcccattcgggccatccgagagatcgcccacgacaccgaactcgagcgcacggttcggctcgtcaacggtcgcgaactcacagggctcgagatccaagaggcctacttcgagcgggcggagcgctaccacgagcggatcggtctgcctgcggacgaggcgcgcgcactcgacatgtggcgcgaggcgctgaaggcgctgcgcgcgaacgatcacgaggcgctctttggcaaggtggactgggtcaccaagctcaccttgatcgaggcctttcgggcgcgtcatcagctcccgctgtcgcatccgcaggtgtcgctgctggacctgcagtatcacgacatcagccgcgagcgaggcctctttgctcggctcgaggccaagggtcgggttccgcggatcgtcgacgacgagaccatcgagcgtgccgtcgacgaacctccggcgacgacgcgggcggcgctgcgggggcgcttcattcgtgcagcgaaggaggcgcaccgcgactacacggtcgactgggtgcacctcaagctgaacgaccaggcgcagcgaacggtgatgctgaaggatccgttcgcgtccgaggacgagcgcgtggatcggttgctgacctcgatctgatggctcgccgtcgccgagcgggctggctcgcactggcgctcctcgtcgtggcggccgtgctggcggtgcgcgcatgggtgctcacgccgttcgtcgtccccaccggttcgatgcgaccgaccatccgtcccgggtcgtggatcctcgtcgatcgactcgccttcgacacacaccccatcgaggtcggtgacgtcgtggtgcttcggcgaccggccgacgatccgggggaggcgaactcggactacctcgtcaagcgggtgatcggcctgcccggtcagacgatcgccagccgcggggggcacgtcgtggtcgacggacgggtcctcgcggagccctatctgcctcgcggcgatcggacggagggcatcgtgccccagacgatcccgcggggcgaatacttcgtgctcggtgacgatcgcggcgattcggtggattcgcgcatctttggacccgtgccagcctccagcatcgtgggcgaggtcgtcgcggtggtatggccgccgagccaagcacacgtcgttcggtcgtagctgtgcccgggcgtcaggcgttcccgcgttcgccggcgatgcccttgcgaaggaagtccacccaaccgggcgtctcgagggcgtcgcgcagcgatgccgcatcgtgttcgtcgagtggggggccgtcgtggtgttcggagagctcctcgggcagccgccagaactgcagccgtacgccggctgcgaccagcacctcgacgatgcgccgttcgaccggtttggcgacgatgaacccgcagctcggacagcggaacgtgtacgaggcttcgccgttcgaggagcagagcatgatcttgacacgcccgggcgcgacctcgacgtccccgcactctgggcacgaggccttgatgatcggcatgggcgactcccttcgcaaccgcgcgtccgtgacagagggtctatcggcacgcgcggcgccggtgttgagtgctgcggccgtcgacctcgacgcgactccaagagaatgtgccgtgtgcaggtagactcacgccggtgacgcagtctctgcgagcgaaccgtgtgctctcgggcgtgcagcccaccggcgtgggtcatctcggcacgctgctgggtgcgttcatgaactttctcgccgaccaggagcgggcggagtgcatcttcctcgtcgcggatctgcacagcctcaccgtcgaccaggaccctgcggcgcttcggcgccagcgttacgagctggtggcgaccttccttgcggtgggcatcgaccctttgaagtcgaccatcgtgatgcagagtgaggtgcccgagcatgccgaactcgcctgggtgatggagtcgaccgcgacctatggcgagctcgcacggatgacgcagttcaaggacaagtccgctcgccagacgaaggtgcgcgcgtcgctgttcacctaccccgcgctgatggcggcggacatcttgctctatcaggccgatgtcgtgccggtgggcgaggaccagctccagcatctcgagctgacgcggaccctcgccgagcgcttcaacggcgcctatggcccgaccttcacggttccgaagggtcagcttccgacccatgccgcacgcgtgatggacctcgccgagccgacgtcgaagatgagcaagtcctcctcctcgcaagcgggcatcgtgttcctgaccgacgacgacgcgacgattcggcgcaagttcctccgcgctcgtacggattcgttcgccgaggtcgtctggaagccagacgacccgtcccgtgccggtgtgaccaacctcgtcgagatcctcgccgcgctcgagggcaccgacgcatccagcgtcgctgctcgcttcgatcgctacggaccgttgaaggaagcggtcgcggaggcggcggtggccgccatcgccccggtgagagagcgcttcatggccctgcgcgacgacgaggcgaccctgcggggcgtgctcgaccaggggcgtgagcgcgcccgggacatcgcccgcacgacgatggccgtggtgcgcgatcgcctgggcctgacctgacgaggcgtggagggaccagcgtggatccggccaaggtgctgttcatcgccgtcgcggcgctcatcgtgctcgggcccgagcgcctaccggcggtcgcgcggcgtgcgggcgagctgtggtcgctcgcacggtcgccgacggagtgggtcgcgaagcatctcggcgaggtcgcgcacgcagccgggatccccgaggacgtgctgcgcatcggtttgccaggaggcctggatcgctggctgatggcttcgggccccgccacgagtgcgtcggcccaaggccccgcggctccggcgtcgccccctcctggccaggcctcctcggcgacgccgacgggcgccgcatcgatcgtggcgggaccctgggagctgaactagtggcgctgcggcggccacgacggcgccgtctcgaccccaacgcgatgaccaccgtggagcacctgcgggagctgcgacgtcgcctgattcgcgccatcgtcgcggtcaccatcggcgccatcgcggcctatgcggtctacccgcacctgttgtcggtcctgaccgaaccgttgtgtacggtcgagcacgaaccgcactgcgtgctgtacgtgaccggaccgatcgatgggttcgcgatccgtctcaaggtggccgcggtggcggggctgttcctcgcctccccgatcgtgctctgggagctgtggcgcttcgtcgctcccggcctcaagcggggcgagcgacgcctgacgctggggtttctcgtgtcgtcggtcgcgctgttcgtggcgggcggcgtggtggcgtggttggtctatccacgcgccctcgggttcttccagtcggccgcgggcgcccaggtgcacgcgatctacacgccgcagagctacctgtcgctgttgctgatcctcatgatcgccttcggcgtcgccttcttgttcccggtcgtgctggtcggcctcgaactcgctggcgtggtgagtccggccgcgttgcggcggcaccggcgtcccgcgtggctcgggatcatcgtggtggtggcgatcctcatccccagtaacgatccctactccttgaccgcgatgacggtgccgctcctcgtgttctacgagctgtcgatcgtggtcggttcggcgctcaccaagcggcgggcacgcgtcgccgacgccggaggctaagctcgtcctcgacggggaggctccgctggtatctaccttccgcagccgattcgccgaaacgctcggcttggtcatggatcggttccaggacgaggccctcgaggcgctcgacgaagggtcttccgtcctcgtcagcgctcccaccggttccggcaagaccatcgtcgcgctctatggcatggcccaggcccttcgacagggacggcgagccttctacacgtccccgctcaaggcgctgtccaaccagaagtaccacgagctcgcccgtttcttcggtcctcagcacgtcgggttgctcactggggacaccacgctgaacccggacgcgcctgccgtcgtgatgacgaccgaggtgctgcggaacatgatctacgcctcgccagccgcgatcgacgacgtcgacgtcgtggtgctcgacgaggtccactacctccagaacccgtaccggggatcggtgtgggaggaggtcatcatccacttgccgcgccgcgtccgcctcgtctcgttgtcggcgacggtgtcgaacgtggcggagttcgctggctggttggccgccgttcgaggtacgacgcgcgtcgtggaggcgacccaccgccccgtcccgctcgagcatcgctacctctacacgccgcggcgttcggagacgccggtcgcgataccggtcctcgtcggtgggagggagaacccccagggggcacagctcgatccaccctggctcgcgcgcagtcgttaccgagacgggcttcgggctcggacggtccatcggatcgagctcgtcgagttcctcgctcacgagggcgatctgcctgccatcgtgttcatcttctcccgtgctgggtgcgagcgcgcccgcgatgaggtggtcgcctccggcattcgactcaccaccgcggccgagcgggtcgcgatcaggcgcatcgtcgacgagcgtctcgacgggttggccgagcgcgacctcgcggccgtcgggttcgcgccgttcctcgcgggactcgaggcgggcatcgcgccccaccacgcgggcatgatcccgccgtttcgcgaggtcgtcgaggcgtgcttcgagcgcgcgctcgtcaaggtggtgttcgcgaccgagacgctctcgctggggatcaacatgccggcccgatcggtcgtcatcgagcgcctggtcaagttcgacggggagtcccaccagctgctcaagcccggcgaatacacgcagttcgctggacgggcagggcgtcgggggatcgacgagcgcggcaccagctacgtcgtgtggggtccgcaggtcgccttcagcgacgtcgcgcacgtcgtccgggcggacttctacccgatcacgagttcgttccgtcccacctacaacatggcggcgaacctcgtgaagcgctacacgcccgagcgcgcagctgagctgctcgatctctcattcgcgcagtaccagcgagacgccgaggtcgtccggcgccaggcgcggttgcgagcaggcaacgaggatgtcgtcgcggcgacgacgcagccggagcgcgctgagtggatcgagccgggtcgggtggtgagcgtcccgagcgagcgcggcggtgccgagcgagcgctgctgctcatcacgcgggtgtcccagcggcgcggtggcgggcttcggatcagtgcgtcctcggagtcgggcagggtgtatcgcctcgacgaggggcacgtcgcctcgatgcgacccaagggcaaggtgcgcctccgtgcggtgcacggctcccgggaccaggggatcgccatggcctgggcacggatccgggcgcggcgtcagcaggcgcgggagctcggcgaaccgtcgaaggcattcctcgacgagcgtgcgcgtggtcgtcgcaccgacgcgccagcgccgtcgccccgttcgcgtgagttgctctcggaacagctcgagcgtgtgcgcacggtgctcgagcgcttcggcttcgccgaggggtggagcctgacgcagcgaggcgagcgactgacgaaggtctacgtcgagacggacctcgcggtcgtcaggttcctccacgacgccgagatcgacggcgtcggcccggcggagttcgccgcgatcgcctcgtggttcgtgttcgaaccacgacctcattcgccccgatccggtccgtggccagcgagcgcggccatggcgcggctctacgagcgggccgaggcgctcatgcaggagcagtgggcggcggagtcgtcgctcagactgcctcgatcgcgcggtccagagcccgggatctctcgcgccctctggcggtgggcgcggggagagccgctgggggcagtgctcgcgaccgacgagatggcaccaggggactttgttcgcgtggtcaaacaggtcgcggacttgcttcgccagatcgcggtcgcctgggacgacgatgtggtctcgtcgctcgctcggcgagccgaggcggcggtcgttcgcggcgtggtggcgctgtcgtcggaggtcgtcgccgaggatcccgagcgcatgccccacggagtgctcgagctcgacgagcggccggcgtaggctggcccgctgtggcgagctaccttcctgagcagttcgacgaggcggagcgggcgcggctcgctcctttcgtcaccgacgtcgacggtcgtgtgttcggtctggtgggcctcgacgaggaggtcgtcgcagccctgttcgcacgctactcgcgcacgtccaggtcgcttcggcggacgctgctggaggagttcgcgccgagggtcgaggacgcggtgcgagcgggcgtcggtcgtgagcgcaccgaggctctccttgcccgcgtgatcggcgagtacggcgacgactcggtcgcccaactcgcggtcgtgcacttcgcgatcgagcagatcccggccttgctcgcgcgccgcatcgagcgcggccgtcttgcggcctatctcgagcaatccactcgctacgtgccgctcgcgactcgccgttcggatgggagttggccagcttacgtccccgacggcctcgcgccgcgggcggcgcgtgcctacgacgaggccatcgaggcgagctttcgtgcctatgcggcggtcctcgaggcggtcgaagaccatctcgcgaagctcgatccaccggccgatgcgccggctcgtcgtgcgcagcgggccgccgcactggatgcagcgcgcgggttgctgccgctcgccgtcttgaccaacgtcggtgtcgtcgccagcgcgcaggcggccgagcgcttggtgtggcggctccgggccgacgccacgcctggggcgagcgaggttgccgacgagatcgcccgggtcctcggagtgctcgtaccgggcctcacccagcgcatggaccgccccgaccgcggtgggcggatggtcgagtatctgcgcgagacgcggggcggcgtcgaggttccgtggcactggaacacggcgatcgtcgaaccctccgttcggatcgtccgagccgacgaggatgcggagcgccgcgtcgctgcatggatgctgttcgagcgtggcgaggtggactcggtcgaccagggccttgccgcggtggaggcgcggggcgaggagggcctcgatgcgctgttcgtggccggcgtcggccatcgggccaatcgccgccacctgcccgggcgccccttcgaggctgcggtgtacgagctcgagatcacctgcgacatcggagcctttcgcgacctcgcccgccatcgcatcttgaccctgctcgagccaccgctcgtgccgggtcgtgggttcgcgctctccgatctcgtcgtcgacgcaggcgtcgcaccgctcgtgctcgagcattgggagcgactcggcccgctggtcgcgagcgtggtcgccgaggccggaccgtcggtgggtcggttgctcttgccgttcgcgacgcagatccgcttcgcggtcgtggtgaacgcgcgggagctgatgcacctcgtcgagctgcgatcgcagccgcagggtcacccggtctatcgccgcatcgcgatcgaggcctggcgcgcgctcgaggcggtcgggcatcgccggatcgcaggggccatggagttcgtggacacagagggctacactgtgggccgcctcgccgccgagcgacggagcgaggtgcgatcgatgcagtcgggaaggatcagcggggctgatccgttgagctagccgagctggtgcgcgaccggctccgtgcgaggaggacgaggacgagtatgccgagacgcaagggcgacgagtcggcatcggaaccggaggttccacacgacgacgagctcgacgaggagctggtgggcttcgacgacgatctcgatggtgacctcgacgacgacgtcgacgaggaactcgaagatctcgacgaagagatcgaggaagagggcctcgaggttggcgatctcgaggatctcgaggccgatgatctcggcgaggccgacgacatcgtcgacgatggtgtcgacgacaccgaggacggcgaggtcgccgttgtcgacgaggaggacgacgatctcgagggcgacgaggacgtcgagtcggccctcgacgagattctgagggagcgcttcgtcggcggtgacgtcgaagaagatgtcgaggccgagtcggacgaagacacgcccgatggtctcgccccggtacggcctcgccaacccggcgagttcgtgtgccagtcgtgcttccttgtcaagagcatgtcgcagctggcagactccgagaagatgctgtgccgcgattgcgtctagacggatcggtggcaccgtaagcttgaggttggccccaaaggaggcgctatggcagagcagcaacgtcgacagctgttcgatgatgtcctcgatcgcttcgtgttcggcccggtcggtgtcgccgctgcggtggcacgggtgctaccgagcgcggcggaggagggtcgcaaggtcctgcagggaccgatccagactgcgcagttcgtctcccagatggccgctggggtcgtacgggcacgctacggcgagcagttgcggggagtcgaggagcgtctcggcgacgtgagcgagcgcgtctcggcactgcgttcgatggtcgagcaggttggcggcgggatcgtgcgcaccgtccagcagaccgtgccccggccgggtgcgggcccacgcgatgcggctcccgatgccgaagccgcatcggccgccacgcgcgaggcgaggccgtcggatgcgcacgcaactggggaggaccacgccggcagtgtcggtgggatcgatgcctacgcgaccctgtcggccgccgaggtgatcgagcggctcggatccttgagcgcggagcagctcgccgaggtcgagctgttcgagctcgatcaccggcgccgccgcacggtgctcgcgcgcatcgcgaagctccgtgaggagcgtggctaggccgcctcaggcattgagaggtgcctcaggcgatgaggccgaggcgctcgaggagcgagcgcacgcccggagccagggggcgaaggtgacgaaggtcgtctggcccgaaccagccgagagcatcggcgtctgaacgcgcattcccacgcgctcgcccccgcggtgtcgcgagcacggtccagagcacgtacgcgccgcgatcggcgagcacctcggcaacctggaggacgcgcactggcgcggcgtggacgccggtctcctccgccagttcgcggatcgccgcggcgaccgggtcctcccccgggtcgacgtgcccaccgggtggggcccaggtcccgttcgcgtccggagagccgcgccgcacgagcagcacgcgcccatcgaggacgaggagcgtcgaggcaccgcgctggacggggagggcgaggcgcgccacgacagcgggcctaggcgaggcttcgagcgagccggagctccaccgttcgaagtccagcctcctcgaagagggccttcgttgcccggtcgccgggtgcgcaacttgcgctgaggacggtggcgccgtgccggcgagcgagttccgcgcaggcttcgaggagctcgccggccaagcccaacctctcgaagccgggcatcgtgacgatcgcgcgcacgatggcctcggggccgttgcgctccacgatggcgatcgctccgactactccgtcgacctcggcatcgacgcgccaggcgtggtcgggccgaagttcctcggcgacgagcacactggccatgggagcctcagtcgtgggtcggcgtcgcctcggcggcggagacgtcggaagggtcatcgccgggcaccgcctcgtcgatgtgcgacggtgctgccgcttcgggttcgccgatggtgtggtcctcgacgtctcgaacggcgtcggctgccgcgagctcgtcgtgtggtcctgcggggtgaggggatggagcagagacggtctcgtcgacggcgacggtcgtcgcagggtcgatgtcgcgggtcgatgtgtccggctccgcgtcagccggctcgggctgggcgccgacgagggtgtcgtcgggagtcgccaacgattggggctcggcctgacgagcgcccgttgcagcgccggcgtccgtggactcggcgtggccccgcccggcatcgtcacgttgcgtggagccctggcggggtttgcgcgaagtcttgggaacccgagcgaggatctctggcttcgggggcgccggcatcgtgaccccgagcaggcgtccgagcgacgggatgcggccggcctgttccttggcgagttcgacgagttcggcaggcgcggcctccggcagaccggtcgcggtgacggctcggcggatcggcgagttcgcgatcgcatcgatcaggaccatccagcgctctggcggggtgtcggggatcagttcgcgatcgacggcctcgacgagggcgcgctcgacgtcgtcggggatgcgtgcactcggatcaggcaggcgactcgccagccgcagcgctcgcacggtacggccggactcgacggcctcgcggagttcggcatgccagcgctcgatgctctcggcgatgcggcggttcagcacctcgcggagcgtggtggccttgtcgaggacgctcgggtccttcgacgacggatcgacggaggccaccacgctgcgcagatcgcgaagggcgacggtgttggcgatggcgagtgcggcgtcggcccgatcgagccaggtcgccgtgcgcacccgaggcaggagatcctcggcgatcttgagcgtggcctcctcaggcgctggcgcgcggccctcatgagcggcggcctcgcgatcgcgcgcgatggctgcgcgaacctcgggcatgccgccgcgcaccagtgcctctgcgatcggccggtgctcggggatgacgctctcgaggaatgcgcgtcggtgggtgtcgcgtggccgaaggcgtggtgccgctggtgcttcgggctgagcgggccgtgcgtcgcggcggcgagaacgctgaggggtcgctccctccgcgcgcgcgctttggtcgtgctggtcgtgctggtcgcgattgctgcctggacgtccacggcgctcggcgcgacggtcctgacgcggccgaccgtcgcggtcgtgggtgcctcgagcacccggccgtcgctctcggcggacggtctggatggtgacgggaggttccgcgcgtcccgaccccacgatgtcgatgcggtcggtgcgaggcggcgcgacgtcgggccgagccaggctgaggatctcgatgccgtcgaggcggcgcgcgatctcggcccgcgcgacatcgccgacgctcgcaccctcccacacgagcgaagccggtaccgtgccgcgcggatgtcgtgcgccgacggcgcgccaggtccactcgccacgcgctgcgtcgtggctcgtgagctcgacctcgatcctcgatgccatgtcccaagaacccttcttgctcacccgatgctcggcatgtcgccggtgcctgcgccatcctagtgtgcgcgctcgtgggcgtcggagggtcactgggggcgctcgggtgccctcggaaggggccccacggcgcccgtggattcgccgccccgaggggccggtcgtgggcgccggctcctcggatcggagcctgtcaatctctagtcaatctctaagaggcaccccgggctcgatgttcactgtgtcgtcgctgcctcctccggcgggttgatccggaccgctgcacggagccggggtggctcgggccgcctctgcacgaggcgttcggggtgggcacgcaaggcagccgcgagcacctcggcccggtgtgctcggagctcctcggcacggccgtcgacgtctgccggggtgtggagtccgattccagaatgacggtgctcgtggttgtaccagcggaagaagcgctcgcaccaggctctcgcgtcctcgtagcagccgaagcgccgggggtcgtcaggtcggtacttcatggtcttgaactgagactcgctcctacgggttgtcgttggaggtgtggggcggctatggctccgcgtcaccccgaggtgcgagagcaggtgtgcgacgggccccgcgatcatgggacctcctctgtctgcgtggatggtgagctgccctggtcggatgccctggctggccacggtctctcccaagagagcgaccgccaggctggcgtgctccgcgcgggcgagcatccagcccacgacgcaagcggctgtcgatgtcgatcacggtggagaggtagtagtggatccacgtggcagggccgtgcagcttcgtaatgtcccacgagtagacctggttccttctcgtggccacgagctcgggcttgaggctcgggggatgggtcgcatggcgtcgccggtctccgagcgcccgtgggcgcgcagtatgcgatccatcgaggacacggaggcgaggtagatcccctcgtcgaggagcttcgcgtacaccgtggccggggcctcatccacgtactccgggctgttcaggacgcggcgcacctcctcgcgctcgcgcggtgagagtgcccgtgggtgagggacacgtgcacgcttcggccggggtggccgggggctcgcagggtgccgtcggtcgtagcgggcacggggctcgccgagggccgagcaggctgcgcgtaccccgaccgttggcgccagttcgctgatggcctcgtcgatcacgtggtctcgccgtgggtcgcgggcgcgccgtcggtggcgagctgctgcaggcgcgcggagagttttccctgcacctcgatcaccttgtgggccttggcgaggtcggcctcgaggcgctcggcgcggcgcctgaggcgtgcgatctcctggtcgcggggatcagcgggttggcgtcctggtggacgtgcgagtgcctcctcggtggcaaggtcgcgttggcgtcgccactcggtgatgagtgaggagtgcaagccctctctccggagcagggctcccttctcggcctttgcaaagggagtcgtagtcggcgaagatccgtgccttgtaggccgcggagaagcgtctcggccctcgggcccgctcggggacctgcggatcggagttgctgggcatgcccccagtctggtagggactcgtcgtggcgtcggtcgtcatggtggtggcaagctccttcctcggccgccctctcgatccaacgatggggtcaggaggagtggtctcacccaagattgacacggagggtaaccccgaaccgctggcggtgccgaggtcagcggattcccccggccagctcctcagcgcacgtcgctgtcgagggggcgctctgccaccagctgcttggcgcgctggggctggcctcgagcgccttcagcctctttacctcgggccccgtgcctgccgccgtcggtctgcttccagccgctgtcaggtcgtctcggtgacgtgcgaaggctcgggcgacctcggcgaccgtggcgcctgtggtgcgcagccgtccccctcggccagcctccggaggaggctgctggtggggtgtggcgctgcctgcccttcatgtggtctcttcctcccactcgtccatgctggtcggggtgctcatggaacgggtggtctcgttgcaggagggccggccagggtactcgatgatcgcgaggtggtcgacgcggtctgtggaggtgcaggcttgccgacgacgctgggtgcaccagccgcaccagcgctcggcggcgtggcgctgtggcttggtggccacgagatcgtcgtggagggggtacggaggcccagctacggcgtggacgacgcagctggtagtgccgtcgtgacggcgtcggctccgcccaggcgctcctggacgcctgttgaaggctacttcacggtcacgttgcagccaacccaagggcaccaccgccgtccggctcagctccctcccctgccagatgacaaccgccgggacaacaacttgtcatcttttcgtccgggtcgtgaggctgaggctatactccgctcaggcgcctccgcaaaggtcgtacggctcgagggctctcggggctcatcgctgcgcgtctcctccgaagggagccgagatatgcacccgtctaagcagatgaccttcttgcgcaaggaactcgcccttggcacgatcctgacgtctgcgctggccttcttacttttctcacccttgggtacaaccagcgtggctgcgtcgaaaacggcagtcgccccgatgcccgcaccatcaggcgacccttctcagcctgccggtatttgttgcagtacccagaacttgggatccaccatcggtgaaggcactgttctcaatcccggcgactatctactctcaagttctggacaataccagctcatcatgcaaggcgacggcaactttgtcctctacaacttgtacaacggtcaagcattgtgggcgactggtactgaagagcactctggcgcctacgcagtgtttcagaacgacggcaaccttgttgtttacttcaatgggactgcgctgtgggatagccatacgtatacctactctggtctgacactgacaatgcagaacgatggcaacgcagtcatctatcaaggtacccagccgctatgggcaacggatacagctgcgaacgagttggactgttggccttccaacaactgcacacccggcttgttcatctatgcctatcttcaattcccgccaacagcgccgttgcagggagtgaacgcaccgacaacgggtgccaacacgtttgcgatgtccaagtgggaacaacaagaagacagcgtcattcagtcaaaccctctcgacacgacgcaaaaggagcctggctcctacaccctgaagggcaactctgccaacgttcaagtgtatacgaattctgatggtgagtccgctgattactggggcattgacgcatttgatcagactatttcttaccttccatattatgggccgattatctcggttcttagaaatccagtgaacagtccctaccagcaatgcgtcaatctcgcgaatgctgtaagcagcaccctttgggggacgattaatttctcagatctgtgttagcttcctactgcaaagatgaggaggtgtgatgtccactgcatggaaccgcacggtgaagattggcggggttgtcagttcgtgtcttgccttagtggctcttgctgctgttgctggccgagtcgaggatggccacgccgctcaacaccgcggacatcagcagtcacccgttgcgagaacagctacggcgccctcagtacaggtggctactgggcaaagagcagggcagtcaaaggatgctgctgccgcaggtgatccaagctactttacccccacgctatcaggtgttgaaacgggtgatcctgccttgccagttggccactactgggaatacgtgccagcggtagtgcccggcgttccggagagaccatcgtacatgttgacgatcacacaaagtgggagtgatggacagatcgcgggcatggtctatatcttctacgaggatgggaagcttgataccgtgtttccgttctctggcctcgtggatgcgacgactggcaagggtagtatcacagtgagtggcgctccaactgtggtgtcatacaacggcgtgatcttctacgatcaatctacggtgcaatctggtcagcagctgccagtggtcgtcagccatggcgacatcacgttccctgggtgttcgaactatctgcactggctgatggccgggagttcagcatcacctgctctgctcgcggcaatagcaagtgatccgaatgtgtgcacgttctacccgactggtggcgaggcctacccaagcgagtcgcagatacccgttaccccttaggggatcggtgcgtgggaagcggagggcggagagcatcttggcgcctcgtgttagttggtgtctcagtaccctcggccggctctcctgaccggccccccgcaccgagtccaccttcaccgtgagacccagcgtcgtcatgccagcgctcgttgattccactgagcgccgatgacgccgagcgggcagcacctctgacccctcgcggaggcctcgaggatccgtcgctgggtggcgacgtcgaggcgggcgaaccgggcggggctgcggtcccccggcgatctgggcgtccgcgtcgtgctggggggtgccggtcgtgctcgaggagctgcctggcctcgcgaacgccaggcgacgcgctccccatcgagcacctcctcgcggacctgggcacccagcgatgcgcacaccccgttctgccacggcgagcccgggtcctggacacctgggcagccgagctcggctgcccaggtggtcatgcacgcggccacgcacgccgggccgtcctcgacccggaggacgcctagggttcctcgctcggcgaggaggccatcgagggtggcgacacgtcgtgcgcgtcaatcgagcgcttcaccacgcacagccagctcctccgtcgtgggggcgtccaccacggcgagcacccagggcgccctcccgtcgtcggtcgcgtcgaaccggctccagtgcccaggtcgcgttcgtctggatgggcaggtgagcgcccatgggcaccccaggtcgtggttggcgccgtctcgtgcgtgactggggacccggagccctgccgtgcgccagagccggtgcacccatttgaggttcacctggtagccagcctccctcaccgctcggtaggccttgcgatagccctggcgggagttggctagggcgaaggtgcgcaggacctcatgctggccgcatccaagctggactcgggcttcgtcggcacccgacgctgggtggagcgaggctgggccgtcagccggcacgctcgtcgctcgtgcaccccgaaccgccggcggtgccggggtcagcaggttccctcggccagcctccggaggaggctgctacctgggtggcacgctgcctgcccttcatgcgctctccctcccgctcgtccatgctggtcggggtgctcacggagggggtggtctcgttgcaggggggccggccaagatcacctcgtatcggtgccggtgccaccaggcgtatggcaccagcgagcggtgatcctcgtaaggcggtcaggtaagtccaggtcagagctgctatggttgagggtcggtagcaacgacccctcggggtcgtcctcgttggagcagggcgtcccagaagaccggatcgtcggcattcaccacgtggcaacgaccccgagcggtcgtcctcgttggagcttcgatgacaccccgctcaccatgtagcggcggctcaagtagcaacgagcccgcggggtcgtcctcgttggagctcggcgacgcagggcccagcccccgacccgtgaccgcggctacgccgtgtgctggaacacggcctgctcgagccgacggaggcgctcggcaacgctcagctcgccccctcctcctcggcgcggagccgatcgagtgcccagattcggatcaacgtggagactggcaggtgctccttggcggcagcgcgttgcagccgggcgtgctcgtcagcggacaaccgcaccgacaccacggtcgggcgagtgaggttgggtcgtgcgaccgtgacgcctgcgggcacggtgtcggcgaggtcgtgctgctccgccgccgctccctcctcggccacgtggagcatgacgcttgccgcccttcaggtcggcgccctcctacgagtccctgctcgtcgggaccgccgcaggccgagtgcaaggatgtagcgtgaacagcgagaggaaggaccccatgccccgccgtaccaccaaggactgcatcctcgcctacctcgccgcccgcccgaacgaggtggccttcgtgcgctccgagttcgctcagtgcgcgaagagtcgctcggccgtggaccgagcgctgcgcgccctcatcgacgaggaggtgctcgtgcgcggcggctggggcatctacgtgcgggccaagcgtgtcgagttccttggtcgtgagtacgtcggcactgtcactggcttcgactattggtaccccgaggtgctcgccaagctcggcgtcacctgggaggccgacagcgcgcgcaaggcgtacaacgagggccacaccacccaggtccccgcctggaccgcagtcaacgtcggccgccagcgcatcaccaggcggatcgcgttcggaaagcgagtgttgcagtatgagcgaaccacgggggctcgacgacgcaaggttcggcctacttcagcgagccgacgacagcgggcaacttccactccctcctgagttcttcgaaaaggacctgctcgtcgccgaggcggtgcgcgtcatcgcccaggtaggtcgtgagcgaggtgtctcgctcatcttctgcggtggcaccgcgctcgcgcaggcccaccaggtgatcgagcgcatgagcgaggacgtcgacttccgggtggtgctgccggacctgcccagcaccaaccagcgccgcaagttcctctcggcgctcaaggccgacctcgtcgcggcggagcctgtcaatctttgagagacaccccgggctcgatgttcactgtgtcgtcgctgcctcctctggcgggttgatccggaccgctgcagggagccggggcggctcgggccgcttgcgcacgaagcgttcggggtgggcacgccaggcagccgcgagcacctcggcccggtgagctcggagcgcttcggcacgtccgtggtgcacatcggccggggtgtggagtccgatgccgcacgtggcggcgctcgtggttaaaccagcggaagaagcgctcgcaccaggctcgggcgtcctcgtagcagccgaagcgccggaggtcgtcaggtcggtacttcatggtcgtgaactgggcctcgctccgacgggttgtcgttggaggtgtgggggcggctgtggctctgcttcaccccgcggtcggcgagcaggtgggcgacggacttcgcgatcatcggacctccccggtccgagtggacggtgagctcccccggtcggacgccctgactggccatagtctcctccagcagggcgacggggtggctggcgtgctcggtgcgggcgagcatccagcccacgacgcaagcggctgtcgatgtcgatgacggtggagaggtagtagtgggtccacctggcagggccgaggagcttggtgatgtccgagctcgtgacttcgttcggtctcgtggccacgagctcgggtttgaccgtcgggggtgggttgcgtggcgtgccggtccccgagcgcccgtgggcacgcaggatgcggtacatcgtcgacacggaggcagggagatttcctcgtcgaggagcttggtgtacaccaaggccggggcctcgtccatgtgctcggggctgttgtagcacccggcgcactggccctcgttcctcgtccgagagggcccgtggctggggagccttggctagcttggggcttcttcggtgccgtcggtaggagcgagcacggggctcaccgagagccgagcaggcggtgcgtaccccgacggttggcgcgagttcaccgatggcctcgccgatcacgtgatctcgtcatgggcgccgggcggcgtatgcgcgcggctcaagggtccttgcggacgcgaggtcgctgccgcacgcgcgtgcacgggagcggttcgcgtgctccgggccactcgggtcagttcgcagccgagaacggtagccttggccgtggggacgcttgctccgagggaggttacagggggatgacgcgtcggtaccgctgcacgaactgcgggaacgtcacacggtttgacgtcaccatgtcggttcgtgcacgttcctatttccactattccatcgcgggtgagctgtcggtcgaggacaccgaggagctgtcgcgcgtcgtcgaggaggtgtcgtgtcggtggtgcggcacgagccgattcgtggaggtcctcgaggcgaccccagcgacggtggagcggacgtgagcccccgcgctggtgaccgccctcgtcggccggcgccgcagtgggcgctcgctcgtgtcgtggagctcctcgacgagacgccggacacgaagagccttcgtctcgagctcgacgaaccccagcagtacttgccggggcagtactacaacatccgtatcccggtcgagggacgaccacgaccgatccagcgcgcctattccctcgggtcctcaccgatcccggaaggccgcgtgatcgaggtcggcgtcaaggcggtgccgggaggactggtgtcaccgcgactcgtgttcgagacgcacgtgggtgacgaactcgaggttcgtggcccctacgggacgttcacctggaccgaggaggacgggggcccggtcctgctcgttggtgcgggatcgggcatcgtgcccctcatggccatgatccgctaccaggccgctcgtgggacggcgatcccgatgcacctgctctactcgtctcggcgtcgcgacgaggtgatctacctcaccgcgctcgagtccctccggagcgagcacgagtggcttcgcgtcagccacaccttcacccgtgatctcgatgatccgctcgccaggttccatcgtcgtatcgacaaggagatggtgcagctggtggcgcgcgaggccgaagcgcagctcgcctacatctgtggacctccagaactcgtcgacgacgtcgaacggacgctgatcgagtccggtatggatgagcaacgcatcaagaccgagaagtacgactgacgacggtgcgctcgctcgccgcgtcgaggcgtgcctccgagacgccggtgtcgtcgcggcagggtgggtcccgagagagcagcgtgcctggcgcgagagcacctgggcccagctggctgtcgcgcgcggctggatgcgtgagccacggttcacctttcggcgtccgcagcctgcggccgacccttgggccccgctgtcgtgggcccgcggtgcgatcgtggtcgcggtcgcggcagcgccgtccgtgcccgcggcgaaccatctcggtgtcgctggctacgcagcaggcgatgcgtacgcgcaggtgcgcgacgcactcgagcgtgtccggcgcctcctcgtcgacgtcggtggccgtggtgtcgtcgtggccgactccaacctcgctttcgatcgcgccctcgcgcgccgagcgcggctcggatgggtcggacgccacaccctcgtgatggtgcccggctacggcggggccgtcgtcctcgggtccttgatcgtcgatcgggtcgtcgaggtgcgtctcggacggaccccgactggggatccgtgtcgcaactgccgtcgttgcgtggatgcgtgtccgacgggcgcgctcggcgacggggtcctcgagccgctgcggtgtcgctcgtggcgccagcaggagcgacacctcgagccgtcgtggcgcgagacgtggggcccctggctgtatgggtgtgacgagtgcgtgacggcgtgtccgctctcggcacggcagaagaaggtcgggggcgagcgcgtcgcgtccatcttgtcggcgagcgatgcagcgctcgccgagcgcgtccggagttggtacataccggatcgaacgctggcgtgggtgcggcgcaacgcgatcgtcgcggctcggtccctcgcgacgagccccgacgacgagcaggcgatctggcgccagctggtcgccggagcagcgccggtgcgagccgaggcggtacgctgggtgcttcgtcgaggtgggtggggaggtgtcgatgcgtcacgtgctcgtcaccaacgactttcccccgaagatcggcggtattcagcactacctcggggagatctaccgtcggctcgacccgacgagcttcgtcgtcgtcacgcgtgacgaggcgggcgccgaggccttcgatcgcgccttcggggcgcgcgtcgtgcgagtgcgcggaccgcttctgcccactcgggccctggccgcccgagttcgcgggctcgcacgcgagatcgacgcggacctcgtggtgatcgacccgatctggccgctcggtgaggtcgcggcgagcctagggctggggtgggttggtgtcgcacacggtgcggagctcacgttgccgcttcgactgtggccgacggccggtcgaatccgaagtgtgctcgcgggggcgctcggcgtggtggcagcgggaggtttcgtcgcgcgcgcgctcgatggggtggtgccggccgatgcgatcgcgacggtgccgccgggggtggatctcgaacgcttctgcgtcggcgatcgcgagcgtgcgcgcaaggacctcatggtggacccggagcgatcgctcgtgctgttcgtctcccgtctcgtcccgcgtaagggcgcccacatcgtcatcgacgcggttgcccagctgcatcggccggtggagctgcacgtggtcggtgacgggcgaagccgcagtgctctcgagcagcgagcgcgccgtcggggaatcctcgcggtgttcgaggggcgtgtggcgctggatcggctggtggcgagctaccaggccgccgacgtcgtcgcctttcctgcgcacgatcgttggttcggtctcgaggaggagggtttcggcatcgtcgcgctcgaggcgcaggcctgcggcgttcccgtcgtggtcggcgtgagcggcgggaccgcggaggccgtcgatcctgcgagtggacggctcgtcgcgagtcgccgtccgagggcctgggccgaggcgatcgaggagcgtctcgctcacacgagccctccggtcgccgacgcgcgtggcttcgtggagcgtcatcacggctacgaccggttggccgacgagtggcatgcgggactcgagcgcctcgcgagccgtggacgtacggccggaagcggctaacctgcacacatcatggaggccacagctgagtcgcgcgaggttcctgcgccggtcgaggcgctgttcgacgtcgtcgtcgacgtcgaacgctatccagagtgggcctcggacatccgaagcgtgagcgtgctcgagcgcgacgagcatggtcggccgcgtcgcgtccacttccgtgccggcgcgttcggccggagcgcgtcctacacgctggtctacgatgcgtccaaagcgccgaacgagctgtcgtggacgcaggaggaaggcgacgtcaccgcgcggctcgatggccggtatcagttcgagccgttgggggacgacgtcacgcgtgtcacctatgagctggctgccgacctcgtcgttccgctccccgggttcttgaagcgtcgggcagagatgaagatcgtgcacgccgcgctcgaggatctggcgcaacgggttcgccagctcggctccgccgacggatcggcggcgcgcacacccgatcgctcgcattgatcggtcgtgacgcactcgcttcaccactgaatccatcgtccctgaccttcggcgtccctcacgacagggacggccatcggcgcacgtcagatgcactacgctggggttcacagcgacgctgtgcgtcgggtgtgggggagcggagccgtctgggggtgcggaatccatggcgagatgtcgaggatctcgaccgatgagccgatcggggtcgacacacggttcgcagccccgacgtcggcgactcgcgcaggtgtcgagcgcggtgcgcgcatgatcggctgtggggggcccgcgctgggcgagatgatcgatctgggcttcggcaaccccgacctgcctccgcctcaagaggcgctggcggcgatcgcggccgagctcgcgcggtcgcatcctgcacgctacggcgacagcgctgggaccgtcgcgtatcgtgccggcgtcgcagccctctacgagcggcgttggggcgtcagcctcgatcccgacgcggaggtcacccaggtgctcggcgccaaggagggtctgcaccacgtgctggcggtgctccctccgggtcctgtcggggtgccgatgccgagctacccgacgcaccacgaggcagtgctcgtcgcggggaggcccctcgtcggactcgagctcgatcccgacgatcgagacgggcgacacttcatcgagcgggccgcggacttggcccgcgccggccgcgttcgcgcgatcgtgctgtcgttcccgcacaaccccacgggggtcacgacgacgcgcgcgatgctcgaggagttggtggccgccgcggtggaggcaggggtgaccctcgtgcacgacttcgcctactgggccacggtgctggaggagcgcccgagcgtgagcctgctcgagatccccgaggcgcggtcggtcgcggtcgagctggtgagcctgtccaagtcgcactcgatggcgggatttcgtgcgggtgcgctcgctggttctggcgctatcgtgcagcgggtacgcgcgcgcaagcgcgccttcgaccacggtctgtcccaaccggtagaggcaggagccctgtgggcgctgcacgatggcgaccgagcggccgacgagctcgcacgtcggtatcgggtgcggcgcgacgtgctggtggcgggccttcgccggctcgggtgggggcgggtcgcgaatccggccggatcgatgttcgtgtgggcacagcctcggggcggactggacgacgccggcgtgacgcgccacctcgtcgacgagcacggcgtccttctcggtgcgggacgcgacttcggcgccacggaggcggggtggcttcgcttctcgctcatcgccgagcccgaggtgctcgacgaggccgttcgtcgtctcggccagtgcgcgctgctcgggtcggcgtcagcgcccgagggctcgctcgcgtcgtgaggccgtggtatcgaggcgcgctcgctcgaggtaggcgagcacctcgtcgaagtcgtggtggggctcggccagcgtgatgcgcacggcgccggcgaacgacgaggcgagggtgaaggcggcgcctggcacggtgcgcacgccgtgggcggcgagctcgagggcgatgagcgcctcgggatcgggcgggagccatgcgttgacgccgtctcccgtcaggttgcgacccagcgcatcggcgaggcgctcccgtcgggctgcgtaggtggcacgggcgtgctcgaggcgctccgtctcctcgggggcctcgagcatcgcggcgagcagcgcctggaggagtttcggcgaccacgacgggccgaggctgcgcgcgtgctcgagcgcgtcgcgtcggtcggcatcggtgatgatcgcggcgaggcgcaggtcgggcccgtgggacttcgagaagctgagcacgtacgcactcgcgggatggagccctgcgaggctcgccaacagcgtcgaggcgacgagcccggagtgatcgtcctcgatcacgaggacgtcggggcgtggggcgagggctgctgccagcgcatcgcgacgctcgccgctcaccgtcgcgccggtcgggttgtgcgcgcggggctggatgatcaccgcgccaagctcggggcgtgcggcgagtcgcgcaaggtcgctcgggtcggggccctcggcgtcgatcgggaggggccagacgctcaagccgtgggcctcgacgaggtcgaagagcgcgggaaagctcggatcctccacggcgacggcggtcgcgctgggagcgacggtgccgaggagtcggtcgatcgcctcgagggcgccatcgacgatcgtggtgccggtgtccgctcggagctggagggcgggtggcagcaaggggacgaggacgtcgacgaggggtccgaacaccggtgggtccgcgtacgtcgcgggagcgagcggggcgatgcgtgggagataggacacggggtcggggagcaggcgcggatcgggagcgccggtgccgaggtcatagcgtgcgggctggggcggcgtctgctgccatcgccgaggccgacggcgcggtggtgaggcgacgaaggtaccacggcggccctgggccgcgacgagccccaagctggcgagctgtgcccaagcagccgccaccgtcgtcggcgagatcccaaggtccgcggcgagctggcgaacagggggcaagcgcgtgccttcgggaagctcaccggcgcgaatcatggtcgcgaccgtcgaggcaacggtgcgcacgccgatcgtgccgacgctgcgacggcgcagcgctgccaccagggcgtctgccgctgcgtcgtgcccgagatgctccatggccccagcgtagcaaggagcgcgctcgtgattttcgtttgtgtggcacaaccctgtgtcgcgtgccagtacaacgaagtgctaccatgccggaaacggtccggatgctcggaggaagtggaggcggcgatggacctcatcgaacggcatcggcgggtgctcccgtcatggctcagtctgtactacgacgagccgatcgaactcgatcggggcgaaggatgctgggtgtgggacgcgcacggtgagcgctacctcgactgcttcggcggcatcttgacgacgagcgtcggtcacaacgttcccgagatcgtgagcgcgatcagcgaccaggccgctcgggtgatccactcgtcgaccctgtatctgaaccggcccatgatcgagctcgccgagcgtctcgccaaggcgtcgggcattcctgatgccaaggtgttcttcacgacctcgggcaccgaggcgaacgacgcagccctgctcttggcgacggccgccctcgggtcgaaccaggtgttcgcgctgcgcaactcgtaccacggtcgctccttcacggagatcgcggtgaccgggaaccgaacctggtcgccgacgtcgtactcgccgctcagcgtcagctggttgcaggggggttcgaggctgcgcgggccgctcgcgggtctctcggacgccgagtacgtcgcgcgtggggtcgccgacttggaggatgcgctgctgacgacgacggccggacgggtggctgccctcatcgccgagccgatccagggagtcggcgggttctgtctcccgccggatgggtacttcggtgagctgtggagggtgacccagcgcgaggggattctgtggatctccgacgaggtccagaccgggttcgggcgtaccggcgagcatttctggggctacgaggcgcacgggatcacgcctgatctcatcacgttcgccaagggtgtcggcaacggcatgtcgctcgctggcgtgatcgggcgagcggaggtgatggacgcgctcgggaccaactccatctcgacctttggcggttcgccgatcacggcggcggcgggcgtggcgacgttcgactacatcatcgaccacgatctcatggccaacgcgcgtgcgcgcggcgccgagcttcgcgaggggctcgacgcgatcgctcgatcgacgcccgcgatcggagaggtgcgcggcaagggcctcatgcagggggtcgagctcgtctggcccggtacggtcgagccggcgcccgagcttgccacacgcgcgctcgaagcggcacgtcgcgaaggcgtcctgatcggcaagggtggtctgcacggcaacgtcctgcgcatcgcaccgcccatgaccatctcggccgagcagatcgagcacgcactcgaggcgttccggcggtccttcgccgaccaggcattccatgtgaaggagcagtgatggagacgatcgcgcacctgatcgacggcgagcgggtcgaagcggccccgctcggatcccagccggtcctcaacccggcgaccggtgaggccatccggagcgtcggactcggcgatgcgggcctcgtggatcgggccgtcgccagcgcggcggcggcacagcaggactgggccgagcagtcgctcgccgcgcgccagcgcgtcttcttccgctatcgcgagttgctcgtcgctcacaccgacgagctgtgcaccttgatcagtgaggagcacggcaaggtgctcggggatgcccgtggcgagttcgcccgaggggtcgaggtcgtcgagttcgcgaccgcgctcccgcagctgctcaagggtcagttctccgacagcgtctcgcgcagcgtggacgttcgcagtctgcgccaaccgctcggggtcgccgctggcatcacgcccttcaacttcccggccatggtgcccatgtggatgttcccgatcgctctcgccgtaggcaacggattcgtcctcaagccgtcggagcgcgatccctcggcgtcggtgcgactcgccgagctgttcgtcgaggcgggtggtcctccgggcttgctgaacgtggtgcacgggggtccagcgacggtggatgcgatccttgcccaccctggcatccgagcggtgtcgttcgtcggctcgaccccgatcgcacgccacgtctacgagagcgccgctcgttcgggtaagcgggtgcaggcactcggcggcgcgaagaaccacatggtggtcctccccgatgccgatcgcgaacaggtcgtcgacgctgcgatcgcggccgcgttcggcagctcgggtgagcggtgcatggcgatcgcggtgctcgtggtggtgggcgagcagccgggcctcgtcgacgagatcgcggctcggatgggctcggtacgcgtcgggcccgcgacggacccgactgcggagatgggcccgctcatcaccgaagcgcatcgcgaccgcgtggcccgcctcatcgaggaggcggtgtcgaagggggcgaaggcgatcgtcgacggacgagcacacccggctgcggcaggtccgggcttcttcctcggccccacgctgctcgaccaggtggacgtcgcgatggacgcctacaaagaagagatcttcggcccggtgctcctcgtccagcacgcggacgacctcgacgaggccgtggcgctcgtgaaccgcaacccgtacgcgaacggcgcggcgatcttcacgcgcgatggcggcgctgctcggcgcttcgtgcgctccatcgacgccggcatggtcggggtcaacgtgccgatcccggttccggtggcctaccactcgttcggcggcttcaagctgtcgctcttcggcgacacccacgtccatggcgaggagggcgtgcgcttctacacgcgcggcaaggtcgtgacggagcgctggcccgacgaggcgtccgaggcgcgctcgctgcacttcgtgaccaaccggtgaggtcgcgcttcggtgccggctcaccgaagcgctaggctcggcgcctcgtgaagcgggaggagtcatcggcggccgacgctccggcggccagcgagcgcgacatggcacgcggccgaggcgcgcgagaagcgtggcaggtgcccgcgctctcggtcgatgcgttcgactacgacctgccggccgaggccatcgcgcacgatcccatcgagccccgtcgtgctgcgcgtctgctggtggcccgtcgcggggctcccgtggcccatgcgagggttgccgatctcgctcggctcctcgagccgggcgacctcgtcgtcgtcaacgagtctgccgtggtgcccgctcggctgcacctgcagcggagcagcggaggcgccgtcgaagtactcctgctccggcagcttcccgatgggaccgccgaggcgctcgtgcggcccaatcgtagggttcgcgccggtgagcgccttctcgccgacggcgtggaggtcgtcgaggtgggaggcgccctcgaggccgtcgagggcatgacgatccgagcggtgcgcgtgctcgatccggagcgcgtcgcctcgatcggggtggcaccgctcccgccctatctcgggcgccaggacatccccctcgagcgctaccagaccgtgttcgcgcggcgcccagggtcggtcgcggcaccgaccgcgggactgcacctcgacgaggtcgtgctcgccgacctcgcggcgcgcgggatcgacgtcgtgcgcatcgtgctccatgtcgggctcggcacgttctggccggtgacggcggcgacgctcgccggccatccgatgcacgcggagtcctacgaggtcgacccggccacgtgggcgcgcatcgagggcgcgaagcgtgtcgtcgccatcggcacgaccgtggtgcgcacgctcgagaccgtggcgctgacaggtgagttggcgggcgagtctcggctgctcatcgcgccagggtttcgcctgcaggtcgtcgacacggtgctcaccaacttccaccaaccgcgctcgacgctgattgcgctggtcgcggcgatggtgggggatcgctggcgcgagctctactcggtggccctcgccgaggggtaccgcttcctctccttcggtgatgcgatgctcgtcgacgtcgaggggcgtcggtgaggccgtcgttccggatcgacgcgacggacggcacggctcgtgcggggacgctcaccctacgccatggtctggtaccgacgcccgtgttcatgccggtcgcgacgcgtgggatggttcgactcgtccccccggcgaccctgcacgagctcggggtctcgctgctccttgcgaacacctaccatctcgccctccgccccggtgccgatgtggtggcggcgctcgggggtctcagcgctttcaccggcttcggagggcccatgctcaccgactccggcggattccaagtgatgtcgctcggaggcacggtcgatgacgacggagtcacgttccgatccacctatgacgggcgccgggtccgtctgaccccggagggcgtcgtcgagctcgaggagcgcttcggcgtggacatcgcgatggtgctcgatgtgtgcaccatgttgccggcggagcgagcagcgctgcaggtggcgatggttcgcaccaccgagtgggcgcgccgggcagcagcggcgcgtcgagacgaggcccaagcgctcttcggcatcgtccagggtgggtcggaggaggatctgcggcgtgagcacgcgagccagatcgccgagatcggtttcgacggctacggcatcggaggcctcgccgtcggggagtcggcgcccgccacgctcgcggccgtggcagccgccctcgagcggctgccggcggatcggccgcgctatctcatgggcgtgggggatccctacctcatcgcccacgccgtcgagctcggagtcgatgccttcgactgtgtggcacccacgcggcttgctcgccacggcatcgcgctgaccagccagggtcggctcgcgctgcggccgagtcgctggttgggctcggacgagcccgtcgatcctcgttgcgggtgctcgacgtgtcggacggtccctcgagggctcgtcgcgcacctgttgcgtgtcgatgcgcacagcgccggcgcgctcctcagcgtgcacaacctgtcgtttcagctcggactccttcgcgacctgcgtgctgcgatccgtgccggcacgctcgcgggcctggtacgcgccctcgacgaggtctgggcgccgagctggcgaagcgctcggaccgaggccgcgccggatcgctaggctccttgatgagtgcacgtcggaggggtatgagcaagacgcgttggctgtggtcggtggtgctgtcggcgctggtcgcggtggcggcattcatcggtgtcgtcgagctcgctcacgatgggccgatcctcggactcgacctccaaggcggggcgagcgtcgtctaccggcctgctcgaccggtgtcgacggccatcttgaacgagacgatcggcatcttgcgcaaccgggtcgatggactcgggatcgccgatccgtccatcggtcagcagggcaacgacatcgtcgtggagctgccaggagttcgcgatccgcgccaggccttggcgctgatcggacagacggcggtgctgcagttccgaccggtcgagtgtacgtgggctgcgtacgccccgacgaagggacagcacgtctcggccactcggccaccgacgtcgtgcccgacgagcgcagccggactcgccgccgaggccgcggtgccgacgacgccgacgcaggtcgccctccacagccagacggcggtgctcgatcttcgtcagggaacccaggtcgtcggacgctacctcgtggggccagccttgctcgacggcaacgccatcaagagcgtgtacgcggcgcccgacaccacctcctcgaccgggtcatggctcgtcgacttcaccctgacgccgaaggcctcgccgctgttcaatcagatcgcgaagacgttctaccaacgccagctcgcgatcgtgctcgatggcacggtgatctcagccccgcagatcacctcgacgtcgttcaacggacaaggacagatcaccggcaacttcaccgaggcgcaggccaacaaccttgcgctcgtgctgcgctatggcgccctcccggtgcagctggtccagcagacggtgcagaccgtctcgccgacccttggtgcgagcgcgctccgtgcgggcctcgtcgccggcgtcgtcggcctcatcgccgtgttgctctacaccatcgtctactaccgagtcctcggcgtcgtggtcctcgcaggtctcgtggtgacggccgcggcggtctgggcggtcgtcgcctacctggggagggcggcgcagctcacgctcgatctgtcgggcgtgaccggtctcatcgtgtccatcggcctcatcaccgactcctacatcgtcttcttcgaacggctcaaagacgagatccgtgaggggtcatcgatcgggtatgcggtcaaggcggggttccagaaggcgtttcgcaccatcatcgcggccgacctcgtctcgttcatcggcgccgccctgctgtggtacttctcgatcggtcaggtgcgagggttcgcgttcttcctggggctcgcgacggtggccgacgtcgcctccgcctggttcttcacccgaccgctggtcctcatcgtcggcgacgccctcggcaagacgcatccccgatggctcggtgtgggcccggtgcagctgcgcgaacaggcacccgagacggccatcttgcggccacgggccagagtgagtggaagtgaatcatgagtcaggttcgcatcgtcgaagatgcctcacagctcagctggtggcggcgtgtcggggcgggcgcgacgcgcattcgcttcgtcgaacgggcgcggtggttctgggcggtctcgctggtcgtgatcgcggtcggcgcggcggcgctcgggattcgcggcctgaacttcggtatcgattttcgtggaggcctcgcctggcaggtgagtgcgccgacgctcagcgtcacccaggctcgtagcgcccttgccgggctcccgctctctggcaccacggtcgtcagcttggggaccggtcagcaccgaaccatcgaggtggaggcggatctgccgacctcgggtgcgcgagcccatgcgctcgagaacgaggtcgccgctcgactggctgccgcagctcaccagccttcgtcggcggtggcgatcaactacgtcggtcccacgtggggatcgcagatcaccgacgcctccctgaaggcgctcgtggccttcttcgtcggcatcacgctctacatctcgttgcgcttcgagtggaagatggccctggcggcgctgatcgcggtgatccatgatctcgtcgtcacggtcgggatctatgcgctctcggggttccagatcacgccatcgacggtgatcgcggtgctcaccgtgctcggttattcgctctatgacaccatcgtcatcttcgatcgcatcaaggagaacgtcgcgacgcacgtcgatcaggcgggggagatgacctactcggaggtggtggaccgctccgtcaatcagatgctcgcgcggtcgatcaacacgagcgtcgtcgcggtgataccgatcctgtccgtcttggtggtgggggcctacctcctcggtgcgacgaccctgcgcaacttcggcctcgccctcgtggtcggcctgaccagcggcgcgtactcctcgatcgccatcgcatcgccgatcctcgcgttcctcaaggagcgagagcccaggtaccgacagctcaagcgacggattgccgcgcgtcgtatcgcacctgcgaccgaggcggcgggtaccatcgatacgtaggagggggcgatgctcgacgagcggtggttagcggagcgctacgccgacaacccgctcgtgctcgacgccctcgcgctcgcgacgaaggcgcaccacggccagctgcgccggtctggggagccctacatcgtgcatcccctcgcggtggcccgtcgcgtcgccgaactgcgcgccgacccgatcaccgtcgccgcggccttgctccacgacacggtggaggatacctcgatctccctggaggaactcgagcagcgtttcggcgcggaggttgccgcactcgtagacggagcgacgaagctcgaccggctctcgttcgactccaaggaggtcgcgcaagccgccacgatgcgcaagatgctcatcgcgatggcgcgtgacgtgcgcgtgttggtgatcaagctcgccgatcgcctgcacaacatgcagacgatcggcgctctcgggcgcgagaagcagcgccggatcgcgcacgagaccatggacatctatgcgccactcgcccatcgcctcggcatcgaggaggtgaagtggcagctcgaggatcatgcgttcgcggtcctgcatcctcggcgctacgccgagatggagcacctcgtcagtcagcgggctccggagcgcgaggcgcggctccaggcggtcagcgaacagctcgctgccaagctcgcccaagtcgggatcgtcgccgaggtcacggcgcgccccaagcacgtctggagcatctacgagaagatggtgctgcggggcaaggagttcgacgcgatctacgacatcctcggggtccgcatcatcacacacgaggagcgtgactgctgggcagcgcttggcgtcatccactcgctgtgggcgccgatccccgggcggttcaaggactacatcaacgctccgaagttcaacctctaccagtcgctccacaccaccgtcgtcctcgagggcgggagcccgctcgaggtccaggtgcgcacccgtgagatgcatctgcgcgccgagtatggcgtcgccgctcactggggctacaaggagggttctgatgcggccgagctcgcctggctcggtcggctcatcgacctcgacgaagagacgcacgatccggtcgagttcctcgagcacctcaagctcgatctcgggaccgacgagatctacgtgttcacgcccaagggcaaggtcatcaccctcccgacgggcgcgacgccgctcgacttcgcctatgccatccataccgaggtggggcaccggtgcgtcggtgccaaggtgaacggtcggctggtcgcgctcgagacggagctgcgctcgggcgacaccgtcgaggtggtgacgagtcgctccgccacggcgggtccgtcgcgtgactggctcgcgatcgtgcgcaccccgagggcgcgctcgaagatccgccagtggttctcgcgagagcgtcgggaggagtcgatcgacgcaggtcgcgaggagctcgctcgtgagctgcgtcgcgaggggttgtcggtgaccaagcacctctcgggaccgggtcttgcgcgcctggccgagcaggccggctatcgagaggccgagaccctgctcgcggccatcggtgagggccacgtctcggcccggagcgtgctcgccaaggtgcagcgagccgagctcgagcacgacgggttcgagccggcggtcgcgacgccgcagcggcggcgccgtggaggcgggggaccgtcgatctgggtcgagggtctcgacgacgtgctcgtgcggctcgcacgctgctgcaacccgctgccgggcgatgcgatcgtcggcttcatcacccagggccgtggggtcgccatccaccgagaggactgcccgaacgtcgaggcgttgctcgcccaagggcccgagcgcatggtcgaggtcgactgggcgggtgagcacggctccggcttccagatggcgatcgagatcgaagccctcgaccggccgcgtctgctcgccgacgtgtcccgtgtgctcgccgagcaccacgtgaacattctcgcctcctcgtcggggcgcgggagtgatcttgtcgcggcgatgcgtttcgagttcgagctcgccgatccgagccacctgtcgtcgatcctggcgggcattcgccagctcgacggtgtcttcaacgctgcccgagtcgttcccgggcgacgtcgcccacggaccgcgacccagcacgacggccgctgagtcggtcgccgaggcgaccgtgtgtcgcggattcgtcatggatttggtcctacgacgcagcattacggcgtccgtgacgggatattgttgggccaccgacgcatggggagcgtcggaggaacgggcgtgagcccgtccattgctacgacaagggggattgctggatgcaacagcaggcagtagagggcggatcccttcgcagggagatgtccttcgttgatctggtgatggcctgtctcggtgccatcatcggatcgggttggctcttcggcgtgctctatgccgccaacgcagccgggcctgcagcgatcgtcagctcgctcatcgggggcattgcggtgatcttcatcgccctcgtgtacgccgagctctcagggatgctcccggaggcgggcgggatcgctcgctacccggagttcacccacggtccgctggtagggttcgtcggctcgtggggcgcgttcctcgcctacgcttcggtgcccgccatcgaagccgaggcggtggtgcagtacgccgagcactacattccgaagctgaccgggaacaccgcactcgacttcgtcatcgaggcggtgctgttgatcatcttcttcgccatcaacgtctacggcgtcaaggcgttcgcgaaggtgaacacggtcatcacgttcttgaagttcgtcgcaccgacgctcacggtcatcgcgttcttgttcgccgtcggccactggagcaactacacggcgacctcgaccggaggtttcatgccggagggtagcgcgggtatcctcggcgccgtggcgacctcgggcatcgtgttctcgtacctcgggttccgccaggcagtggagctcgctggtgagtcgcgcaacccacagcgtgacgtgcctcgcgcgatcatcacggccgtgttgctcgcggtcgcgctctacacgctgctgcaggtggtcttcatcgccgcgattcctcactccgcgctcgccaagggctgggcgggcctgtcgctgacgtcgccgttcgcgcaggtcgcgtccattatcgggctgggctggctggcggcgatcctgtacgccgacgcggtgctgtcgccctcgggcacggggctcatctacctcggctcgacggggcgcgtcgtcctcggatcggcgcgcaaccgctacctcggtcagctgttccgtcggatctcggacgcgggtgtgccgctctacgcgatgatcgcgacccttgtcgcctcgatcatcttcttgctgccgttcccgacctggcagagcctggtgggcgtgatctcgtcggcgacggtcttcacctacatgatgggtccggtgtcgctgggtgtcttgcgcaagcactacgcagaggcgcatcgtccctatcgcttgcctgcggcctcggtgctctcgccgatcgccttcgtggtgggcacgctcatcatctactggaccggttgggcgacggactggaagctcgccgtcggcctgctcggcggcgttgtcgtgtacctgatcgcctcgagtgctggtcagggggtcaagaagatcgacggggcggcgatccgtcacggtgcgtgggtgatcgtctatatcgtcgcgatgctcgccatggcctacttcggtgcgcaccgcttcggcgcgccgttcgatcacggcaaggggctcatccattatccgctcgatctcgtcgtcgacatcgtccttgccctcgtcttctactactgggcagtggcgtcgggtcgtccgagcacggatacggaggaggccatccagcgtgctgccgagctgcgtcgtcagaccgcggctggcggttccgcagccatgagcggttgagcctcagctcgccattgcgagagggggtcgggctctgcccgacccccttcgtgcgttggcgggccagcaccagccggggcggcggcatggcccctcggtagtatgggcgccgtggaggtctcccggtgagcgtgctcaccgtcatcgtgctggtcctcgccgtcgtcgtggcggtgctcttggtgcttggcctctggcaggtgagcatgctgcgtcgccagatggaggcgtttgcgagcgagtggcgcgaggagatggtccgcatggtgcgcacctcgacccaactcatcgaggaggcctcggccgctcagcggcgggcgcgcgatctcgtcgaggaggccgaggccgatgtcgacgggctcgactgggcgctgcgtgcggtcgtcgagcctgcgcggagcgttcggcgcctgggtcttggggttcggcgcgctcgcgccgtctttcgggagcgtcgtggtggtgaggtgcgccgcgcatgaggcgggtggtgtggctcggtatcggggcgaccctcggggccatcggggcccgccggttggggcgtcttggcgcctcatcggtggatgcgcgggtgcggcgtgagacgcgccgactgcgccgggatctcgcggccgccatcgaggcgggtcgccacgaggtgcgcgtcgccacggcgaacgagcggagccggcgccgcggctcgaggaggagcgggtagtggattcgaatgacctgagacgtgcgtttcgggagtacttcgtcgagcgaggacacgttcccgttccctcggcgtcgctcgtgccgcacgatccgacgctgctcttcacggtcgcgggcatggtgccgttcaagccctacttcttgggcgaggaggtcccgccgtatcgtcgggcgaccagcatccaaaagtgcatgcgcgccggtggcaagcacaacgatctcgatcaggtggggaccacggcccgacacctcaccttcttcgagatgctgggcaacttctccttcggcgactacttcaaggagggtgcgattccctacgcgtggggtctcgtcaccgaggtgctcggactcgatccagaccggctctggatcacggtgcacacgagcgacgacgaggcggagcgcatctggatcgaggcctgtggggtccgcccggagcgcatccaacgactcgacgaggacaactggtggcagatgggggagacagggccgtgcggtccgtgctctgagatctactacgacaagggcgagtcctacggcgcgggcggtgggccggcggtcgggtccgacgagcgcttcctcgagatctggaacctcgtgttcatgcagtacgaccgccacccggacggttcgttgacgccgctgccggcaccctgcatcgacaccggtgccgggctcgagcggatcgtgccggtgctccaggggcacgactcggtcttcgagaccgatctcatgtggccgctcatggaggaggcacagtcgctgacgggccgacgctacggcggtcgcttcggtgcggacgccggtggcgacgtcgggctgcggatcatggccgatcacgctcgggcgacgacgttcttgctcgctgacggggtcgtgccgacgaacgaggggcgtgggtacgtgctgcgtcgtatcatccggcgtctcgtggcgcgcgcgcagctgttgggcgcgaagggtccggtcgtcgagccgatggtgcgcatgaccgccgccgtgatgggcgaggcctaccccgaggtggcgcgcgagctcgagacgatcgtgcagcacgcagcgcgcgaggaggagcggttcgcggcgacgctggcgctggggcgcccgctgctcgacgcggccctcgagggcggctcggttcccggcgcgctcgcgttcaagctccacgacacctacggtttgccgatcgagctcacgatggagctggcggccgagcggggggtgagcgtcgatcgtgccggtttcgaggaggccatggccgcacagcgcgagcgggcccgccaggccgggctcggtaccgaggccgtggagcacccggtgagcgccgaggtgctgcgcgagcacggccggagcgagttcacgggctacgaggccaccgaggacgaggggcgcctgctcgcactcgcctccgaaggcgacgtgctcgtcgccgtcctcgatcgaacgcccttctatcccgaaggtggtggccagctcggtgataccggcacgatcgagggggatggctttcgcctcaccatcatcgacaccgaccagcccgtcgcgggggtgatccgccaccacgtcggagcggtcgagggcgagccggtgatcggggcgttggtgcgggccgtcgtcgacgcggagcggcgcgagggtcttcgggtccaccacacggcgacgcacctgctgcactgggcgcttcgcgaggtgctcggtccgcacgtcaagcaacaaggctccctggtcgcaccggatcacctgcgcttcgacttcacgcactggggaccgctcacgcccgacgagatcgaggagatcgagcggcgggtcgcggccgagatcatccgcgactcggtcgtcacggtggagctcatggatcgcgacgaggcgatccgtcgcggtgcggtcgccttcttcggcgatcgctacggcgacgtcgttcgcgtggtgcacgccggtgagtcgtcggtggagctgtgcggtgggacgcacctcgaccgactcggccgcatcggccacctgcgcatcacgtccgagagctcgatcggcgccaacacgcgccgggtcgaagccgtcgtgcagctcgccgccctcgaggtggcacaccgcgatcggcgactcctcgacgagctcgagcggatcgtcccgggcggacgcgatgggatcggcgagcgcgtcgatcgcatcgtcgagcgtgccaagcgcgccgaatccgagctcgcgcgtgagcgcacgcgcaccttggctgagcgcgcccgcgcgctcgccgagacccggggggccgacggactcgtggtggcgcgcgtggacggtcttgaccagcggggggttcgggagctcgcgatgctggttcgtgaccacgagggcgtgctgggcgtcgtgatcgggggcgtcgccaacggcgtggtcgcactcgccgccgcggtgcgcgagggcgctccctggcgtgccgacgagctgctgcgccccgtcgcgcaggcggtcggtgggggcgtcggtcgagccgaggtggtggcggtctccggtgggcgccgtgccgaagcccttgacgcggcgctcgaggcggtgcggacggcttcgtgagcgaggggttcggcggccgcgctctcggcgtggaccttgggacgaagcgcatcggcgttgcggttgcagagggctcgctcgcgctgccgctcgaggtcatcgacgcgcgggggccgtggcgtgcgaggctcgccgagctggtcgcgtcggtcggtgcgagcgtcgtggtcgtcggtcttccgatcggcctcgatggatcggagggtcgggcggccgcccgggtgcgccagtggtcggaaggcctcgcggagcacctcgaggttccggtcgtgttcgtcgacgagcgcttgtcgtcgcaggccgccgagcgtcgtctcggggccgccggtgtcgacgccaggtcgcggcgcggtgcggtggacgcctttgccgcgaccgagatcctcgagcggtggctggtgacgcagcggtgagagggtggccgaagcggctcgtcgctctcgcgctcgtggtggtgctcgcgctcggggcgatcggggtcgcgtatctcgccgaggcggcgccgagctcgtcgggtcacgaggttgcggtactcatcgagcccgggacgtcgctcgagggggtgtcttccctcctcgcgcgcgagggcgtcgtgcgcaacggcacgttgttcgacctctacctgcgccttcgcggatcgccgacggtggatgcgggggtgtacttcttgcgcaccggggagggctacgccggcgcactgtcggccctgacggcggggccagcaacggtacggctcgtggtggtgccggggatgacgatcgctcagatcgcagccaggctcgccgcactgccggaggccggtcacaacgggggtgcgttcgtcgcggcagcgtctgccgtgcacagctaccacaatcccttcctgcgcggcgcgaggtcgctcgagggcttcctctaccccgacacctacttcgtcgatccggcccagacgccgcacgagctgatccaggagatggtggatcgcttcacccaggaggccctcggcgtgggtctcgagccgggggggacctaccacggtctgagcgcctaccaagtggtcatcgcggcgtccatcgtgaccaaggaggccacggccgcgtccgatgcccccaaggtggcccgcgtgatcctcaatcgactggccgcggacatgccgctcgacatggactcgaccgtgcgctttgcgaccggcaacgagaacgcgccgctgacggcggccgaactcgcctcgccctcgccgtggaacacctacacccatcgagggttgccgccgaccccgatcggtcagccgtccgtggccgccatcgacgcggtgctccatcccgccaccggaccgtggctgtacttcgtcgcgctccgcgggcatcggaccgagtcgttcttcacgacctatgccgcgcagcaagcggcgatcgcgcgctacggagaggccgggtgaggcgcgcggatcccgaactcctcggggtgatcggccatccgatcgcccacagcctctcaccagcgatccacgccgcagcggcccgcgccgagggtcgtcgcttcgcctaccacgccttcgacgtcgagcccgctgcgctcgcggcagcgatcggggggcttgtcgtgctgggagcgcgcggggtcaacgtcacggtgccgcacaaggttgccgctgctgcgctcgtggatcgactcgagccggaggctcgggcgacgcggtcggtgaacacgatcacgatcgaggacgacggcacgctcaccggtgcgacgagcgacgtcgagggcgtcctcacgtccgtgcgcgacgatctcggtctcgaggtcggcgggttgcgcgtcgtggtcgtcggggcaggaggtgcggcgcgcgcgacggtctatgcgctcctccaggcgggtgcggcctcggtcggcatcctcgcgcgcgatgtggcgcgcgcggccgagctcgctcggagccttggcggttccgtcgtcaccgcccatgacgacggggcggcggcagatctcgtggtccaggccaccagcgtgggcatggcgggcggccccgatcccgcgggatctgcggtgccggactggctcctcgatcgtgccggcgcggtgctggatctcgtctatcgcccgagcgtgacgccgcttctcgaggccgcacgccggcgcggacttccggcggccaacgggttgacgatgctcgcggcgcaggcgcgtgggtcctatcggcgttggttcggcgacgcaccgagcctgtcggtcttcgtcggcgcggcccgcgaggccgccgccgagggctgaggcgatcggcgcgagccgcgaacgggctcgccgaggctgcccgggcacgaccggttctggccgtgcgcgcctcgcgtgatgtcacagtcgccccagctgcgcggagcgcctcgactgccctgtcagcgggtcagcgtcgccgagccctgcggtgctcagtcgttcgtcgatgcgtcctggttggcgtcgtccgagacgagtgccttggcctcgtcgagggtggtgtcgggtgcggggacgacgacctcggccgtcacggcgggatcgtcggtcggcgtgccgttcgtccggacgagctcgatgacctgtgcgagcagtcgcgtgaacccgtcggcgtcgtcgtgatcgagggcctggtcgagcgcgtcgtcgagtccgtcgagcgccggtcggagcgaggcaggcacgaggtagacgtggtccgacaagatgcgcaccgccaccgtggcggccgacgtcccgggcgccgggggtgtcgcgggcgccggaggtgtcgtggcctgtgccggctcgctggccgcgatcgccgcgggcgctggcggtgctccgatggcgttcgtctggtccgcaggggcggcaagctccgccttgatctgggcgagctgcagatcgacgtcgttgccctggttgccggccgcgagggctgcctcgatgtcgtccccaccaccgccgagcgctggtgagtcgaggaccccggagtccgccagttcgccgacggcggcggagcgcgcttgcatctcggagatcttgtccttcgcgcgatccatcatcatggtcacgtcggtcatctgatccgacaggccggtgaggccctcgagcgcagcggtggacgccttggcggcggtgtactgcgccttcatggtgtcgcgttgggcgcgaaacgcctcgatcttggcgttgagttgccgtccggtctcctcgagcgcggcctcctgcttggccagctgctcgatctggggcgtgagctggtcgatctggggcttgatggtgctcgcgcgctcgagggcgagccttgccacctgctcctggccctgctgcacggcctggcgcgcctgtccttgcagcttgtcgtactgggcctggagctgggcgcgctgagcctcgagtcgcttctgggacgtgaggacgtcggcgatcgacttacgaacctgctggaggttctcgagcatcttctggtaggacaggtcgagcgcctgggttgggtcctcgaccttgttgagcagtgcgttcgacttctgctggaacacctggctcacacgcttgagcaggcccattggcatctccttcgatgagacccacccgcgcgccacggttcgaggcgcgctaggctccacagagcatggtagcagcagcgacgcagcgttcgtgggccgtgcgcttagcgttctcggtgcctgcttgcgttgcaacgcccaaggcctgaggaggtgctctccatggcgacatcgctcgcccccagatcccgcgggacgacgtgggcgcgccttcgcagctacgacgcgctcctgtggttgctcgccgcggccgtgggcgtcttcggtgtcgtgatggtgtactcggcgacccggaaccaactggaacttgctggcctctcgccgcactactacctcgatcgtcaggcgatcttctgggtgctcgggctgatcgtgatgagcgtcgtcgccgcgctcgatctcgagtggctcggtcgtctcggctactggatctacggtgcggtgctgctcggcctcgtggccgtgttgtcgccggtcgggtcgtcggcgctcgggtcccagcggtggttccagctcggcccgatccaggtgcagccgtcggagttcgcacccatcggcgtgatgttcggtatcgcggcctatctctcgggacgcgatggaccgcggacgtggcgcgaggtggccgtggtcctcgcgctcgggggtgtgccggcactgctcgtggtgaagcagccggacctcggcaccggcatcgtggtcggtatcgtcaccatggtgctcctcgtcatgggtggcgccaccggtcgtcagctcctcgtgatcctggttgccggggtgctcgggatcatcgccgtcgtgcacctcggtctgctgaagcactaccagctcgagcggctcctctcgttcgtgaacccgcagtcggcgacccagacctacggctacaacctggtccagtcgaagatcgccatcggttcggggcacatcttcggcaccggcctcttcaaggggagccaaacgaacctcgcctacgttcccgagcagcagaccgacttcatcttcacggcggtgggcgaacagctcggcttcatcggtgccggttcgctcgtgctggtgtacggcatcatgctggccaggtcgtatcgggtgctgcgttcggcggcggatcgagtctccatgctgctcgtcgccggcgcgatcgcgtggatcggattctcggtgttccagaacatcggcatgacgatcggcatcatgcccatcaccgggatcccgttgccgttcgtctcctacggcggctcggcgatgctcggcttctcctcggcggtgggcatcgtgctctctgccgggtcgaggcgactgcgacgtgccagctgaggagccgccgcagaccgaaggcgcgcccctcgtcgtctgcgacgttgcgagggtgcacgtcgccctcccggagccgttcgcgcggatcgagctcgtgtcccgtcaggccgagcacccgggtcggttgtcgttgccggtgagcgtcgagcaaggtcgtgccgtcgcgctcgcccttgcgcgccgacgcgcaccgcggccgttcacccacgaactcgcctccgagatcgcccacgccgtcggggccagcgtgttgcgcgcgacgctccacggctccccagaggggggcgagtccaccttcgcagcgacgctcgagctcatgggggccgatggttgtcggcacccgatcgacgcgcgaccgtcggacgccatcgttttgtgtctgctcgaggccgtcccagcccccatcctcgtcgaggcaccgctcctggccggcccacccaccgacggctgacgtcgacggttaggacgccggccagtcgagcccgagatccaggctcggtgccgagtgcgtgatccacccgacagcgaggtagtccacaccggtgagggcgacctcgcggagccggcccggacgcaggccgccggaggactcgagcttggcccgccctccgttcagacgaacggcgtcgcgcgtggcctccagggtgaagttgtccaggagcaccatcggcacgtcgagcgcgagtgcctcctcgaggccgtcgaggtcgtccacctctacctcgatgggaaggtcgccgaagcgctgacgtgcggcggcgacgaggtgctcgaggggtgcctgggcgaggtggttgtccttgagcaagatggcgtcgtcgagactgaaccggtggttctcgccaccccccgcacggacggcggccttctcgagcccacgcatgccggggagggtctttctggtgtcgcggagccggcagcgggtgtcggcgatctcggcgacggcccgggcggtcgtcgtggcgaccccggagagatgggtgagcaggttgagcatggtgcgctcggctgcgagcaggacacggttcgatccggcgagctcggcgatgagctgcccgggctcgagcgcgtcggcgtcgtgtgcggaccactcgatggtgggcgcggccgcaccgaggcgcgcggcggtggctcggagcaccacctcggcggtgttggacccggcgaggacgccctcgtcgcgggcccggagctcgagtcggacggtccgttcgggcaccaaggagccggtgatgtcgccacgctcgccgaggtcctcgtcgagggcgagcgcgacgaggcgttccaggctggaggcgcggagcgccgtcatgggcgcagctcccgggtgacgcggtggtcggcgtcgaccgcgagctggtagtggggatcctcgtcgatcgcgtcgcgacgggcatgcgcgcccacgctgccgcgacgggccgccgccccagccagcatcgcaccgacgagccacgtcgccccagcctcgctgggatcgccgctcgactcgccagtgaggccggcggtcttgatcgtccggtacgccgcggcgagcgtgtccccgtcgcgcagcggaccgagggcgagggcggcaagggcgcgcagacgcgcgagtgggagtgcgggacggcgcacggggcgtggtagagccgtcggcaggggtgtcgggcgcggcaggtcgccctccgtgatggcttcgccgacacgccgtcccatgacgacggcctcgaggagcgagttcgaggcgagccggttggcgccgtggagtcccgtgacggcgcactcgccgacggcgaagaggcccgggaggctggtcgcgcccagctcatcggtcgcgatgccgcccatggtgtagtgcgccgcgggacgcaccgggacgagctcgcggagcgggtcgaggccgagcgtgcgagccgcggcgacgaagctcgggaagcgatcgacgagcgatggcccgatgggccgcgcgtcgaggaaggccggggtggcgtgcacgctgaggtgcaaggcgagctggtcgcgggtggtgagttcgcgcgccgggaggtcgtcgacgagggacgtaccgtcggcatcgacgaggagggcgccggccccacggagggcttcggtggcgagcgcgaagggcgcacgtgggcccccgatggcggtcgggtggaactgcacgaactcgaggtcgaccaccctggcacccgcccaggcggccgcggcgatgcccgtgccgagattggtcggggggcaggtgaaggcgtcgaagagcgcgccggcccctccggtcgcgagcacgacgcgacgagcggcgatggcgtcgaggcgtccgtcggcggtgcggacccaggcgccgacgacgcggccatcgagcgtgatgagctcgacgagcgtgccgtcgaggcgcgtgatggagccgagccgagggcggagcgccgccatgacggccgcaccggtggcgtcgccggccgcgtggcggatccgtgcgcgccggtgaccggcttcaaggccatagtcgggtgcgaaggccacgccctggtcgccaagccagcgaatcgcgctcggtccgtcggcgaggatgctcttcgcggcgcgctcgtcgaccaggtgggcgccggcgtcgatggtgtcggcgagatggtcgccgatgtcggggccgtcgacgggggctgcgatgccgcccttcgcccagtcgcttgaggtcgctgcgcctcgaggtgcgacgatggcgacgcggagcgtgggcgccacgctgagggccaccgaggctgcagcgaggccgtcgcctatgatcacgacgtcgaagctgctcaccatggtcgcaccgtgggatcgagcatcgcgagtacgggtcggcgtgcggcctcggcgacggccggatcgagtgtgacctcgccctcgttgcgctcgagggcgccgaggagcagctctggcgtcacccgctgcatgtaggggcacgtggcgtcggcgcgcagcggttcgaagctgatcgagttctcgcgccggagctggtggagcacgcccgtctcggtggcgacgatgacgcggcggtgctgctcggcgcgggccgcctcgatcatctgcgtggtcgacaggaggcgcacccgttggcgccacgggtcgtcgacgagcagggcgctggtggtgcagccgcactcggggtggacgtagacgaccgcctcggggtcgtcggcgagcgcggtctcgagggcgccgggctcgagcgcggcgtgtacgtgacactcgccgtgccagacgtgcatgcgttctcggccgagcgtacgcttgacccacgagccgaggaagacgtcagggaggaagaggacctcgcggagggtggggatggaggcgaccacctcgagcgcgttcgcgctcgtgacgcagacgtcggcgagcgccttcacctcggccgaggtgttgacgtaggcgacgacgatggcgtcgggatgggcgctgcgccactgccgcaggtcgtcggcggtgatggcctcggcgagggagcagcccgcatcgtgtgccggcaggagcacggtcttcgtcggcgacaggagcttggcggtctcggccatgaagcgcacgcccgcgaagacgatccgccgtgccggatgctcggccgcgatgcgggagagctggagtgagtccccggtgacgtccgcgaggtcctggacccacggtggctggtagttgtgtgcgatcaggagtgcgtcggtggcgagggccttcgcggcacggaggcgctcgaggacctcggccgagggagtgggcccgccgacaccgagggttggcttcgtcgcggtcgatgcggaactacttagtctcatcaagagacaaagttagtgggtgacgccatcgccacagctcggctggtcggccggtaccggtacggatccgaagtccgacgggctcgatcagcgtggactcgacgaggcgcctgcgcgcgttgggcgcgtggacctgttccccggtgagggcctcgatgcgcccgatgagcgcggggagagtgaaggtggcggcgaggagcggggcgaggacgctcgttcgatcgaggaggtcgcggaggaggagcaggccacggccgacgagggcgagttcgtcggcggtgagcgtgctgggccgcgggctgcgggcgctgcgatggtcgagggccggcatgaggtcatagacccggaggcggtcgacgcccgaggcgttcgaggcgagcgaggcgaggaggccgacctcggcgtagcggatggtgctgggatcggcggctgaagccgtgagggcatgcgtcggcccgggatcgagaccgacacgagcgtggaaccagtcgtgcagcgcatccgtgagatcggcgcacggaggtgcgagggtcgtcgtggggaggtggccgtcgagggtcaggaccacgggatcctcgccctcgacggtgagcgcgatcagggtggcttcgaggcgccagcagggcgtctcgttcatggttgtggcaattcctgcaatttgcttgacaatagcgccgggctgtggcatgctccatatgcgcaggtgcgcatatggcaatgctccgagcgtccggtggaggaaccggggcgaggagcggagccggcggggacggtcgacatcggggctgggaacctcccgatgaggtgccgtcgtcggtgtcgtacctcgcgcaggcaccggggggtgcatggatcgcaagatccgaggtgcgtgttgtgacaaggggggactcgtggacgaaccagcagtggtcttggactgcaccggcctgcagtgtccgatgccggtgatcaagacgtcgaaggcgatcaaggacgtcgaggtaggggcggtgctcgagctgctcgcgaccgatcctggcgtcgagccggacatgcaggcctggacgacccgtacgggcaacgagctgctcaaggtcgaccgtcaaggtgacgtgttccacgtcttgattcgtcgcgccaagtagcgctgcgcggtcggtcgcggtccgagcgaccacgtggcgggcacgagccgtgtggcgcgaaaggctgcgtacggtctcgctccgcgcgtgatcggtgctcacgcgacggcgagctgcgatggtggcgtctcttgctgggcgtgcgcgaccaccatgacgggttcgcgtccatggaggtggctggccctcacaatttccgtcagttccgtcagtcgagtcgctgcccgcgaggcgggccaggtggtgaggaggcaggcatgtggaccaacgagggtgaaggaaagatcgtctacgtccagacgcacgggatcaacgatccagggcgctcggcgacgccgttcttcctcgctgcctcggccgcggcgatggaggtggaggtcggcatctacttcacgatgtacggtccgcagctgctgcgcagggacatcgtggacaagatcggaccgaagggcgatcgcgggcagccgctctcgtacttcattcggcaggcgaccgatctcggcgtgcgtctgtgggtctgtcagccttcgctggacctgaacgacctcaccctcgaggagctcatcgacggtgtcgagatgatcggcggggcggccttcaacaacctggccatgaccgctgacgcggtggtgtcgttctgatgcccacgttgagtgccgacccctacctgaagcgttccgacgccaccggctatggcgaggtcgatcgtgcgaccaaggaacgcctcatcggcgaggtgttcgaggatccgcggtttccgcactacctctacgggtgctacgagtgcgggatctgcgtggcggcgtgtccgtcggccaggttctacgacttctcgccacggcgcatcgcgcaagctgcggccaggcgtgacgtggagctgctctatcagcagctcgaggaggacgtctgggagtgctcgcagtgtttctcctgcctgcgctgcccgcgaggcaacaaccctggaggcatcgtgacgatcatgcgcgaggtggcggtccgtgagggcctggcgtcggccaaggaggcgctcgcgggctactcccggatcatctacaagatcatgtcgacgggcacgcaggtctcgcccgacatgctccagcccgacgccttccccgactggggaccggaggtcaaggacgtctcggtcaacctcgacctgtggcgtcggatgctgccgcccgagacgatgcacaccaccaccactgggtggcaggtcgccgatcggacgctcgtcgagctgtacgtcatctggttggaaacgggggcgctcgacatgatcgcccaggtcgacaaggggatccacatgatcctcgccgaactcatggaggagcgactcgaagaggagggcatcgagctatgaccacgagcgctgtcaacgtcatcctgtcgcgcaaggagcggttcgagcgagagcccgatcgccgctccgaggacttccaccatcacctgttcgagctcgaagccgagggcgaactggtcgtccagcgcgtcgccggggaggtcgtcgaggtcccgaccaagtacgggatcgccaagcggatcccgaaggctcacctctggcatcacaagtcgtgcggccagtgcgggcacatcccgggctactcgacgtcgatcttttggatcatgcgcaagctgggctacgactacctcgatcccgaggatcagacgagctgcacggcctggaactactacgcctcggcgacctcgaaccaggccgcccaggccgccgtcgccgtgcgcaacttcgctgcggcgtacgagaccgggttcttcccactgatccactgcggcaccagctacggccactacaaggaggttcgctccgagctcctgcacgacgcggcgctgcgtgcccaggtgcgcaaggtcatggagcgactcggcaagcagctcgtgctgcccgaggagatcgtgcactactcggagtggctgtacgcggtgcgagacgagatcgcccagcgggcggttcgggacgtgtgcaacgtcgccgttacggtgcatccggcgtgccactactacaagctggtcgagggcgacgccatctacgacccggatgtctaccacggtcagcgcacggcggcggtgtcaggcctcgtgcaagccctgggggccgaccttcggagctactcgacgttcttcgactgctgtgggttcggctttcgccacatcctggtgcagcgcgacttcacgcggtcgttctcgacgctgcgcaagatcgaggtgatgcgagcggaggccgaccccgacgtcgtgctcacccacgacaccggctgcgtcacggccctcgacaagagtcagttcgcagcccaggcgcacgagcgcaacgtgggcgtgccggtgatgagcgaggcgcagttcgccgcgctcgccatgggcgcccatccgttcaaggtgtgccagctgcactggcactcgaccaactatcgaccactgctggagaagatggggatcgactggcgggccgcgtgggccgagttcgaggaggacgccaagcgcctctcggacggtcgtcagcagttcctgacctgggccgacgtggatgcgtgaggggggtacatggatcgaattgtcgtgatcggtggtggcccggcgggcctgtcggcggggatcgccgcggcggagctgggtgcacccgtgacgctggtcgagcgcaacgccttcctcggtggacggccggtcgaggagaactacgcctctatcacgccctatctcgaggacgcggcgatggtgatggggcggatggaggagcggctccgggccgccggtgacgtcgaggtgctcttgtcgtccgaggtggtgcacgcggccggtgacggaccctacgggctcaccatccgtacacccgatggcgaacgagtccaagaggcctcggccgtcgtggtggcgacgggcttcacccacttcgatccgggccgcgagacgcagctctatggctactacgagttcccagacgtgatcgcgctccaggacctcgaggccatgctgaaggagcaccacgtcgtgcgcccctcgaacggggaggccccgcggcgcgtgtgcttcatccagtgcgtcggcagccgcgatcgccagatcggcaacgagtactgctcgaaggtgtgctgcggtgtggcctcgaaggaggcgatcgaggttcgccagctcctgccggattcggaagtgttcatcttctacatcgacatgcgcatgtacggctactgggagcgccagctctactggccggcccaggaagagcaccacgtccagtacgtcaagggcatcgtgaccgaggtcctgccgaaggacgggcgcctgctcgtgcggggcgaggacaccaccatgggtcggccgatggagacgctcatggatctcgtggtcctgtcggtgggcatggagccctccccgggaacccgcaagatcgccgggatcttggggctcgcacagaacaagttcggcttcatcgaggcccagcagcccccgctcgacacggtcgggacgtcgcgtcccggtgtgttcgctgccggtgcggctctcggaccgagcgatctcgaggactgtgcctcctcgggtggcctcgctgcggcacgcgccgtcgcgctgtggcgtcagcaccagaccgtcggcgcgcgatgagtgtcgtgagctcgcagctgtgcgacctcgagagcgtgcgtgcgttcttggaggctttcgacgagcaagccgggagcgcgacccgcgctcggctcctcgagcgggcgcacgagcgtcgagcacgggtacgtcgagcgctcgagctcggtgacgccgatctcgtgctcgagacccaagtggcgagtcggcggcgacggcggacgctcgctgggctgcttgcacgagacgagctcgaagcgctctgtcgcgatgtcgcagccggtatgggcgaggcacgcgcgctcgaggacgatcctcggcgcgaggttgtcgagttcgttcgcgagctcgtgcacctgtgggaccctgcgaaggtcgcgctctggacgtcgtgggtctgggcccccgacgacgagaccggcgcgctcgcgctcatggtggaggacccagcggcgctcctcggtgccgacgatgccgaggtggccgcgcgggtgggcgaggcgagtcgctacctcgccgccgtgctcgaggcggcggggctcggtgtcgacgctgccgatccgttgagcttcgacgtggcggccgctgccgtctgggccacctacgcggtgacggtggtgcgcctgcgcatgaccaaggagttcacacagctccttccgccggccgctggctttgcggaacgagcactgggactagcgagggagggctgatgccggtcggagggcgcaaggtggcgcctcaggtggtcgaactcgaggaggccagggtcacctcgaccatctcaggcagggagtgggacgtctcgggcggcccgagtcgcatgctgatgccgcgggtgctcaccgactacacccagcgcggcttcgaggcgatccgtgcgctcgccggtggcgagagcctcgagtggtgctacggctgtggcaagtgcgtaccggtgtgcccggtcgatctcgtgggcgagtacgggccgcgcaagctccaccgcatggtccagaccgggacgaacctcttcgaggccgatcagctctggatgtgcacgacgtgcggcaactgcctgcgcgtgtgcccgaagcaggtcaacatgatccagatcatgccggcggtacgcgaagtggcggtcgccgacgggaccatcccgaccgagctccaaggggtcatggagaagaccttccgctacgggaacgccttgggcgagaatccccggcggcgccatgcctggacgaagggcgcgggcgtcccggtgcgggtgctctcgcaggatccgagcccggtggacgtgttgttctacgtcgaggactactggagctaccacccgcgcggacagcaggcggcacaggcgttcgcgcgtgtgctgaacgcggctggggtcgactttgcgatcctcggcgccgaggagaagaccatcggcgactcgcagcggctcgccggcgagaaggggctgttcgaggccctgatggaggacgtcgtggcgacgctcgagcgctacgagttccgacgcatcgtcacgccggacccgcacggcttcaacgcgctcgtgaaggtgtacccctcgtatgggcatcactacgaggtgctccactacacgcagctcctcgcgccgctcatgtcgtcactcgagctgacgaacccgatcgacgcgaaggtgacgttccacgatccgtgctacctcgggcgtcacaacggcgtctacgacgcccctcgcgaggtgctgcgagcgatcccggggctcgagctgatcgagatgggtcggtgccgtgagaactcgtactgctgcggtggcggtggcggcggcatgtggctcgacggcttcaacggcaaccacctctcggagcgcctgtcggagcgacgggtgcgcgaagccgcggcgaccggtgcggacatcttggctgtgtgctgcccgtacgaggtgtcgcgcttcgaggacgccgccaagtcgaccgggaacgaacatctccgcgtgctcgacatcgccgaactcgtggacatggcaatggcgccggcgctcgctggccaggttgggtgaaggaggggggatggacatcgtcgtcgtggtccgtcagctggcggacctcgtggaggaactcgaggtcaacgacgagggcacggatatcgaccgtgacttcgtgaagttcgtcgcgaacgagtgggacgaggccgcgctcgaggaggcgctgtgtctcaaggaagcggtcggggggaccgtcaccgtggtggccctcgacgagccggacgtcgaccagacgctctatgccgccgcggccaagggggccgaccgggtcgtcaagctgaccgggcacgatcccgacggctgggtgcgcacgcgcgagcgagccgctcgggtcgctacctggctccgtgatcagcatccggacgtggtcctgacgggcgtccaggcggccgacgacctcgacgggcagatggcgggcgtggtggctgcgtatctcggatggccgcacgccgccgtcgtggtggtggtcgaacccgccggcaacgagctcaccgtgacccaggagctcggcggtggcacggtggcgacctcgacgctcgccatgccggcggtgctcgggatccaggcggcgcgccaggcaccgcgctacgcgcccatctcgaggatccgccaggcgcagcagtcgacgaccatcgaggaggtcgagatcgacgagccggcgatcggcgccgtcgcatccgtgcgtcgtctgttcccgccaccgtcgcgcggtggcgctgagatgctggaggggtcggcggccgaggtcgccgacaagatcgtggagatcttgcgggcccgcgggctcgtgcgcgcgtaaggggggttcagatgtcggtggcagtgttggtggtgagcgagcgggtcgtcggcgaggttcccgacgtcacgttcgagctgctcggcaagggccgtgagatcgcctcggcactcggtggcgagctcgccatcgcggtgctcgggcaccaggtcggcgagctcccgttcggggcagccgacgtcgcctacgtggtcgacgatcctgcgcttgcgaactacgcggcgagcgcggtcgaggcagcgctcgctgccgtcgtcgaggccgcgtcgccaaaggtcgtgctgatgagtacgggcacggtcgggctcgatctcgccgcgtcgctggcggctcggctcggcgcgccgatggcgtcctatgcggtcgacgtcgcgacggaaggcgacacggtggtcgcgacgagtcagctctacggcggcaagcttctcgcagaggtcgccctcgagggctcgccggccgtcgtgagcgtgatccccggcagcttcgcggccgatgcgggtcgcgtcgggggtgcgccgcgcatcgagaccatcgccgtgtccctcgatggtgctggtgcacgaggcgagggtgtgcgcgagcccgaggcgagtggcgtcgacatcaccgcagcggatctgttggtgtccgtcggtcggggcatcggctccaaggagaacctcgagctggtccaagagctcgccgatgcactcaaggtgccgctcgcggcctcccggcccatcatcgaccagggctggctccccaagccgcatcaggtcggcaagtcgggcaagaaggtcaagccgcaggtctacctcgcgctcggcatctcaggggcgcccgaacacctcgaaggtatgcgctctgccgggaccatcatcgcgtgcaacaccgatccgaaggcgcctatcttcgaggtcgcacactacggcacgacggtggatctgttcgatctcgtgccggagctgaccgagcggctctaagggtgagcatggtcgcgctggttgagacgaggccgatcttcggcggagagacggagacggccaagctcgtgttctacgcgctggcgctcatcgtcatcgtggtcttcttctgggggctcgctcggcgagtgcgggcatggtcgcggggtcgccggcccgccggttggcactggctccgtcggcgagaccctgccgacatcgccgacgtcaccgagcgtccgaaggtcgcgtcgtcggtcgcggtgatcgcagccaacaagacggtcacgaagacgaagcactcggtggggatggcgcacctgttggtgttctggggcttcatcggcctcttcgtcgccacgtcgatcctgtcggtcgactacgacatcctcggcaacctgtcgcggctgatcgtcggccacaccgtgagcttcttccaaggtccgttctacctgggctacaacgcggtcttcgatcttgcgggcctcgcggcgatcgtcgggacgctcctgctcgcgctgcgacgctggttcagcccggagatccaactcgacctgcaccgcgccgagcagcccgagggaggctactcgcgcgcgaagatcgccctcggcgaccaggtgttcatcgtcgggctcttgctgatcctcctcaccggtgtggccatccaggcgctccgcatcgatggcgagggctttccgagtttcgagcgctggacctggctcgggtggctggtggcgaagctcttcgtgagcctgggtgtcggtcgggttgcggctcgtcacatccacgcctggctctggtgggtgcacgtcgggatggcactggcgttcatcgcctacatcccgttctcgaaggccctgcacatgctgtcggcccctgccaatctcatcgtgcgcgatcccaagcaggttcgccagctgccgccaccgcccgagggcaaggtgggctacagcgagctcggcgacttcacgcccgccgaattgctctcgctggacgcgtgcaccaaatgcggccgctgccatggcgtgtgcccggcgcggaccgccggcgcgcccctctcaccccgtgacctggtgctggatctgcgttcctggctcgatcgggcccaaggcatcgagctcctgctcgactcggaggatcggcccaccccgaccggcccacgggccccatcggggccgctcgcaggcaacgtcgtggccgagcgcgtgctctggtcgtgcacgacgtgcatggcgtgcgtcgaggtgtgtccggtgggcatcgagcacgttccgctcatcgtccaactgcgccgccccctcgtcgacgctggccagatggacccgacgcttcagagcgcgctccagaacatcgcccagcaaggcaactccttcggcaagtcctcgcgtatgcgggcgcgctggaccaaggggctcgagacgccgatccccgatgcgcgcaaggagccggtggagtacctgtggttcgtgggtgactacgcctccttcgacgagcgagtcgcggagctctcacggaccttcgctcggatcttgcagggagcgggcgtctccttcggcatcctctacgagggtgagcgcaacgccggcaacgacgtgcggcgcgtgggtgaagagggcctgttcgagatgctcgtcgaatcgaacttgcaggcgctctcgcaggcgacgttcgagacgatcgtcacgacggacccgcacagcttgaacaccttgcgcaatgagtaccccgccttcggtctcgacaagccggtgctgcactactcggagctgctcgcgaagctgatctatcagggaacggtggagccgaggcagctggggttgcgggtgacctaccacgacccgtgctatctcggtcgttacaaccgtgtcttcgatgcgccgcgtgccgtcatcggcggtctcggctgcgacctcgtcgagatgccgcgcaaccgacagggatcgttctgctgcggagcgggcggcgggcgtatctggatggacgattccttcttggccgagcgcccgagcgtgaaccgcatcaaggaggcccttgcgctcggcgtcgacgtcttcgtcgttgcgtgcccgaaggactacgcgatgttctccgatgccgtgaagagcgtcggtgccgaagggacgttgcgcgtcatggacatcaccgagctctttgccgaggccgtgctcggggcgcctgcgctcgaaggggcgagtgagtgagcgatggcggcgagttcatcctcacgtgcttcgtgtgcggcgagcaggggagctaccggagcctgcacgcgcaccttgtcgacgcacacccggaactcgtcgtcatcgaatcgggtccgcgaccgagctatgcgcttcgctgtccggtgtgcggcgaggcctaccgtcaggcgatcaagcgcgggcgggccgatcgcgacttcgtcgccgcgttcgaacgcgacgtgcgggtggtcggcatggacatcatgctccagcacgtcatcggcgagcatcccgatgcagtcggcgtcgacctcgacgcgttggcgacggatgccgatgagccggaggagtgaggggagcgagcccccgcgcgctcgtggagcgatcgtcgtcgcgggaccgcagcgagagcgcagaaccgagtctccaagagaggaaaggatggattggcatggctgaggtgcgatcgtgcaacctccccgaggacctgtactacctcgtcgaccggcacgtctgggttcgcccggagggtgacgtgttggtggtggggctcaccgatgtggcccagaacctggcgaagacgatcatctcggtgtcgctgaagcctgcgggcaagccggtgaaggctggacgctcgctcgcgaccgtggagagtgggaagtgggtcggcccggtgcccgcaccggtggacggcgaggtggtcgaggtcaatggtgcccttgcgacccatcctggcctcttgaacgacgatccctacggcgagggctgggtcgcgaagctgcgagcagacgccttcgatccggctgctgccggtctcgtcaccggcgatgagggcattgcgcgctacagcgccttcctcgaagagcaggggatcagctgcggctgaggtggcgcgatgagtgagacctgggcgggctgcgaggtcccgccggagctgcgctacgacttggatgccgacgtgtgggttcgcttcgagggcgagctcgtgcgactcggcatgaccgatgtggcgcagtcgcgcatgggcaagctcgttcagctgtcgtggaagcgcgtcgggcggacgatcacgcggggacgacccctctcggtgctcgagagtgccaagtgggtcggaccgatggtctcaccgctgacgggcaccatcgtcgcgacgaacgaagccgcattcggtcgggacgtcgcgatcgcaaaccgagatccctatggcgacggttggctctatgtcgtcgagccaacggtgcctgctgagttcgacgccttggtcgacggacgaaccgcgttcgagcactaccgacgtgtgatcgacgagtccggattgcgctgtttccgctgtgaggacccggtgatattcgtggatgaagatccttgaatgatccctgatcatggcgtagactcaccaggtgaacaccgcgggggatttggtgttcacctggagggtgatcgcgttggacgagcggttcagagtcggtgcggtcgtcgcacgctgatcgagtaggggcatggaggctcagtcaacgacacaagggtgacagaggggcatcgaggcgtcgcgggcgtggcgcgcgtggcgcgcgacccggaggagccgttgcggttgaatccgacgaccacgacggtagccctcccgaagagccgatcactacggcgcatgccgcagcggaacggttcggcatcacagagacaggtacgggttgtacgaagggggaaccatggcaaaggatgacggcacccagtcgatggcgatgatctgctggagttccgatctcgatcgggtctggccggtcttgatcctcgcgaccacggcagccgcttccgggctcgaagtggacgtgttcttcacgttctggggtctgcgagtcctgcagcggtcggacgttcgcatcacgggtgagaactggaagcagaagctcgagtcattgatggatccgggctcgaccgatcgccttcgactcgggaagttgaacatgggtggcatgggcacgaagatgatcaagatgctggcggacgagcacaaggtgtcgtcgcccaccgagctcttggagatggcgctcgatctcggcgtgcgcttgcatccgtgccagatgacgatggagctctacggcctgtcgaaggacgacttcatcgagggcctgcagcctcccattggagcggcaagcttcatcaatatggctgccgaagccgacatcaccctgttcatctagtgctgagcgtcgccgtcgtcggtgacgaaggggtggtcgcgcgcgtagtgcgcgccgcctccccattcggctgggaggtaacgagcgaccttggggctgccgatgtcgtggtcgtgccggccggcgaccccgaggcacttcgagcggtcggtgctcgccgtgcccgaggcgaggcgatcgtcgcgatcgcctatgtcgccgagccagatcagctggcctggcgcgcagccgagcgcggcggtgcggatcgcgtcgtcaacgtcggtgcgttgacgaagacgcttcgcgaggtgctcggggatccctcgcgaggcgtcaggcgcctcgtcgtggggcacgtcgaggacgtggcggggcggttgggcctcgtgggcgaggtcgagatcgacggcgcttcgttcatggtcctgcgcgtcgagggacgatgggtctgcctcgaggcgacctgtccgcatcagggagcgcgtcttgccggggtcccgtgcgaggagggtgtgctgacgtgtccggcgcacggctcgcagttctcgtgcgagagcggggagcgcgtgcgtggtccggctgaccgggcactccgttcgctcgctgtggtggtggaaggatcggagctggtcgtacgtgggggaggggttggctgactcacgaggggtcggtacccaggcgcggtattcggctggatggtccccagtggtcccgggccggtcagcggaaccacttctgtcgtatgttgccccgtgcggcttgtgaatcgattgacatccaaaggggcagcgagactcgcaaggcgtccatggcaatgggactcccattgggcagcggctcccggtgacaaggttccgcttgccccggaggtcatggtgcagggaggtgatgccgagcaccacgatctggggagctagtccctatagctgtgtcgcgggtgggtcacttctgaccggtgatcccgggtcaaaagaaggccggtgcctacacacccccgcctgcgcggggagcacctcgccagcaacgtcacggaccacaccgaggtcggatcacccccgcctgcgcggggagcaccgaaatccagttgagccaggcgcaagttcaggcggatcacccccgcctgcgcggggagcaccccaacgcactcctcgtccgcacgcccgaggagggatcacccccgcctgcgcggggagcactcagtcaacgcggccagccgcgcgcaagtacggggatcacccccgcctgcgcggggagcactcgacggtgatcccctcaatctcggtctggccgggatcacccccgcctgcgcggggagcaccagaacctggccatccagcagtcgagcgtcgccggatcacccccgcctgcgcggggagcactccgtcatcgcgtcctttcttgagtcctgctgaggatcacccccgcctgcgcggggagcaccccgccgcgaccgacagccgcaggcgatcttcgggatcacccccgcctgcgcggggagcacgacgtgggtgcccctcaccgacgcgagcgggtcggatcacccccgcctgcgcggggagcactatctatccaccgaacctggcgagcgcccaggtggatcacccccgcctgcgcggggagcacagcttgccctcaatctccagcaatccacgtaccggatcacccccgcctgcgcggggagcacagatcccacacaaggacgccctcggggagctggggatcacccccgcctgcgcggggagcacacgcggggtggtacggatccatcctcaacgcgcggatcacccccgcctgcgcggggagcacacgaccaccaccacgtcgtcgggcttcggcttcggatcacccccgcctgcgcggggagcaccacgcgcggattgctcatgtaacgccacgcggcggatcacccccgcctgcgcggggagcaccgaccatcagaagcttcggttggcgaccgagaaggatcacccccgcctgcgcggggagcaccgctttgcagcggcgtgaggccgaaggtactgcggatcacccccgcctgcgcggggagcacaaaagcccgacggggagtattgcatgcgacgccggatcacccccgcctgcgcggggagcacacccgtgaagagatgcgctcgtgggtagagcgcggatcacccccgcctgcgcggggagcaccggtaatgcccacttctgtctcctttctgctcacggatcacccccgcctgcgcggggagcacctcacctgcgcggcgcgctgagccaggaatgtcggatcacccccgcctgcgcggggagcacttgggcagctcaggacagtagacctccgctgcgggatcacccccgcctgcgcggggagcacatcgcccttggccttggccttggctgcctcagcggatcacccccgcctgcgcggggagcactcggcgtccttcgccacccagttcgggaggtgcggatcacccccgcctgcgcggggagcacacggtggcctgggggctgtcgccgggctggatcggatcacccccgcctgcgcggggagcactacttgaccaccatgtgcagcacacagataccaggatcacccccgcctgcgcggggagcacgggtcgccagcgcggagggcgtcgaggatcgggggatcacccccgcctgcgcggggagcacacgtgggacctccagatcgccggacagacgaccggtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccatcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccacggatcacccccgcctgcgcggggagcactacttgaccaccatgtgcagcacacagataccaggatcacccccgcctgcgcggggagcacgggtcgccagcgcggagggcgtcgaggatcgggggatcacccccgcctgcgcggggagcacacgtgggacctccagatcgccggacagacgaccggatcacccccgcctgcgcggggagcacttgagggtggcgggtgaggtaccccaatgcgagggatcacccccgcctgcgcggggagcacgagggtgacgctctcgaccggatcgcggacctcggatcacccccgcctgcgcggggagcacggctactcagtggtcagtcttgaggagaccccgggatcacccccgcctgcgcggggagcacccgtcggcgacctctctggttgccttgtatatcggatcacccccgcctgcgcggggagcactcgaacagcacgagcgacgagccgacctgcaacggatcacccccgcctgcgcggggagcacctaacgtcacatggtatgtggtgatgctcaggaggatcacccccgcctgcgcggggagcactgcgataagccatggggagctgtcgaccaagcgtggatcacccccgcctgcgcggggagcacggcctcaccggcctcaccacgacccgccaagtcggatcacccccgcctgcgcggggagcactgctgaactcgtgatcgtgttccccgccaagtaggatcacccccgcctgcgcggggagcaccgaagtcccagctcaggggcactgggggaaaaaggatcacccccgcctgcgcggggagcactgcccgccgatcccgtagccatcgaccggatcgggatcacccccgcctgcgcggggagcacacctcgttgaccccgaggttctccacaatcgtcggatcacccccgcctgcgcggggagcacctcgctcctccctcttcgtcctctcgtccccacggatcacccccgcctgcgcggggagcacggtaggggccgtgctcatcgctgagggcgctggggatcacccccgcctgcgcggggagcacccgttcgttgcccggggcaacgcagcccactggggatcacccccgcctgcgcggggagcaccgccgttaccgatcacgatccaaccgggaagcaggatcacccccgcctgcgcggggagcactcgcgttgatgacccggacgagctctggctggcggatcacccccgcctgcgcggggagcacttgatgcagaccagtgctgatccgcgcatcgacggatcacccccgcctgcgcggggagcactgccgtggcgacctgcgcgtcgtcggcgttcagggatcacccccgcctgcgcggggagcacaccatagcgtcgagggggtactgcggatgagcaggatcacccccgcctgcgcggggagcacctgctatcgatgactgctctcatgctcttcagaggatcacccccgcctgcgcggggagcaccaagttcagcttcagaatgcgtactgagtcggaggatcacccccgcctgcgcggggagcacgtcagttgacagatcgactacctgaggcgactcggatcacccccgcctgcgcggggagcacccgtcgtgattctgtccttcttcggcgtggtgaggatcacccccgcctgcgcggggagcacgagttgtcgaggtgcatgtgctccgagcaagggggatcacccccgcctgcgcggggagcacagctcgcgttgcgggtcgtcaccaggcacgaggggatcacccccgcctgcgcggggagcacccccagtcgcccgagaagctgagcttgtccgagggatcacccccgcctgcgcggggagcactcaaccgcgtgccccccacccgcgaggccaagcggatcacccccgcctgcgcggggagcacggaatcttgactacttcaccatccactgcctccggatcacccccgcctgcgcggggagcactcagcctgagactctctgatgatggataccgccggatcacccccgcctgcgcggggagcactacattgccttcactggcccgtacctgacccagggatcacccccgcctgcgcggggagcactgctcccgttgctgtcgcagtgcgttggccatgggatcacccccgcctgcgcggggagcacccgatagtcccgaagatcggagagtatcccgaaggatcacccccgcctgcgcggggagcacgtctcactcgggaagagctcgaggagtctccgcggatcacccccgcctgcgcggggagcacccaacccacatgaccaacgtcggcccggttcgaggatcacccccgcctgcgcggggagcacttccgtgtgcggcccgtacttaccagtcatcccggatcacccccgcctgcgcggggagcacatgtcgtctgtgtaggtagtcacttctgccaccggatcacccccgcctgcgcggggagcacacttcaccacatggatgtttaccggctgggcttgcgaataagtgtaagtccctcaaagtccacgggctcccatgtgccgcctacgactttgaaggcaaggccctgttcgttgcgagcggggtagaccatgaccgctcggccgccttctcccaggtgctcgttgactcgttgccacatgaggtcacgaacgcgggcggtcacggttcccacgaagaccccaggagcgatttcgagcagccacctggtgatgtggccacggagcccaacggggacagcggtaagcacgagaaccgtcatacgtcggagctgtagtcggtgcccgctgggacctcgccgatgcgatcgtcgaagagaacgagaccgggttcgcccccaaggtcggcatctggcgtaccaagcaagagacgaatgtcgtcgacggctcgttcgaggagatgtgcctcgtgaatccgttcccgcatcgttcgtcggacctgactcgacagacttcccgttcgctgggcggctgcctcgaaggccaccggtatcgccagttctaccttgtagaggtcggcgacgtcgtagacgaacgacagcgagtggccagtgtggacgaagcccaggccgggactacagccgagtgcaacgatcgccgtatggaccacgccgtagagcacgctgttcgcgatggagagcgcgcgattgacatcatcgcccgcggacgagttgttggggtcgtagtgccgaccatgccagtcgatcccaaaggcgctggcaaggtgacgatacgtgcgacggatgcgcgcgccctccatgcctcggagccgctgcatagtggccttgctcacgtcctcgccgggaaagcgcatctgatacatctggcgcgcgacccggagtcgatcttgccgattcgagacgagacgagcttgcgcctcgaggaagcgcgtagactggaacagcgacggtgcccaggcgtacagacgagtatcaccttcgcccacccagcacaccacgaccccggattctcccaggagcagcatggcttgatgggtgatgcgcgttccgggaccgaggaggagcgtgccgaccgctgctgcaggcaggtaggtcgtgccggactctgttaccgacacgactgcattcgcatcccgatggacgacgcagtgctcgaggtagacgaacgaggatcgtcgtgagaccggctggagttcgcctatcccgacgcgctctccactgagtgggacacggccttcagtcatcggggtctcgctggtgcagcaagcgtgagcaggccgcaaccataggcgcgtgcgtggcctatgccggtgaccaagctgcgccgaaggagctcccggtcgagaacctcgagatggcccatgaactcggtcaacgcgatggtcactcgttggccttgcctgcggaacaccatccggcgaccgcctgtcaccgccacgtctggttcgcctgtcgaaccggtacggatcgtgaaaccgtgctgctcggaccgcgcaaggagccagccgagctgctgtgtgatggtgacgtggccgtggcgcttcgtgtctgcggatccggacgaactccgaccgctccgcaccgcattggctgcgagccggaaggcgtagacctggcctgtctcgagtcgatcgaggaggggcccgtagggcttcgtgtcgtagtccgtgcctcggacgacttgccctacgctcgccgcgaagtgggcgaactgcggctggactgcgctcaccacgtagagaatcgggacccgagggtcgtcgccgtcgacgcgccagagcgttcggccaatcgaattcgcctcctgcggcacactggccgacgtcgcttgggcgatgatcgcgtgcatgcgctgcgggttccgcagaacgctgagagcagcctgcttctgtgggtcgatgtagagccgagtgaggaacatctcaatcgccctcctcgagcagggccatcgggtcatgggtcgagcgagccgattcgtggccgtggccgatggtcacctcgacgtagtgatgactgacccggcggcgcgtgtaggagcgcgtgagtgggtcgaagcttcgtgcctggtccgcaagctcgacatcgccggcgggattctcgacgacgagttcacaccgtatcgacgtcgcggactgcgcggggtcgttggcctgccacgggatgcttgccagcacgtcgatgagcccgccgtcgtagacgccgagccgcagcggcttgtccggggggcaggagcgtcgcccgaggtacaggggaaacaccggagtcctgagtgcgtcgtcgagctcttggagctgcgcggcgtcgccttcgagcccagcgacgaagcaggcgtcggcgaggtagaaccgttcggtgacttgcgtgctcgtagcggcagagcgatagccgcccgatgcagtcggcagtctcccctcgccgggcgcgaaccgcttcttgtcgtcgaacagactcgacagtgtgtggaagtctcgcaagacttcacctggtcgatcgatgcgcacggcgaagcgcagcgcgccgagatcgtcgagagctgcggaccgaggacgccccagggcggctgcgagcagcccgatgacccctgacttagttgggaaacgctccgttcgtcggtagtggtcgagacgctggctgctgccccaggcctgcaatggtcctccaaggcgcagtgcgagcacgctcatgatgccatgtgctccgcggttgcggcctcgacggcgtcgaggagctggggaaaggcgatggagtcgccgaggtgagtcgcgaccgcctgctccagcttcgggacatagctcgcccagccgttcaggcgaggcacgccatagagtccgtcgatgtcgtcggcgtaggtcgccaagcgctcggcagatgcgtggacgtacccacgatcgctctcgactggtgcctcgaaggccccgaccagactgaccggctggtcgcctcgcatggacacaaacaccaagtcgggcaccgtcaatgctgcaaacgtgttctggtgtcccgttggcaggctcttggcaaacgcttcgataaaggcgcgcacgcccgtcggtaccgcgtcgggatcccccaggttgtctgccagtcgtccaaggctcacggtggcgaagcgatagacggtcgcggaattgaactcgatgaaccccatcatggccgcgccggtctcgtcgtcgcctgccaggtcgtcgacggtggtgtaaaagtcgaactcggaggtgacgcgatgggtcgagatggcatgcgcgacctggcacgcggcgtcgacgttgagattcggggtgtcagcgatcatcctgccgaacagagcgacatcgagggagagatccctgcccatcgcggtcgtcagaacgtcgaggtcgaggtcatcgccggcacggagggagcgttccagctctcccaccgccgcatcgattgcactctcggagacgaacaacgcgtattcgagatctgcaggttgggtctcctgggcgcgcttcttgagcttctcctccttgaggccgagcagcgctcccgcggcgaggttgacgagtcgtgcgacgtcgtcctcgcgcacatcgagatcgcgcacgcgggcctggactcgctcgtggaggaggccggcaagcttacgcgtgcgaattccgcccccgcggctgcgcagccagtcggtgccgatggttgcgaggttctcattgaagtagcgcctcgtcgcgcgcttccacgactgtgacgacacccgagctcgacgagcaccgccatagagcgcggtctttggtgcgttggtgtcgtcgcggttcagacatgagggcggcaacgtttgcaggacgtgcacgtcgatgactgcgcgggtgggatggttcatggttcctccttctgttcggcgggtgattgctggtcagggtcgagcgcgtagtagtctcgtgcccatctcaggctgactctctgtagtttctcgggcaggagccaggtactgagatcttggtagagccggggatagtcgagggacacgtccgcaccgcgcatgagcgtgaccagtccccgaaggtgaacgccgagggcgtcgatggtctcgctcgcgagcgcgctccggaagcgccgttctatcccttgctcggatgcgccgctatcgccgcgagaggttcgcaatctccgagttgcgagcccgaaggtcgagccttccttgtcgagggcgccaggcgtcttcgattggtggtgcaacgcgaagagaccgagcgcgaggtgcgcagccggctcacgccagcgcgagcgtcccgtcaccatgaggacgtacggccaagagtcaggggactcgtcaaagctccggccgacgttgcggcgaagcgtcgcgagcgctcccgggtctcgggcgatcatgtcacgtacctgacggaacagtgtgtcgttcgtcgaggtcgacgaagttgtggtcatgcagctcccttctctgggctatccgatggactgaactcgttgcgagcccgtgcgagcattcgtcggaagcggtcctcgccagcgacacccgcgaaggcctgcgccggggcgagctgcgctagctcccggctcgcgagatcccgagcgacggcctcgacgagggcagcccactcagcccgagggcgctcgaggtcgtcgatgttcgcgagtcccgtcaggaagtggcgatagggcgcgtcgagccgaccgtagagctcctcggcgagcgccgaccgtgccgccttggcgagcgctgccttcccttcgggcacccggtgtcgctttgattcctcgtggaaggagaggtcgtaggagaggtagcgagcttcggcgacgtagccgagtgcttgggcagcgtgcgctgcgaaggtgactgcgtcgattgcgacggtggctgctgcgggatcctcctggttcagtacggcaagaggagtgtcgagtcggtcgtaggccaggtcgtcgagggtggtcgacatgttcccgaactttgcggaagtgacgaggagggacacgagggcgatcccccgcgattgcagaccctcgacgaaggacaggacgcctgcgcgctgttcctcagcgccgagcgcgagcacgctgctcaggccccgccacacctgctggcccgggcgcgcccgcagtggcacatagctgacctctgcaccacgcctgctctccatccgccatccgacgtgaggatcgacgtctcgcgcggcgcgacgatcaacctcatcgccagcgcagatgagtacccgcgggacgacgatagcatcgccgcggcgctccgggaagaggcgaatccgccgaccttgccaggtgaacaggtcgcacacaccgtcgggcgcgcgcatcacccgtgtcggccccagcgggtcacgttcccatgcgggcacgtcgtcctcgcctccacggatgagattgcgatactgccacgggacgaggttgaggaggagtgtctcgcgcagtgtctgcccgacgggcgcgacgaacccgatccaagcgaggtagccgatcgcgggggtgtccttgccgcccttgaccttcggattccccttggccccagtcttgtcggatgccgagccgaaggcatggcgctccacgagccagcgtgctgcctcggcggggctcagtgccagctccgtgcggtcggtgatgggcgtgaagacgggcacgttgttgcctgatggcgcgtaggccaccagactgttggcggtcttgacgccgcccttgcctgctggctcgaggtcggcgacctgaaagaacgggaactccttcgagaacaggtcgaagcgatggcgccaacgggcgaagtaatcgtcgatggcgtcctccgaaaaccggtcagcctcccagaggcgaccccactcggcgtcatccttcgggcctcgcaagatgcggtaggcgagggcgagcacgagtcgaagcaaggccggctccagggtcgggaagtcgacgtcgaagccaacgatcgtatgggcgagcacgaatatgtctcgaagactcacctcgcttcgccgaccgtctctgaaccgtacgggcagccacggctcggaggagaggtcaaagtgcatctcaggctccaccgctcaccacctccaatccctctacgtcagtatatcgaatgcgataatacccgagcgagcattcaccgtcaagtcccaacacgagcacccgctgacgccgtagccaggggtgacgacgccaaccctccggcacggcgagactggttgcagcttccgtgaggtaactaggcagccggaccaccgagccgaggaccgcctcgacgtcatcgggcgtcggaggatgctcgagactgacctcggtcgtcccgaagcgcgcgatgttcggcgaggggccgacacacgcgatcgcaacctcgatgctcgggacgctgtcgcgcaccgccgcttggacacgaggatcatcgtcgtcttcagggtcgccaagacggatacgttcaagttccaggagataccccgccctcgtcgggtccgagatgacgaactgctccgcccgtcgttctcgttcgtgttgctccgattgccattcgacggcgacccgagcgccatgatcatgccaggctggagcgatgacgtcgtcgtccccatagacggccgccaccagggaggggacgtcatcggggagcgtcagcgagtcccgagcgagcagcagggcggccgttcgaagcaacaggtgctctccgtacactcgcaccgagcccgaaggaaacgcgggtggtccggttggcgagcgcgtgaaccctgtcacgatgacacgaggctctgtgaagccgacggggcgtcgcgtgccgcggtggcgatggaccctgccgattcgctggaggacgaggtcgaccggcgcgaggtcggtcgcgagtacgtcgaaatcgatgtcgagcgattgttcgagcacctgtgtgccaacgacaacctgccctgagaggcgtgtgccaccgcggccgaagtgctccgcgagccaggactccttcctcagtcgatcagctgtggtgaatcgagcgtgcagcaggtgtactgtgcccatgggtcgccgctcagcgacggcgcggtaggtgcgttgcgcccttgccacggtgttgcggatgacgaggatgttcgccccggcctctgccatttgggcgaccatctccagtagcggcatcgaggattcgtcctcagggtcctcgtcaaggtgctcgaggcgcaccgtaaccgatgatgcgtccgtagcaactggagtcgtggtgacgtggccgtcggtcgagacagttgtgatcgagggatagcccacgagcccgagtggtgtcgagtgtcccgcatacgcctcgatgagacgtgcgcgcacggcaggagggagcgttgcggagaggagaatcaccggaatccgctccgcgccgagccactcgaggacacggcggaggaagaccgacatgtaggcgtcgtaggcatggacctcgtcgaggatgaccacttttccggcgagaccgacgtgtcgcaaggccacgtggcggaccttggcggttccgagcaggatctgatcgatcgtgcccacgacgaagggggcgagcaggcggcgtttgggaccggtgaaccatgcttcggccgtgacgcgtgcgatgtcgccttcgtcgacatcgaccgcggacggagcgccgttctcaaggaggtcacggaacgctggcacctgctgtgcgcggccgtgggcaagttcgagcacaaaggtgccgggcccaagctgctccaaccagcgcctggtgcggtggaacatctggttgctcgtggcttgtgttggcaggccgatgaaggctccgccgtgaccttggcgagtggccaagacctcggccgcagcgagggcggcttcggtcttacccatgcccatcggcgcctcgataagaactaggcccccgtcgccttgctcgacggcctcgagcgtctggcgctgtagggcgttcggcgagaagccgaaacgatgctcgaaggcgggcgcgccgaccacggctccgaggttggcgactccgtgccatccgagttgcacgagcgcctcggcggcgcgctgctgagctgcgtggaggtaggcgtcgtcataggggaggcagaggtaggggaagagctgctcgttgctcgcgatccagtccgcgaggatgacgaaccctgcgagtgcgagtcgccgcgcactgccgagttcggttgtgcctgcgaggccgagtacctgctgcgcaccggcgacctcgacgacgaggtcgaacaggcgctcgcgcgcggcactccaggggtctccggcaccgccgagaggtcgtcccgccagaccatagagttcggggcgcttgatcggttctcgctcatagcccagaggagggaaccaaccgtggtgaccaccgaggatcgctgcaactccgcggatagcgggttcgctccagccgcgagctgcgagcagcggctgcaccgtggccgccgaggcgagtgcgtgaggtgccttcgagcgctgggggagcggcttgtccacggcgaggccggcgtcgcggagttgcgggtgcagccagtcgacctggatttggaaagcgggtgttcaggacgaacgctggcggcgtgcttaacacatgcaagtcgaacggggtaccaaggtagcaatactagaagtacctagtggcgaacgggtgagtatcacgtgagtaacctgcctcaaagtaagggataacaccgggaaaccggtgctaataccgaatactctcattcggccgcatgactgaatgaggaaagatttatcactctgggacgggctcgcggcctatcagcttgttggtgaggtaacggctcaccaaggctacgacgggtagctggtctgagaggacgatcagccacgctgggactgagacacggcccagactcctacgggaggcagcagtggggaatattgcgcaatgggggaaaccctgacgccgcgacgccgcgtgcgggatgaaggccttcgggttgtaaaccgctttcagcagggacgaaattgacggtacctgcagaagaagccccggccaactacgtgccggcagccgcggtaagacgtagggggcaagtgttgtccggatttattgggcgtaaagagctcgtaggcggctcggcaagtcggatgtgaaatctccaggctcaacctcgggttgcagtgggatacgggcatggctagagtgcggtaggggtgactggaattcctggtgtagcggtgaaatgcgcagatatcaggaggaacaccaacggcgaaggcagcgatctgggccggtactgacgctgaggagcgaaagcatggcgagcgaacaggattagataccctggtagtccacgccctaaacgttgggcactaggtgtggggcctatttcgacgggttccgggccgtagctaccgccttaagtgcagcgcttggggagtacggtcgcaaggcttaaactcaaaggaattgacgggggcccgcacaagcggcggagcatgcggcttaattcgatgcaacgcgaagaacctcacctgggtttgacatgtagggaaaagctgcccggatgcggtgtcctttcgaggccgtacacaggtggtgcatggttgtcgtcagctcgtgtcgtgagatgttgggttaagtcccgcaacgagcgcaacccttgtcctatgttgccagcgggtagtgccggggactcgtaggagactgccggggacaactcggaggaaggtggggacgacgtcaagtcatcatgccccttacatccagggctgcacgcatgctacaatggccggtacccggcgtcgccaacccgcgagggggagccaatcccaaaaaaccggtctcagttcggatcgcagtctgcaactcgactgcgtgaagtcggagtcgctagtaatcccgaatcagcacgtcggggtgaatacgttcccgggccttgtacacaccgcccgtcacaccacgaaagtcggcaacacccgaagccggtggcccaaccagcaagggagggagccgtcgaaggtggggtcggcgattggggtggccctaaatccatccgatttttcaggcgccggatgggaggtgggtcagcctggctgcgcgtggacgagccgagccgcggctacggtcaccgatgtcggcgtagttcagatcctgaggcgtggcgtcgggggcagcggcacacatcctccggcctcgggtgtgtcctcggctctgacgtgctgaggcgggagctgtcgtgatggacgatgacggacctcgacgcagcccggtcagtgccatctcgtgcggcctcgtgggcacggtgaccccgctgcatgagctgcgctgtgttgtaccagtgcaccgaggccgaggtgagctccgcgagcgtcgcgatgggtccgcgacgaaagggcgagcgaaggtggagtcgttggcctacgggctggtcgtggtctctgtggggcgtggcgtcgtcgccgtcctcggcgaacttcgaggcccctggacctgttggcaatggcaccacgtcgctgtggacggcggcgctcgacgatcctgcgtctgcatgagaggtggcgatcgcagccaagagcatcctcggcctgctggaggcccttggctgtgcacgcggcgctctcgacgaactcggtgccgctgcgaagcgagcctgtctccctggtgatggcgtgccgacgaagacgcagctgtgaacgccgtgcagccgaaccagttggtgagcccgacgtcggtggcgtcgaccacgtcgagctcgcggggcagacggctagcggtctcgtgcgcccgaagcgccactgaacgaggcagggggcgagttgcaggctcggattgcggaccgtcgcgtgtcgtctcgtgtcccgtcgcatcccgcgccagctatgggggcacggggagctgcggacgcggccggtcgcggagaggctcgttgcgcccttggtacgggtactgatcgtcgttcagggggcctgagccgatggacaggtggagcctcggacgatcgaggtgcgcgtgcggtgcgcccgagcgatcggtgcgaccccgaatgcgtgcgttgcgtggccacgtcaaggagtcgcagatcacactgatcgtctcatcttccgcacgcgtcggacgccgtcgtcatgtgtcgagatcatgcgcttgacgtcgaggttcccgggttcggagcgcgcacatcgcgggcgtgatcggtggtgaagcccggctgctcgcgagcttcgatgcagtcctggtcgtgcccctgtggcgcgtcgttcgggtggcgtcgcgccgttcggccgtgggcttcgggaatgagtagcgagcccggcatggttgttcgatggtccgtgtgagcttcgatggctcagctacgatcgtcgagaccggtgatcgcagcgagcaggctctcgactgtgaactcggacgtcggggcgtcacgtaccactcgaccgagccgcaacacgatgatccggtcgcagacctccagcacgtgggggagcgtgtgggagatgaagaggacgctgagcccacggtcgcgcgccgcgcggatgaccttgagcacctcgaggctctggcgtgctccgaggtggttcgtgggttcgtcgaggatgatgacatggcgagcccaggtgatcgtgcgcgcgatggcgaccgcctggcgctgtccgccggagagctcggcgaccgtgcggcccatgccctcgatggtgatgccgacacgctggagttcggcgagggcctcgcgctccatgcttcgctgatcgacgaagccgagcctgccgagcaacccacgccgacgtcgctcacggccgaggaagaggttcgatccgatggagagatccggtgcgagtccggagtcctggtaaagggtttcgataccggcggttcgcgcctcgcggggtgagcgccagtgtcgttgctcgccgtcgacccagatctcgcccttgtcgggttcgaggacgcccgagatcgtcttgatgagggaggacttgccggcaccgttgtcgccgacgatgccgatgacctcgctcgggtacacctggaggctgacgtcctcgagggcgaccacggatccgtaggtgagcgagaggtggcgcagttcgagcaccggttggcgcgtcgtcgtggtgctggtcatgtggtcatcctcccggtcgcgttcgaacgacgtcggagcgtctggagcagcgccgcgagggcgataattgcgccaacgacgacttgaatccatgtcggggccacgttgatgaagatgaggccgtcgctcaccacggtgaggagagccgcgccgaggatcacaccccaccacctgccgacgccgccgtagagggaggcgccgccgatcacgaccgcggcgatggcgagcagattggccgagttgctgacctcggtcgtcggggcggccgagccggatcggatgtagaaaaacatcccggtgagtccagcgaggacccccgagaggatgtagatcgaggcgacgtgacggcgggtcttgatgccggcggcaagggcagcaaactcgttcgagccgatcgcgtaggtgtagcgcccatagacggtgaagtgcaagacgacgccgagcacgatcgcgatcacgatcacgatgatgtcgagccaggtgaacaggctgatgcccgaggtgctccagacgatggcccgcggatcgtagcccaccggcgctccgttggagatcacgagtgcgaggccggcccctgcgctgtaggtgatgagggtcgccacgaacggcaccaggcggaacaccgtgatgagcaacgcgctgatggctccggcgactgccccgaggcccgcgcacaggatcgtgccgagcaccaagatgacggcgaggttgtcgccgtgggtgacgagtggctggatccatcccgccacgatcaccccggtgaccgcggcggtcgatccgacggcgaggtcgatgccaccagcgatgatgacgaacgcctcggcgatggcgatcatgacgagaccgctgaagtcggtgagcaggttcgtgaactcgccgatccggaagaagagcgtgttgcgggcaccgaagaacaagatcagtgcaatgagtaccacgacgagcacgaactgctggttggtgacgatacgccgcaaggttggcgtcgtcggtcggctcgtcacggccgctggggccgcgtcgtcatcacgcgtcaggctcacgtcaactcctcccgccagggctcatggcaaccacgagatgcgtgtgtctccccggccccgggggttgggtaccggggagacacgtgcgcgtcgagctagctctggacgtactggtacttctggaggatgctctgtggtgtcgagggcgtgagcaagatgttcgggatgagctgcaggtggggcaccggcttgtggtgcagtgcgtccacggcgtactcgatgatcagcttgccctcgagggtcggctgctgggagatgatcgccgagagcgacccctgtccgcccgcctccatcgactggatgttggtcgcgtaggcgtcgtagcccacgatcttcacgttcgcgccttcggcgccggccgccttgacagctgcgctcgcaccttctgcatccgtgccatccaccgcgaagatgccgtcgaggtggtgggcgctgatgtcctgggcgaacccagactgcgcgacgctcggctccgactcgctcacgacgtcattgagcacctggatgttcgggtagtgcgccttgatctcggccttgaagcccgcgacgcgttgggcgtcggtggtggtggtcagcgacgagacgccgaccgcaaccgtgcacgggttggacgcggtgcagttctttgcgtagtccatggcggaggccagtgcttgggccgccgtctcgccaccttggtagttgtcaccggtgacccaggaggtgatcatgctctggtccgacgatccggagtcgacgttgaggaccttgataccttccttgacggcctcttgcatgtaggtgttcaaggccttcggatcggtgggcgcgaccacgatggcgttcggatgcagcgcgaggacctgctgcaggatcgggatctgcgtcgctggcgagtagtcgaccgggtcgccctgccagacgagcttcacgccgagcgccttggcttcggcggccgcgccgacgtacatcgactggaagaacggatcggcttctgcgccgacgacgaaaccgatggtggtgccgctgctcgaggccgtcgtggacgacgacgtcgtggacgaggacgacgacgtggatccacacgcggcagccaggagcgatgcgccagcgagcaccgcgccgacgacggctggccgacgccaggtccgaagagaccgagtcatgaattcccccttctcccacgcgggacgtgctctccgttccgcggttgggtgtgagactagcgggctctgatatcgttgtcaacgaccatcgggcgcggggatctcacccgatcctcgagcgacgaggcgccacggtgcgtacgcggtctggatggggagcgatgggtcgtccatccgtgcgaacagcagggaggcggcgagcgctccgatctgctcgacctcctggctgatgacactgacgggcgggtcgaggaggtcggcgaggtcgaagtcgtcgaagccgatcagcgcgacggatcgctcgagccctgcggcgcgcagtgcgtagatgacaccgatggtgatgaggttctgacccgcgagtatggcagttggcgggtgcgggccagcgaggagttcacgggtgcgctcggcggcctcgccgacggagtgcacgtccatgaccgcgaggcgcggatcgatcactagaccgccagcgaccaggccgtcgaggtagccaagcctccggtcgacggcggtggcgatcgtggagagatcgccgagaaaggcgatgcgccgatgaccgtgggcgatgaggtgctcgacggcggctcgcgcgccagcgcgattgtcgatgaggacggcgtcggcatcgagatggcgcgggggtcgatcgacgaagatgaccgggacggacgcgcgctgaagctcggcaaggtagtggtggtcgtcggcggccggttcgacgacgatgccgtcgacgccgtggcgccacatcgctgcgacgagctggcgttctcggtcggggcgctcctcgtggctcgcggcgagcaccgagacgccgcgatcgcgcgcggccagctcgatcatgcggaggatccgcgctgggtgggggttcgagagatcgtcgaagatcgcggcgatcgtggaggagcgtcgatcgagacgacgcagcgagcgcgcggagaggttgggctcgtagcgtaactcacggatcgcggcgcgcacgcgctcggtgacctcggccgtgacgcctggctcgtcgttgacgacgcgcgacaccgtcttcagcgagacccccgcgcgatgggcgacgtccttcatcgtggctcgagccttcggggtcgggcgcgtgaactcggtcgtcacggtgctccttcgtggtccggtgcccaacgggtacgagtgctcattggtcgactcgcgctcagcataggcagctcggcctggtgcgtcgaggcacgtcccgagctcgggcctcctcaggactcctaggtccaagtcgacgtcggcaccgatcgcctcggtgggtcggcgcctcggcgggtgcaggtctcgcgagcgacctcgatgccgtcgcgcacggccgcgagcacaaactcggtgtcgtcgaccgtgcgccggccgtggtaggcgaacgtcgcggcgacggtgccggtgagcgcgtcgcccgcgccgacggtgtcgacgacgcggaccggagcgacgggaagctcgaccacgcgaccgtgtaccgagacgaggacggggcctgccccctggctcatgatgacagcggctggtcccgaggtcgcgagatgggcgagggcctcggccacggtcacgtccggctcgagccagcggaggtcgtcgtcggaggccttgacgatgtcggcatgggcgatggcctcgtggaggcgctcgcgatagcgctcggggctcgcgaccgcactcggacgtacgttgaggtcgacgatgcgcaacgatgcggcgcaggcacgaaggacctcgacgacgctcgttgcgagcgtgtcgagcgcgagggcgagaccaccggtgacgaggacgtcgccggcgtgcgcggcgtcgttcacgcgatcgtggcccaccgggtcgtccagggccgtgccctcgaggtagaagcggtagtcggcgacgccgtcgtcgagggtcgcgagcgcgagcgtcgtcggcagccgcgagcgccacgagaagccgaggtcgaccccgtcgtcgcggagaaagcgcaggaggcgctcaccgaggggatcgtcgccgacgccggtcgcgagcgtgaccggcacgccgtggcgagcgatggtgcgagcgacgttcgcgggtccaccaccgggcgtgaacgatggcgagcccgaccctggaaggaggcagtcgaagagtgcctcgccgatgacgacagcctgagacgtgctcggggagcctagctgcgagctggctcgatcacgacgtggaaggcaagctcggggcagaggtgctcggcgtggcgggcggcatcgaggtcctcggtgacgatcggatcggtgacgagagggaagtgccagggatcgagctcgagatggcgcgcgaggagggccacgcaggtgccatggcctcggcatcgggtcgggtcgatcacgatccgagcgcggctagccacggctcggctcccggctctcgagcgcgaaggggcgctcgtggcagcgccggcgctggtggccggccgcatcggccggggtgatggccgtcgcgaggtgtgctgcggcgtcgggtagcgcgcaagcgcctcggcgggcgatcagcctcgccacggtcgcaagttcggcgggacgagccccggcaccgagtgcacgggcaagttcggggagcccacggtcacagggtccgcactggccggctcgctcctcgctgaggtagccgacgagctcgctggtcgcacagacgacgcaggtcgccgatggggcgagcagcacggagcccgcgccgagcgccagctcgtccgatgagtcggcacggtcgacgaggacacgtgccatcgcccgctcgtcggcgaccgagatgagctcgccgaagagaccgccgacgagggcgagacccgtggtgacgccgaccgcgtcgaggaggctccgaacggtcgcccctggggcgagttcgaccaccgtgggcgtcgagcccgggagcgcgatcgagacgatgcgcgtcgagcggtcgtggcctcgggttccggcgctctggtgccaggaggtgccaaagcgcgcggcgagggcccactgcgcgagcgtctcgacgttggcgacgagggtcggcctgctcttgtagccgcgctctgcgacgcgtgcgagctggaaccgcgggagtgcgggacgcccctcgagcgcggcgagcagcgccgtctcttgaccggtgagatacgagcggtcgaggagtgcgacgcggaccgcgtcgctgcgttcacgaatggctcgctcgaggacgtcggctgcggtcgcgtcctcgacggccacgatggcttctcgggcctcgaggagtcgtgtcgcgagcccgaggccatcgagcacgaggtgcggcgcatgggtgagcagcgccttgtccttgcgcgcgccgggctcgctctcggcgccgttggcgaccacgacacgtggcccacgctgggacgcgaccgcagcaagcttgcgcgccagggggaagcccgcgccgcccctgccgacgatgtgctcggcggtggcgagtggtggtcgtgggggcagggagccgtagatggcgcggtgcgcgtcgagcgagagaggcggcgcatcgagctcagcgatcgcgaggtcgtcgctcacgagtcggctccagccggcgctgaggcgtgcgacggacctgggcggcggcgtcatgcgtcgctgccttcggagccatcggcctcgggagcgccgatcgagggtgcagcgttcagggcttccgatggcgcggtggagaaggagacctggcccgtcgcaccgttcgcgtcgatggcgagcgccgcggtgccttccaccgtggcatgggggcaggcgagcgagaaggagatcgtcgagcccccgagcgcggtgacgctcccgtggcacaggtttggcgcgctgggggtccccaaggtcaccgtgccacccgagacggcaaagacgccctcgctcggctgtccggtgagcacgaccgtgagccgttcgttcgtgccgccgatggcgcccgcgatcgtgaggtccgtggcgctcgtggcctgggtctgcgtcacggtggcggtgatgggcccgccgaggggctcggacgagcgtgtcacggcggcggtggtcgccgtcgtcggggcggtgccgtcgatgcgcgcagaccagccagggcgaagcggtccgctccgtgcccacagcgccacgaccccgggcacgccgaggacccccaccatgccgagggtacgggcagtatgtgcgagatcggggtcgcgacggatgcgcaagaccgcgaggacgatgacgcctgcggtgatggcaccgtagacggcgaggaccgcggcgagccgcgtgtcggaaccggtcccgagcccgtggacgatggcgagcgcgagcacgagccacacgagcatgtgcgtccgcttccagagcgcaaagccaaggtgctggcgtgcgagcgaggaggcgatcacgatcagcaggccatcgaaggcgagcgtgccgaacccgacgaaggcgcgtcgatagtgggagaggaacgggatgacggctgccgtccagccgatcggcacgaagctgtcggcaagtgccgtcagaatgtggatcgcgagcacgaccaccaaggtgagcgagagccgtcgatggaggtccgggccgaggaagcgggcgacgccggaagggaggattttgcccgccaccgcgatgccgagcagggcgaccgcaccgagcatgacgagcgcggcgagaccgctcacgcgggtcaggtaccacagcagcggggatgtcgtcgcgatcagcacgcggccgcttcctcgagacgtggtggccagccgccaagggggaggcgttcgccggcattcgtcacgacgagcgccgacagctcgtagcggcgccacatgcggtgccaggcgcgtccagcggcgatgatcgcgaggctggctgcattggccgccgcggcgctctcggcgacgacggtggcgcggcgggcagcgccagggagcgtggaggcaccgacgatgtgatcgagaccccgtggcgatcggcgcgtcgcgcggtcactcgtcgcgaccgcgccagcggggatgtggatccgctggccgggcgcgtcgggccgcaaagatccatcgtcggtgacgaggatcgaccagggggcttctccgacgcagcggaggtcgccaccgaggttgacgaggatggcaccggcggcgtcggctgcgagttcgagggcgatcgcatcggcgatggccgccttggcgaggccgccgaggtcgatcagcgttccgggtgggcgtcgaaccatgtcatcgtcccgttcgacgtcgtcccaggtcgcgctggagcgacggccgaggcgcgccaccgggtggtctggttcgagcgcgctcggatcggcggcgcgcaccggatcgatgacgccgccacttgcgcggaccgcctcgtcggtgacctggaggaggtgtgcgagacgtgccgacacccgcacctccggtgtcggatcggcgttcagctgcgagagctcgctgtggggatcgtggaagctcgcgacggcgccccactcgtccaggagcgcacgaaacctgtcgacgagggcgcgatcagcggggtccgtgccgaccagttcgcagcgtgtggtgtaggcaggcagcacgctcgaccacacgttaggagcctccggtcggggtcggggttgcggcagagggagcttggctcaccgtgggagcggacgatcccgacgacgtcgacggtgaggagctgcccgacgagcccgacgacacgaagggtgccgtcgagttcgacgtcgaagaggtgtgggaatgggtcgtggccttggtggtgtggccggggaacgatcggatcgcttcgaagccgagtgcaccggccgcgaggacgagcgctgcgacgaccgtgcggtggatgcgcttcgcttgggccatgaggtccgtcacgggtcctccttgggtcgggggagcggggacgacgccctcaagtcaaacggcgcgatctggcgtggaccttgagtcaggctcgaaagcccctgagaagggtggtcctgcgaagggcgttcaggactggtgggtctccaaggagaaggcgtcctcgaccgcctcgcgcagatggacgccggcgaggccaggagcgtcgtcgagcgttcgatcaccggcctcctcggcaaccctcgcgagagccgcgggatcggccggttggccgatcagggcatcggcgatctcgcgcggtgcctccatgggccagacggtgaagtccccctcgacggtggcgtcgatcacgtggccctcggcgacgacgaggaggatccgcacgagcccgctcggtgccttggtgcggccgacgaggacgtcggcaccttcgcgaatgtgcaccccgaggacgcgccgccccccgccatcgttgacccaggcgggatcgacgagtcgttcgcgcaccgcggcgacgtggcggcgctcgtcctcgctcaaggtgccgagttcgagtgggcgtccgagtgcctcggcgaggatcgggaggtagcgctcgacgatggcgtcctccgacggtgccgatccgagctcgcgctccatggaggtgacgtaggtgcgcatcgtggcggcgagcttgtcgcggagcttcacggagtcgacgcgcagcacggcggcgagggcgtcggtgtcgatcgtgcggatgaacgaacccacgagcacctcggcgcccgcgatgcgagccgcaccggtgccgccgatcttgcggtcggcgacgtggatgtcgttgaccgggcgatggcgcgcgtcgatcccgaaggcacgcagcgtcgtcacgagtggcgcaatgtaggccgcgtagcgtgcctccagcgagagcggtacgtggtctgggtgcatgatccactggacgaacagctgaccagcgtcgaggtacacggcgcccccgccgaccatgcgccgcgtgatcggtaggccgcgcgccgcggccgcttcgacgtcgagttctcgttcgaccgcctggtggtagccgacgcacacgtaggggtctcgcggtgacaccaggcagatggtgtcggggtcgtcgggaccgagcctctcggcgagggcgtggtagatcgcctgggagtcgatggcctcgaggccggtggcgacgatgatgcgaacgggtcgtgtcatggtcgtagctccgtcatcacgatgacgtcgtggccggcgtcgatctgtcgattggcttggtgggagatgcgcacgagtacggcgacgaggagatagttcgcgagcagcgacgaccctccgtaggcgacgaaggggagcgtgacgccggtcaggggcaggagtcgcacgatccctgccatgatgaagaaggtctggagtccgaggatgaccgacagggcgaaggccagcagcgacgagaactccgttcgcgcacgcagggcggtgcgcacgccggcgccgacgaggagcacgaaggcgatcacgagggcactcgtgccgagcagacccatctcctcgccgaaggcggcgaagatgaagtcgctggtgacgaccgggatgagctgcgggtggccgagcccgagcccggtgccggcgagtccaccgatgccgaaggcgtactgtgcctggacgagctggtagccgatggtctgggcgtagcgccatggatcgagccagaccacgacgcgctcgtgcacctgggtgaagagggctccggccaggaccgccccgatggcgaaggccgcgaggccgaggaccaggtagctccggttcgccgtgcccacccagaggacgatgacgaaggtggagaagatcaacagcgcgaagccgacgtcgcgctcggccgccatgacgacgagtgcgagcgcgaacgcgagtgcgatggggccgaggcggcggatgccgccaccacgaagccggctgagcatgtcgcggcgctcgacgatccaggacgcgaggaacagagcgagcaggagcttggcgatctcgacgggttggaagctgaaggggccgacgtggatccagagccgcgcaccgttgatgtcgagcccgagcccgggtagcagcggcaggaacagcagggcgatcccgccgatcgcgaggaggtagcggtagcgatcgagcgcgtccgcgttacgcacgacggcgagggtcacgacgtaggcgatgacgctgagagccgtccagagggcctggagggtgccctcgtgggggtcgagtcggttgatcatgacgaacccgagcccattgagcagtcccacgaggggcaccatcgtgggatcggcggccggtgcgagcagccggttcgcgatggcgaggacgaacggcgcgaccatcacgctgacgagtgcgaggttggggtccaggtgtgccttcgggttctcgccccaggtcgcgagcgcccacgcgaagacggtgatgacgtcggcggcgagcaccagttcgagttctcggcgtcgccggtcacgagcccatggtgatcgctcgcgacgggcggcgagcatggtgcgcatcggtccttgtccccctggctggtgcgagcggattctagcgggcatgacgctggcgcaggtggtggcggaccgggcgtcgacgcactacggcgagaggctaggttggcggccaaggaggtgctggtggctgaggcgcaacgcatgctggccgagggctccctgcgcagttcgtctgagcgcttcgtgaatcgggagttgtcctgggtggacttcgcctcccggatcctcgaactcgccgccgatgcgcgcgaaccggcgctcgagcgcgccaagttcctcgccgtgctcgcacaaggcatggacgagttcttccaggtgcgcgtggccggcctcaaggatcagctcctcgcacagcatccgattcgctccccggacggactcgatgccagggcgcagctgcgcgcgattcgcacgcggctcgagccggtctgggagcgccagagcgaggtctggcacgacgggatccgaccggcactcgctgcgctcgggatcgagatcgtcgccgtcgaggacctctctccgacgctccatcgtcgcctccacgagcgcttcttggaagagctgttcccgatcctcacgcccttgtccgtcgatcccgcgcatccctttccctacatctccaacctgtcgctcaacctcgcggttcgcgtccgtgacagccaaggcggtgagctccggttcgctcgtgtgaaggtgcccacgaatgtgccgcgcctcttcccgctcggggacctgcgctactgcttggtcgaggacgtcatcgcgagcttcatcgcccgcctgttcccgggcatgatcatcgaggaagtcggcacgttccgcgtcacgcgcaacaccgacctcgtcctcgaggagggcgaggcggacgacctgctcgagctggtcgagaccgaactgcgacgccggcgcttcggtcgtgcggtgcggctcgaggtgtcgtcgcgcatgagtcgtgagctcgtcgacgtgctcgtcgacgagctcgagctccatccggatgacgtctgggcgacggacatgccgatcgacggttcgttcgcatgggagatcgtcgcactgcccatcgacgaggggcgaggcatcgccgccgcgggtgtgacgccgtcgatcttcaccgtgggcgacgacggcgctggcgcgctgttcggccgcctggcggccggcgaggtgctggtgcaccatccctacgagagcttcgcctcgacggtggaggcgttcgtgcgtgcagcggcggccgatccggacgtcctcgcgatcaagcagacgctctatcgcacctcgggtgactcggcgatcgtcgaggccctcgtcgaggccgccgaggctggcaagcaggtcgtggtcatcatcgaggtcaaggcccgcttcgacgagctcgccaacatcgcctgggcgcgtcatctcgaagaagccggcgtccacgtggtctacggcgtcgttggtctgaagacccacctcaaggccgcgatggtggtccgccgtgagggcgcccgcctcgtgcgttactgtcacgtcggcacgggcaactacaacgcccggacggcacggacctacgaggacctcggcctcttcagcgccgacacggtcctcggcgacgacctggccgaggtgttcaactacctcaccggattctcgcacccgaatcggttgcggcgcgtcgtgctcgctccccagcagctgcgcgggtggttgctcgagcgcatcgcccgagagcgcgatcgcggaccgagcggacgcattcgcttcaaggtgaactcgctcgtcgatcccgagatcatcgatgcgctctacgacgcgtcggcggccggcactcccgtcgagggtgtggtccggggcctgtgctcggctcgcgtgggggtcgaggggctctcggagcaccttcggatccgatcgatcgtggggagcttcctcgagcattcacggatctacgtcttcggccaaggacccgacgccgatgtggcgatcgcctcggccgatctcatgcagcgcaatctcgatcggcgcgtcgagctgttgatcccgctcgaggcgccggcgactcgagcgcgcgtggagcacatcctcgatctcgccttcgcggacgacacctacgcatgggagctcaccgccgatggccgctggcatcgtcaacgcggtggcgagggcatctcgctccagcggcggctcaacgacgaggcgggggctcgggggtgagcgaaggcgcgatcgggaccgagcgggaactgaagttccgcccgcgcgacgtcgacgaggcacgagtcctcgtcgccaggttccgtgaccggctcggtctgcctgcggcccccgcggtgacgaccacgctcgagtcgcgctacctcgacacggccgatcaccagctcgcgcgctgcggccttggcgtgcgagcccgctgggcgctcgaggctttggatcccgaggccgcacgctggacggccaagctcgcactcgaagaggacgacggcacctacgtgtcggtcgagttcgaggtcgacggcgagcgcgagcgcctcccggccgagatcgctggtcggcttcggagcgtcgtcggatcggcgcggttggtggagctcgcgcggattcgcaaccaccgtaccagctggcgcgatgcgaccggtggtgtcgagatcgagctcgacgtggtggacgtgctcgctccgcgaactgggcacttcgtcgaggtcgaggtcgaggtcgccgacgacgagcagctgcgcgcgctgcggcgctgggtcggggcggtcccggtgtcgacgacccacaagctcggcgcggccctcgggcaggtcgtgagcgtcgatccggagtgcgtcgcgcgggtgcgtgccctcctcgaggcgccgagcgaccccggctggtgcgaggagcctgctccatgggcacgctgagtgcggcggcgatcgatctcggctccaactcgttccatctcgtcgtggcgcgggtgcgtccggagcgcctcctcgagcccgtctacgaggacaaggtcatgctgcgcctcggggaggtggtcgcacgcctcggtcgcttcgacgacgaggccgaagcacgtgcccacgaggcgttcgagcgcttcgtctcgctcgcacgcgcgttcggcgcgacggtcatcgtcgccgcggcgaccgcgagcttccgtgatgcccagaacgggcgtgacgtcgccgacgcgctcgaggcgcgaaccggggtgcacgttcgtatcctcaccggtcacgaagaggccagcacgatcttctcggcggtgcgctcggccggcagcatcggccaggtccccgtcgtcgtggccgacctcggcggaggcagcttggagctcgcgctcgggacccaacgatccctcctgcgcgcgcgcagcctcccactgggtgtgggcaagctgtcggtgcgctaccgctgtagcgacccgccacggcacgacgaactggctcggatccgggcccacgtcgaggcggtcgccggtgccgagctccgcgagatggcctcgttcgagccgcgccggctggtcctggcgagcgggacgttcgccgcgatcgcgaaggtcgcgcgtcgactcggtcgcgtcgatcagctcgccgacgggcaggtgttgcgggtcgtggacgtcgcctccctcaccggtgcgctcgatgcgatcgtgcgtgccgatcgagaggcccgcatcgaccgtctcgggatcgatcggcggcgcagcgataccgtcgtgccgggcgtcctgatcgttcgcgccctcctcgatgagctcggggtcgacgaggtgtggaccagtcggtgggcgcttcgggagggcctgttgatccaggccgtggaggagggcgacgccatgggcttcgccttcgacgctgccgagctccgcgctggctcgctccgacacctcatgcggaagtaccagatcgaggaggatcacgcccgcgctgtggagcggcacgcactcgcgctcttcgacggactgggcggtgccctcgagctcgtgcccgaggatcgtgacttgctcgcggtggcggcgctgctgcacgacgtcggtgcgttcgtctcgggccggaaccacgaccgtcacggtgcgtatctgctcgcggccgacccaccacgcgggctgtcggtgcgcgagcggctggtggtcgagggcgtcgtcggctcgcaccgtcgcggcgcgcctcgttcccccgacgccctctcgacggccgatcgcgaccgtgtggctgcgctcgccgcactcctgcgcgtcgccgatgggctcgatgcctcccacacccaagtggtcgaaggggtcgaggtccagctcgaggcggacgagatccgtctcgtggtgcacgccgacgaggcgctcggtgccgagcgcgttgctctcgagacgaagaccgagctgctcagctccctcctggggcgcagagtcgaactcgacgtggtgccggtggcgcgagatggggcggcacgagcgcggtccgtgctcgactgagcgctcgcactccgcggtcgcgctcacggatcggggagcaggacaccagggttcacgatgccgtagggatcccagatccccttcagcgatcggagcgccgcctcgtcgatggggtcgaggaggagccgggcccagcgacgtttggtgcggccgatcccgtgttcggacgcgatgacgccgccgagggccgccacacgtgtgagcaccgtctcgtagagcggaccgggatcggccccgtgtgcgatcgcgaggttgacgtggcacgtcccctcggcgagatggccgaagaggacggtggcgcgcacctcgtcgcgctcggccaccaggtcgaggtgggccgcgagctccccgagtgccccgagtgggacggcgacgtccagcttgaccggggtgccgaagcgctcggcgagcagcgggagcatctcgcgcaggtgccagagccgtgccctctgggaggggtcggtcgccacgtgggcgtcgaggtgggccggtgcgagcaggaggggccgatcgtcgtcgggatagggactcgtgagctggaggatgaggaggaggggatgcgggtcgggcggggtgaggccggcgcttcggacgtcggccgtacgcacgaactcggctgcctcgagccacggcgcaacgagtggccggagcgtctcgaagaggctgacgaggtcgacgaagtcgtcagcgccgatggcgatggcgatgcgggtgcgtgggcgcgggtggacccggagcgcgacggccgtgatgacgccgtagatgccctcgctcccggcgacgaagcggcaggtgtcgagcccggcggccttcggaggccgaccgatgcgacggtgggttcgcccgagcccgtcgacgaggtcgacgtggacgagctggttggccgtcgagccgtagcggacgacccgttgaccgcccgcgttggtcgcgacgagaccgccgagggtggcgttggcgcgcgatccgaggtcgataccgacctcgagtcctgcagcctcgagctcggcgtcgagatcggcgagcgtcacgccggcttcggcgacgacggtcatcgtggccggctccagtcgaacgatgcgtcggagtcgttcggtgctgacggcgatggcgccggggtggggtaccgcaccggccacgagcgaggtcctgccaccttggatggtgatcgcgacacgagcgctcccagccgcctcgaggaggcgcgcgaccgcgggagcgtcggcggggcgtgcgagcgctgcggcatcccctcgcgtcgtggcggtccagtcgaggttgatcggctcgagggccgcggggtcgtcggtccagtcgacgttcgcctcgtcgaggacgcgagccgcatcggacgctgctgccatggggccatggtaggtgtgggcatgctgctcgcgccatcgcccgagggctcttcgagggatcgggttaggctgcctagcggtacgtcggagcgtgcctgtgtccggatcgtggccaggctgctcgagcgagtcgcccgacgacgagcgcgtgtggcgcatggtcgggcggcgcgcgtcgtggcgatgcgacagaagggagcgctcggtggagacggtggatccgagatcgcttcgggtgtggcgtgagctcgaggccgaggccgcggagctgcgcgacgtgcctcttggcacgttggtggccgagggaagcgatcgcgagcgtcggctcgtcctcgatgccgggctgctccggatcgatgcgacgcgacagctcgtacgcgctcgcacgttggagctgctcggtgagctcgcgcgcgagacgaaggtggtcgagctgcgtgaggcgatgttcggcggtggccacatcaacaccaccgaggatcgagccgtggggcacgtatggctgcgcgcgccgcggggaggggcacccgtcgtcgacgggatcgacgtctcttccgcggtccacgacgtcctcgagcgcatggcggaggccgccgttcgtctgcgcgacggcagctggacgggtgtgaccggcgaacggatcgagcgcgtcgtgtcgatcgggatcggcggctccgatctcggccctcgcatggcggccctcgccctggaggccttcggccacggcgggcccgaggtccggttcgtctcgaacgtcgatcccgtcgacctcgagcgagcgctcgtcggcgccgagcccgcccggacgctgttcgtcgtggtctcgaagacgttccggaccctcgagacgctccagaacgccacggcggcgctcgcgtggctgcgctccgagctgggagagggccctgaggtggtggcgcgccacgtggtcgcggtctcgtcgaacgtcgaggccgcgacggcgttcggtgtcgaccccgccaacgtcttcggcttctgggacttcgtcggtgggcgctactcggtgtggtcggcggtgggttttgcgctgatggtcgccgtcggaccggagggcttcctcagtctgctcgccggggcccacgccatggacgagcactttcggaccgagccgatggatgtgaacgcccccgtcctgcacggcttgttgatgctgtggtatcgcacctttctcggcgcccagacctacgcggtgctgccgtacgcggagcgtctcgcgctcttgccgtcgtacctgcagcagctgaccatggagtcgaacggcaagtccgtccgacgcgacggcgagcgcgtggactacgacacgggcgccatcgtctggggagagccggggacgaagggccagcacgccttctatcagctgctgcaccaggggacgaccctcgtgcctgcggacatcatcgtggtcgccgaggcacaagccggtcccgagcgccaccacgacctgctggtggcgaacgccttcgcgcaggcccaggcactcgccttcggccgggacgaggcgtcgttgcgggcggcaggggtgcccgagcgcctcgtgccgcacaaacggatgcccggttcacgcccctcgagcgtggtgatgatgccccgactcgcgccggagacgctcggcgcgctgatcgcactctacgagcactcggtgttcgtccagggggctgtgtgggggatcgactcgttcgaccagtggggcgtcgagctcggcaaggagctcgccgaccagctcgcgcccttcacgacgggcgagcgcgacgtcgagggtgccgacctcgacccgacgacggcgcggctcatcgagtggtaccgttcgtggcggcaagggccgccgaagagagaggagatgccatgaagagggctcgcttgctggcggaacacggccagagcgtctggctggatgcgatctcgaggcgactgctcgccaagggcacgctcgcgcactacatcgacgagctcgcggtgaccggcttgacgtcgaacccgtcgatcctgtcgcacgccatcgccggttcgaccgactacgacgagcgcattgccgatgcggtcgctcgcggtgtccacgatccagaggccgtcgtctacgaactcgcccactgggacctcgccgaggctgccgggctgttcgcgccggtgtacgagcgcaccgacggcgtcgacggctacgtgtcgatcgaggtgcctccccagtacgcgcacgacacccaggcgacgctgtcgtgggcgcgtgagctgcggtcgcgcttcgcggagccgaacgtgctcgtcaaggtacccggtaccccagagggcctccccgcgatcagcgagttgatcgcctcggggatcggcgtgaacgtcaccttgctgttctccgtcgagcactacaccgcagccgcggaggcctacctcgagggcatcgagcggcgttcgagcgccgggttgtccctcgtggtgccctcggtcgcgagcgtcttcgtctcccgctgggactcggccgtcgatccgctcgtgccccgtgagctccagggccgtacgggccttgcgatcatgcgtcggatctacgcggcctaccaggcgctcctcgcgtcggagcgcttcagcaggctcgccggccagggtgcgagagcccagcggctcctctgggcctcgacctcgacgaagaaccccgagctccccgatacctactacctcgggcgactggtggcgccagggacgatcgacaccgtcccggaggggaccctgctggccttcgacgaccacggcgagatcgagcccgtgctcgacgacgacctcgcgggggccgatgcactgctcgaggaggtcgcctcggcgggagtcgatctcgcgggccttggcgacgtcttgcaggagcaaggtgcccacgccttcagcgccgactggacgacgctgctcgacaccgtggcacggcgggtgaaggggtgagcccgcgcggcgtcgtcgtccgcgaggatgggggcacggtcgcagctcgcgtcgaggagctcgacgagagcctgctcggccacgatccagtgcggatccgcgtgcactactcgaccctcaactacaaagacggcatggtcctcggagggctcgggaggctggttcggcgctacccccatgtcgccggtgtcgaccttgccggtgaggtgatcgaagaccggacggggacgttcgctccggggacccgcgtcgtggtcacggggttccacgtcggcgagcgccatccgggcggtcttgcccaagaggccagggtgcgtccggagtgggtcgttccgttgcccgagggcctcgatgcgcgaagggcgatggcgatcgggacggctggcctgagcgccatgctcgcgatcatggccgtcgagcagcgggggcgttccgatcggaccttccccctgctcgtgactggagccgcgggtggggtgggctccatcgcggtcgctgtcgccgctcgacgagggtggggggtggctgcgtcgaccggtcggaccgacgaggcgccctacctgcgctcgctgggtgcgagcagcatcatcgccagagccgagctcgcgagggacgacgtgcgcccgctcgagtcggagcgcttcggcggggccatcgatgcggtcgggggctcgacgctcgcgaccgcgcttgcccagatggcccacggcgcggccgtcgcatccgtgggtcttgccggcggcgaccgcttttgcgcctcggtgatgcccttcttgctccgcggcgtgagtatcgtcgggatcgactcgacgctcgcaccgctcgaggatcggcgagcggcatgggcagcgctcgcgagcgacctcgaccccgcactgctggcggaggtgacccgggaggtggggctcgaggacgtgcccgccctcggacctgagatcctcgccgggcacgttcgcgggcggatcgtcgtcgacgtgaaccgctgagacgtgcccacggtcatcgtcgtgtgtggcccgaccggctcgggcaagtcgacgttgcgtgctcggctcgtcgagcgaggtgcggtgggcatcgacgccgacgaggtggcgcgagcggtcgtcgagccaggttccgaggtgctcgcctcgttggtggcggctttcggcgatgacatctgcgacaacgaggggcggctccggcgtgacgtgctggccgcgcgcgcctttggctcggccgagacgacggcgctcctcggtcggctcacccatcctgcgatccgtgccgagatcgaggcccagttggcgtcagccggcgatggggacgtcgtcgtcgtcgaggtcccgctgtggcggcgggcggacgactggatctgccccgatctcgtcgtgtgggtcggggcgagcgccgagcgcgcgggcgctcgcgtcgcggaggaggggcgcatgagcgaggcggagctacgccagcgtcgtgctcgcttcgacttcgaggcccagcggcacgaggcggacctcgtcatcgacaacgacggtggtccagaggccctcgccaaggctgccgatcgtgtgtggtcgctcgcgctcgctgccgacggtaaaggtcatcgccgcgcgtgacgatgggttcgcgaggaggtgaccatggctgaggtgatcaccgcggagcagctgacggcccggatcgcggagttcgaaccatcgaggagcgtcgccgaacgcgtgctcgcggtcatcgatcgcgacgacatcggtgctgccgagctcgcgactgtcgtcggcacggatccggcgctcgtcgagcgggtcatgcgaacggcgaactcggtggtcttctcgagtcaggccaacgtgcgcaccttgcagcacgcggtggcggtgatcgggttcgagaccgtccgttcgctcgcgctggcctcgttcgtcgagggcgtcatgagcgtctcccggcaggactggcaacgatcggtgatgtcggcggtgggtgcggcggccgtcgcgcgggggatcgggctcgatccgcagctcgccttctcgaccggactcctccacgacatcggccacgcgctcctcgagagtctggacccgagctacgccgccgtcgtcggggcgttccgtgccgagccgctcacggcctcgtccgaggccgccctcgtgcgagccgaacgtggtcgctacgggatccaccatgcgctcatcgcgggcgacgtcctcgcctactggaacttcgccccggacatcgtcgaggccgtgagccaccaccacacgccgaagggttctctgtcgcgactccacggcgccatcgtcgacggctaccgtctcacccactggctcgcctcggggctcgatctcgaggagtacagccgcgccgacgacgtgctgctgccgacctacctgcgacccgagaacctccacgtcgtggccgccgatgtccggtcgcgggccgagacgctcctcgaggatctgttcgggatcccggcgtcgcacgcgagcgcacggtagactcccggtgtagtgccggagcgcttcgaggtccacgcgccgtatcgcccgagtggcgatcagccgagggcgatcgacgagctcgtcacctcgatcgagtcgggcaaccggttcacgacgctgctcgggatcacgggctccggcaagagcgccaccatcgcctggacgatcgagcgactgcagcgccccacgctcgtcatcgcgccgaacaagtcactcgcggcccagctcgccaatgagtttcgcggcttcatgccccgcaatcgggtcgagtacttcgtgtcgtactacgactactaccaacccgaggcctacataccctcctccgatacctacatcgagaaggactcgtccatcaacgacgagatcgaccgactgcggcactcggcgacgtcggccctgctcacgaggcgagacgtggtggtcgtggcctccgtctcgtgcatctacggcctcgggagcccgagcgcctacgaaggtcagatcctccccatcgaggtcgggatggatcagccgatggggctcgtggtgcgaaggctcgtggccatgcagtaccagcgcaacgacctcgagctcgcccgtggccgtttccgcgtgcgaggcgacgtgctcgaggtccacccggcctacgaggagcgcatcgtgcgcgtcgagttcttcggcgacgaggtcgagcggatcgtgagcgtggatcagacgacgggggaggtgctgcgcgagctggaggacatcgttctgttcccggcgacgcactacctcgcgagcccggaggtggtcgagcgtgcgcttcggtccatcagcgacgagctcggggagcggctccgtgagctcgagagcgcgggcaagctgctcgaggcgcagcggctccgcatgcgcaccgaactcgacctcgagatgctccaagaagtcggctactgcaatgggatcgagaactactcccgccacctcgatggtcgcgagcccggacaggcgccctacacgctgctcgactacttccccaaggacttcctcgtcgtcatcgacgagagccacgtcggcctcccccagctccgcgcgcagtacgcaggcgatcgctctcgcaaggagaccctcgtcgagcacgggttccgcctgccgagcgcactcgacaaccgtccgcttcgcttcgacgagttcctcgaacgggtccctcaagccatcttcatgtcagcgacccctggtccgttcgagcgtgagcacgctgggcgcacggtggagctgatcgtgcgtccgacgggcctcctcgatcccaaagtcgaggtccgccccacgaagggccagatcgacgacctgctcgcggagatccgcgctcgggtcgagcgcgaccagcgggtgctcgtcaccacgctcaccaagcgcatggccgaggacctcaccgagtacttcgagggcctcggcgtcagggtgcgctacctccactcgacgatcgagaccttggagcgcatcgagatcgtgcgcgatctgcgcctcggggtcttcgacgtcctcgtcgggatcaacctgctgcgcgagggcctcgatctgccagaagtggggctcgtggcgatcatggacgccgacaaggagggcttcttgcgctccgagacctcgctcatccagaccatcggccgagccgcacgcaacgtcgagggcacggtgatcctctatgcggatgccgtcacgccctcgatggcccgagcgatctcggagaccgaacgccgccggagcatccaggccgactacaacgcacgccacgggatcacgccgcgctccgtgagcgcgaggatcgacgacctcgtcaccgagcgcacgcgcagcgcgccgacgccgacgctcgggcgtcgagcgatcgaagagcggaccgctggcatgaacccggagcaggtgcgcgacgtcatcgactcgctccgcgaagagatggagcgcgccgccaccgagctgcgcttcgaggaggcggccaagctgcgtgacgacatccgggcgctcgaggcactcctcggttcggacgcgatctcctagcgagcttattgccgctatcacaccccctatggtataatcggagataccgctgggggtatagcggttggtacctaggaggacacaggatgctcgatctcatcatcgtcccgacgctcgagctcggcgaccggtcgtacatcgtgcacgacgggcgtcgcgcgatcgtgatcgatccgcagcgcgacatcgaccgtatgctcgccatcctcgcggagcgcggcctcgaggcggtcgcggtcggcgacacccacatgcacaacgactacgtcaccggcggctatgcgctcgcgaaggagctcgacgtcgactacctcgtgttcgagggcgagcaggtgcacttcgagcgccgagcggtcgccgaccgcgaggtgctgcgcctcggcgacatggaggtcaccgtgctgcacacgcctggccatacgccgacgcacatctcgttcgtggtgcgcgatccggccgacgatcggccaccggtgctgctctcgggtgggtcgttgctctatggatccgtaggacgcacggacctcatcagcccggaggcgacctacggcctcgcgaaggaccagtggcactcggcccagcgcttcgcgaccgagctccccgggccgacgatcttgatgccgacgcacggcttcggctcgttctgctcgtcggtgtcggtcgaggaggccggcgactcgacgctcgatggcgagaagcgcgtcaacatcgtctacaagtacgactccgcggagtcgttcgcggacatgttggtggcgacctacgatccgttcccggcctactaccgccacatggggcctgcgaacgtctcgggtcccgcgccgctgcgcatcgacagcctcccgaagctcgacgttgcccaggtgaccgagctgcgcgatcatcacgaggccgcggtcgtggacatccggccccggaagcagagcctcgagggtcgtccggccggcacgctcgcgttcgagtactcgaacgtgttctcgacctatctcgggtggctccaccactacggtcgcccgatcgtcttggtctcgtccgacgaggcgaccgcacgtgaggcggcgctcagcctcggtcgtatcgggatcgacgaggtgcgtggctggatcgagcccgaaccgctgatggatgcctggggcgtcgagcgtctcgagcgcatcagctggcaggagtacgtgcagcagtatcgggggagcgatcacacgctcctcgacctgcgcaatccgtccgaggctcgggccctgccgatcccgggcgccatccagatcccgatctacttcttgccgaaccagatcgacgaggtggcgacggatcggaccgtggtggtgcactgcgccggagggtatcgcgccgcagcgggtgcggcgtggctgtcggcgaacaagcacattcgccctgtcgtcatcgacgacggggccgacgtcggcgcgcagctgctcgcggcgcagtcgtagtccgtcgcggcccgacgacgagacgttaggctcgtccccgccatggtgggtggggacgagcagcgtcgcggcggcgacacgccgctcgtcgtggtcgtcggcggtgcgcgctcagaggttccgatcgataggggcgcggtcgcagcgatcgtgcgcctcgttggtgtcggcgacctccacgaggcggcagcgatcgccgatgagcccagcagcgaacgggctctcgtgggtcgtcgtggcgtccttgcaggactctcgctgaccagcgatgagcccgccatcgcaggcgccctgatcgaaggggtcgccttcgaggcggcgcggatcgtcgatgggctcgacgaggcggtcgcgggctctcctgaggcccgcatccttctggagggtctctacgccgtctcggcggtggcgcaggtggtggcggacgtcctgggacgtgcggtcctcgacggcgccgggcagagggcgatgcccggaccacgcgcgagaagccggcgttccaggtggcgccggtggctcgaggatcaagggagcttgacgtaagcccagccgtcgccctggcgcgccacgaggtgagcgatggcggcaggcacatggccgacatcgctggcgaggtcgctgctcgtcgcgccgagtgcctggaggctgttgtcacaggcgaggacgcggcgccattcgagggcagggctcaggagtggctcgagcggtgagggcgccagcaggcggcgaacggccgcaccttggcagacgacctcgatcgtgaggtccggagcggcccgatggaggttcgcggccgacccgagtgctgctcgcagtgcgtccaggtcgtcggtcgtgacgtggatgagggcacctcgtgcgatcatcggatctgctcggcgtgcaggtccgaacggctccgtccgaagagggcgaggtgcatgaaggcgaacttggcgaaccacagcacgacgaaggaagcgaagtaggttccctggaccacgatgtcctggtcgagtcgggatgcaccgagcgcgagggcatgggcgtgcgccacgtcgactgcccaggtcgagacgatcaggctggtgagtgacatcgcgacgtagggcaggacctcacgggcgagcgacgagcgatcacgacggcgccaggcccaggagcgattgagccagtaggacggtgggatgccgacgagcgtggccacgatggcagcgtcacgcgcatcgaggagatgccagagtgagtagacgacgaggaggaccagctgcgacaagacggcggtcgctgccgacccggccgcgtagcgccagaagcgatcccacagcgggacgaaccgtcgcaggccgaccacctcgaggagtcggcgccccatgcgatcgattcggtccacgctctcccagcatagaaccgggcgccgagcgagcgcggatggtgacgtgttaccgatcggttaggaaccctcgggttgttgctcgtgcatccggatggtcgagtaaggtaacgaggtggtagcgctgcggtcgccacgaggtggcgaagcgcgttgcctgaccggagagtcgctggcgaaaggtggtcacgtgcggcagcaggcagagtgggcgatcgtcaccggcggctcgggattcatcgggaccgcggtcgctcgtgcgcttcgagcgcgcggcgtgcgggtcgcgatcgtcgatcgcaacgcgccgcagcaccgcgaactcgatgtgttcgtcaagggcgcgatcgagcacgagcgcacctggctcgccctcgcgaccgagctcgctggcgagcacgtccgtgcgctctaccacttcgcggcccgcaccagcgtcttgcagtcggtgaacgaccctcacgacgtctttgtgtccaacctggtgggctacgagaacgcgctcgagttcgcgcgcacgcacgaggtcgcgagcgtcctcttcgcgtcgaccaacgcggtcgtgggtgcgggtgacagcggcaccatctcggagcgctcgccgttggcgccactcacgccctatggcgcgacgaaggcggcaggggagatgctcgggagcgcgtacgccgctagctacggcatccacgtcgcgtcggtgcgcctgacgaacgtctacggtccggggatgtggcacaaggactcgatcgtgccgcgcctcctgcgtcatgtggtcggcctgtctgaggcgaccatctacggagacggtgagcaggtgcgtgacttcgtctacatcggtgacgtcgtggacgccttcgtgcgcctcgaggagctcggcttcgtgggcgcggtctcgttcggttccggcacgagcgtcagcgtgaatgagctggtcgatctcgtcggcgacgtcacgggccacgagctgcgcctgcgtcatgtgcctgcgaaggctggtgagatgccgggcgtgagcgtggacctgtcgctcgcgcgctcgctcggcctgaaggctgacgtcgaactggcggagggtctgcagttcgcgtggtcggacttccaggaggatcagggccgcgtcgccggctgagcgcagatcgcgcgcgctcgacgcgcctgtgagcgcgcgttgcggtgaccaccgacgcgggtgcttggcacaggatcgggttcgcgagccccggtggcggctcgcgctccatggcgcgtcacgcgtgtgggcggcctgagggtcgcaaggtcgaacgatcgatggcggaggcggtgtgcttcgagcgccgctcgcggccgagttcgctgcgctgtgcgctctcgctgctcgggtggggcggagtgggcaggcgctgccgacggctcgtgccgtgacgcgcccagcggcggagcgctcagcgttcggagccggggcgtgcttcgagttcggcgaggcgcgcgagcagtgccgagcgccgctcgtgccaccagtgctcgacgggggcgaaggcgctgccgagacgccagcgatcttgttcggtcgcgctctggcgtacgagggcgagggcctcacgggggtctgcctcgaggagcgatcggaagctgaagcgacggcctccgaagcggatgggcacctcggcgcggttggcggcggcgagaatgccgcgccgcgtgagcacgatccccgacagggcgggggagaggcacagctcgaggagcccgtcgaggtcatcgggagtctcgagatccggggcggctcgcaggtgcagtgggagagccgagggcacacccaggcgttcggcgaggctgttgagggtggcgaggaggtgttctgcccacggtgcgtactcggggggaccgagtgcgcgagcggcgcatgcgtacaacggaccgatcggtgcgagctgctcccagaggaaggcgcgtgcgaagtcgagcgcatcgcgatcgagcgcggcggcgaggacggagagcaagaagcccacgtgatcgcagagcgctggggtcgtgagatcggcgacgtaggtcgcgaggaactcgcgtgtgcgctccgtgggctcgccgccgagcagcgggccgcgcgtcaggaagaagctcgtgtaggggggcagctcgaagtcgaacagctcggtgaaggcggcacgcgagcgtcctaccccgaagagggcgaggagctcggggtcgggctcggggttctcgctgagctcggcgaggccccggacgacctcggcgagcttgcgcgtgtcactgtcgagttggttcactggcggtcgccgaggtcgggagtcggaaggcctctggggtcggcttgagcggacgcatgagccagcgagggcggcgcgtcccgtcggggctgacctcgcgggcggaacgagcgagctcgagccagcggtggaacacctcgcgcgaacgagcggtgtcgacgtagacctcggcgtggcggtcgccaggctgggctcgggtcacggtgacgacctggtgccagcagtgcatccccgagatcggatcggggtgcacgccgaaggtgaggttctggtgcacgcccacgtcggtccaccagatgcgctgggtgtcgggatcggccgactcgtagggcgcgacgccgtcggaggggtcgagcgtccagcgtgatccctggcggcgcagggcgacgagacgcatcatgcccttcgatccgacgtcgccgaggcgccaccgtcccatgtggtgcgagcaggcgacgacaccgggacggatgccttcggtgacccacgccttgacgacgaagtagccgagatcggtggtgacgcggacgagctcaccgtcgcgcacgccgatgcgggccgcgtcggtcggatggatccacagtgggttcgtgtgggcgatctcgtcgagccacttcgagttggccgaccgggtgtggatctgcacgggcaggcggaaggtcgagatcaggggcatctgcccgtcggcgagcttcgacggatggacgtggctcgggatgtaggtcgggatggcgtactctggccatccccacgaggcgacggtggccgagtagaactcgagccgaccggagggcgtggggaagcctcgcaggatcgcgccgtcgacctcgacgccgacgggccgacgtccctcgtcgtcggggctcgggtcgccggtcgggacgatgttggcactcgcgggcttcggagctcgagtccagacccggccatggtcgtcgacgtggacgtcgtcgagttcctcggccgggacgggccgttcgtagacctggccgacctggcgcgcgacctcgaaggcaccgtagcggcgcatgtagccgagcggcgtgaggccctccttggccgcggcttcggggagtcctggcaccgaatgctcgaacatccaggcgtagtactcctcgacggagagcttctggccggggttggctcgagactcgaagtagcgccggatacccagggagccgtcggggtcgatgcgccacgacagctcgatccagaactcgttctcctcccacacctcaccgggattgacctggcgggtgtcggtgacggtctcgccgagacgctcacgagccgctcggagcacgggttggcgaaacccgatccactggccgtcgtactgctcgtaggagtgggtgtcgtggcgttcggaggcgtgacccatcggcaagatgtagtccgcgaagaacgcggtctcgttccaggtgggcgtgagcgcgacgtagcacccgactttgtgctcgtcgagcagcatctcgatccaggcaaagccatccgggttggtccacacggggttgtagaccctcgtgaagtacacctcgagtcgcttgccgtactcctccatgaggtgcgggagcaagaacgagagctcgttctgggcaagtggatagtcgacgggccaggacagctcctgccagaccttcgggtgcggcgggacgtggatcggtcgtggcacgaacttgttccaggcattgaggttcgtgccccctggcgtcgcgacggcccccagtagtgcgttcaggaggaacagcgtccgagagacctgccagccaccgaggttgccggcggctgccgagcgccaggtatgcgtggcgagctgggtgccggcgtcggcgacgagctcggcgacctcgcggagcgtggcttcgtcgacaccgctctccttggccgcgtacgcgaaggtgaagtcggagtagagctgcttgagcacccccacgaaggcatcgaaggtcaccgggagctcggggtggaccgcctcgaggtactcgcgccagttccaccaccgctcgacgaaggcgcggttgaagcggtcgtgctggatcaggtagttcgcgatcgagaggttgatcgccgcttcggagccgggccacggcgacatccacacgtccgcgtgcgtcgaggtgttcgacaggcgcgtgtcggcgacgatgagcttcgcgccgcgctcgcgggcttcggtgatgcgctgcgcatgagggttgaagtagtgaccggtctcgaggtgggagctgatgaggtagatcaccttcgcgttggcgaagtcggcgctgggccgatcgatcccgctccagaactgatagccagttcgtccacccgacgagcacacgttggtgtgcgagttgtggccgtcgacgccccaagcggcaaggacacgctcggtgaagccgtcttccccaggacgaccgaggtggatcatgatctcgttctggcggtcctcgacgagcgcctggcggaggcgacgggcgagatcgtcgagcgcctcgtcccagctcacgcgctcccacttcccgctcccgcgggcccccacccgccgaagggggaagaggatgcggtcagggtcggtgatctggttgagcgtcgcgggacccttggcgcagttgcgccctcgcgagccgggatgttcggggttgccctcgaacttgcgcacggccaaggtgtcgcgatcgacataggcgaggaggccgcaggcgctctcgcagttgaagcaggtggtgggcacgagcatcgatcgatgctcgacgcgcttcggccaggcgcgcgagtcgagctcgacccagtcgtcccagcgctccttgggcgggaagctcgcgaggtcgatgcgcgagggcccctggtagaaggtttccccgcgtgcctcggtctgctcgcggagcgcgcgaatgcgagccgagagagattcgacgtcgttcgtagccatggtggtcgtacctccgagggttacgccaacgggacgcgttggccggcttggacgtaggcgtgttcgagcgggaggatgcacaggagcgctgctgcggcaagggccatgccgagcggggtgaggatcccgacgagatcgagcgcgaatcccagccagaagaggcgcccgagtgcgccgtgggtcatctcccacacggcaaggtgggccttggccgtggggtgcgtgatggtgatctcacccaccacgagcagcgcgttcaggatcgcgagcgcgcctgtgagacgctcgaggtagccgaccgtcgagccgggatcggtgatggccgcgacgaagacgctgacggccgatccgagcaggagcgcctggatgacgaggtggatcggcatcagggggctctgccagagatcgcgtgctttggcttgggcgaacaggaacgcggtatagagcgccgcgagtgcggcaaggggaatccccgggatggcgaggatgcccatggcggtcgagctgtgcaggatgccggcgatgagggtcagcgtgtcgatgccgccgaagaggaggagtccgtagccccccctgacgagccagctctcgggtcgacccttgaggaagagcaggtagaagcgttcgggatgcttgaggtcgccgatcaggagccccccggtgatcgcgaggaaggcgagcgagatcgacggtccccagatgcggacgaggtccgacgagaacggcagcttcccgagcaaccacagcgtgatcggcacgaggtaggcaccggccgagaggcccttcgtccaggtgtagaggctgaccaggccgccccacggtgcattgtgggcgacgtcgtagaccagcttggccttggccgacgagttcggcacgtgggcgtcggccgggtggcccgaggcgatgacgtgcggtccgctcgggatctgggaccacatgtacgtatcgccgcgcggacgctcggccgcgatgggatccagggttgcctggtgtgcgccgcgatagaacagcttcggacgggtccccttctccgggttgcgcacggccaccggggtgcggtggacgacgcgggtcgcgcgtgcggtgtcgtcctcgagcttgccgatgaggatggcctcggtcgggcagacgacgacgcacgccggttcgaggccgatgtcgagacgatgcgcacagaagttgcacttctcggcggagtggtcctcgggattgatgaagatggcgtcgtaggggcatgcggccatgcacgccttgcagccgatgcagatggccttgttgaaatcgacgatgccatcgggtcgctgatacatcgccccagtcgggcaggccgcgacgcacggtgggttggtgcactggttgcagcgtgtgacctggaacgagcgccgaacctgcgggaacgtaccgacctcgacggccttgacgtaggtccgcgtcacccccagcgggacctggttctccgacttgcacgcggtcgtgcacgcatggcagccgatgcacttggtttgatccaggaccttgatccaggtctctttggatgtcgtccgttgctccgtgagcacgctcgccccaccccctgcagcacacagccgtgcgtacgatcggcgcacgcacgcatgtcaacgcatacccagtggggattctaggaacgtgctgcggctacgtccaggaggcgccacggcggccccgggacgacaaaggcagcccatcagggcgtgtgagctgcgatgatgggcgattctgccgccagaggctcacagctggccgggtggcgagatgtgagccctggcaacgctattgcctgcgtgacaggcgttattcgaggagtgatcgagccgcagaattagcgcatcgcgtgttcgcgctcggctcgggcgcagaaggcgcagccgacggtcgttcgatcgccgaagagccgatagagcgggcagtagccggtcagcccggtgatcagcatgatggccgcgagcgcgtagagaacaacgctgccgacgctgccgttgccgaccatgacgccaagcgcccagaacactggcgtcgcgacgacgatccgcagtgctcgatcccagatacccatgttccgtcgcattggtgcctccttgagtggtcctagaccatccaacgcgcggctccgacgagcaacgtcccgggcggcaccgacaagcgacgagggtcctaggaggtcgggaccttcgtccgacgacgggtgaggacgagagcccctacgaaccaggcggcgaggccgagggcgctcgcggcgaggccctcgccgaaccgtggagcgtggtagctcatgacgaggtgctggcgcccagctccgacgtcgacggtcatctgatcggaagggctggaaccaacgggagccgggtgaccgtcgagctgggccgaccagccgggcgcccacgcgaaggggaggacgagccgggtcgggtgggtcgtgacgacggtcgccgtgatggtgcccgatgcagcttgggaggcgtcgaggacgcgcaggccctgctcgggctcgatccagtgggcgggctcagggagctcgaatgcgagtgctgcgccccgaacgatcagttcgtgccaactgctcggagcgagggcagtgtcgagcgggccaccgaggaggtaggcgccgctcgaagcgacggcgacgacacggacggggagcgtggcgcccttggaagcgctgagacggacgctctggaccgtctcgccgccgggaatggcgagctggacggacgatgcccggtgctcggtcgcggcctggatcgtcgcgccgctcgtgagcgtcacgctcatggccaggcgtcggacgggactggcgacggtggcggtgagcttcgtgacgccggtgagatcgccggcgtagacgtcgaggcgaccgtcgcggagcgagagcggagatgacgcggggagtcgggacgccgtcggagcttccgtggcgaagtagcggcgtgaggtgacgacgaggcggacattgaagtcgcgaaccaaggtggacagatcggccggatcgaacgtcgactccggcttggtgccggtggcggcgtcgtagcgagcgaggccgagcgagctgtagcccgaggccgacagtgtgtgggcgtagatgttggtgtcgggctgcgcgtcggtcgcgatcaggctctcgtagagatagagctcagggtcgtagacgacgtagcgcagaggtcgtcggagcaacgatgcgaccgtcggtgccgtcggcattcgcaccggtggcgagagcgacgagagcagcgggaactcgaggacttggttggcgacgtcgaggacgaggacgaggacgaggatgcgcagggcccaaccgcgcaagggcgagccgaggagcacgatggtcgccgctcccacggcgatggccatgacgacgaggtagccgcgcagtgcggcgagggagatccctgtgggcagcgacaccacgttgaagtgttcgagcagcgcagcgggcgcgacgatctcgacgagcgcaaagcccacggcgagggtgccaaagacgatgagtgccactcgagtcgggaggtggtggcggaaggagtcggggtgggcaagtgcccagtcggcgctgccggccgcgaggagcacggcggcgaagtcgaccccgatgaggtaacgggacgcgagtcgctggaggtcgaacagcgggagccggtagacgaggtgcgcgaacggcgtgtggccaccgagtgcgaacagcatgctgagcaccgccgcactccacagggcaggtgctgcaccacgtcggagcgtgctcgcacggggacgcacggctgcgaggaggaggaaggcgaggccgagcgcggtgatcgagacgttgatctcgtaggggttgtagttgccgaagtaggagatcagctctcccccaaaagccatgggatagacggcgagcggcgtgaagatccccgaaaacggtccggcaccggcgtagtgcgggggcaggtgggctcgcgtcgacagggcggtaaaggcgagcccgggtacccactggatcgctgcgagcatgagtgcttcgagcgcgcagatcgcgatgacgacgagatcacgaacgtcgagtcgtcgcccgagggtccacacgacggcggccaccgccaagacgacgaggcccgcgagcatggcttcgggcgcgccggcgagcacgtcgagcgcgaagccggcagcgagcccgagggcgttggcaagtcgagaggagcgtccgtaggcgaggcgagccaggaagacgaaggcaagcatccatcccgcgtcgccttcgatcatgtcgaggtggacactctggccgatcgccgcacccgtgagggcgaggacgaggccggcgacggtggcgaccttgaccccgatgcccagggttcgcgccgagagataccccgacagtgcgatggtcgcgaaggcggatccggcggcgacggagaaggcgagccccgtcgggaggacgatgaacgggatgatgaaggggctgaaggcacccgcgttgaagccagcggcgaggggcacgccgctccagatggcgggatcccacagtggccaggagccatggcgcaggtcgaggccgacgagcgtgcgaagcggtgcgttctgcgtcgcgttgtcgccaaagaggagtgggtgccccgcgagtgccgggacgacgaagaggacgatcgggacgacgatgaggatgacgacggctcggcgcgcaccggcatcgcccgtggtcgtcagcgcggcgcgatccatcgctcacgaagataggtacgcgccaccacgcgcccatagcgcaggccgtagcgccagttgcggcccttcttcgaggtgccggcgcggcgagcgaccatcgtgacagggaactcgacgatcgttgcgccggcgaacgctgcggcgaggaggagttcggcggattggtactggggctggtcgagccggagccgtccgaggagctcggccgcgatgacgcggatacccgatgacgtgtccccgacccgctgaccgatgagcgcggacacgacgagcgagaagactcgaacgccaaggtcgcggatggggtcgcccaccgtgctcgtgccgagtcggcgtgagccttgtgcgaacgtggcgacgtggtgatcgacgagatccacgcccgtcgcaaggtcggctgggtcccactggccatcggcgtcgacgatgccgacgatgcgtgcgccccgacggatcgcgaggaggtaaccgagacggagtgcagcgccttggccgcggttgatcgggacgtcgaggacgagcgcaccttcgcggcgtgccacgtcgacggtggcgtctcgggaaccatcggacacgacgacgacgagcggtggtgagccggcgagctgtcggggcacgcgccggatgacgtcggcgatggtggcttcctcgtcgaatgcggggatgaccaccatgactgccgcctcgggcaacctcgggttgtcgtcgtcgaagcgtgcgaggacgaggcggtcgatggcgtcatccgggtcgaaggctgcgctgcgcacgtcgggtgtgacgcgcacgggaccaccacctttctcgagccggatcctcgcgatgtccgaggctcggctcatcctaggggcgcgcgcgaggaggccagggccgagcgctgcgaaggcggcgcgaacagcgccaccgcggccccgatcggtgctagcatgcgctggcacaaaccctacggatagggtgcgaacgacacacgagggcactagttctgtggtagcgtttcgcaacacggtcgatcggctacggacggtggtggatcggggttcggggctggaggcctccagtccagaggtggaggacgagcaacgtcggtgggctgcgtcggtcggatgggacgcacgttcacgcggtcgtgactcagcaggccaacggacgttggcctgaccaagaaggggagtgagagggaggcgcagtggcaaggtccacgagtgcacggattcagcggcatttcacggctccggggctgcacccgtacgagacggtgggatgggagcgtcgcgacgcgcggatcacgaactggcgtaccggcgacgtcgcctttgagcaacgagacgtcgaggttcccgtgacgtggagccagaacgccacgaacattctcgcgcagaagtacttccggggccatctcggcacaccggagcgggagggctcgttgcgccaggtcgtcgatcggatcgtgaatcggatcgtggcctggggcgaggccgatggctacttcgccgacgacgacgagcgcgatgccttcgcggacgagttgcgctggctgctcgtccatcagcgagcggcgttcaactcgccggtctggttcaacatcggggtcgagggcgtgccgcagcaggcgagcgcctgtttcatcctctccgtcgatgacacgatggagtccatcttgaactggtaccacgaggaagggatcatcttcaagggtggttctggtgccggggtgaacctctccaccatccgctcctcggtcgagccgttggcaggtggtggcaccgcttcggggccggtgagcttcatgcgaggcgccgatgcctcagcgggcaccatcaagtcgggaggcaagacgcggcgggctgccaagatggtcatcttgaacgtcgaccaccccgacgtcgaggagttcgtctggacgaaggccatcgaggaacgcaaggcgcgcgtgctcgcagaagccggcttcgacatgggcgtcgacggcaaggatgcgttctcgatccagtaccagaacgccaacaactccgtgcgcgtgaccgatgagttcatgcaggccgtcgtcgaagaccgggagtgggaactgcgggcggtgacgacgggcgaggtcaccaagacggtgcgtgcccgtgacctcttccatcagatcgccgaggccgcctgggagtgcgctgatccagggctccagttcgacaccaccatcaatcgctggcataccacgccgaatgccgggcggatcaacgggtcgaatccgtgcttcccgggctcggccagggtccacaccaacaaaggcctcatcgccttcgaggagttgaccaggcgcgtgctcgatggcgaggagttcctggtctacacgcacgacagcacgagccctgacgatcctacggagcaggtgctgctctcctcgccagaggcgttcatggtcaccgggtacaaccaagtcgtcaagttgcgcttcgacaacggcgccgaacttcgctgcacaccgggacaccgcatcttcacggtcaatcgcggttacgtcgcggccgaggacctcaccccggaggacgaggtgcagctgctggatcttccggcgccagccacggatgcatcctgggtgttgccggtggcaaccgatccggagttctaccatcacaagggcgaccgccgcgacccgatgaccttcccagagcgctggagcgaggacttcgcccacttcttgggttggctcatcggagacgggtcgctctccaatgggacggtcgtggcgacctatgggtctccagacgaccagcaggagatcttgccgatccaccagcaactcctgctcgagatcaacggcaacaggcctctgaaggtgtcgacccaagccaacggcaccgtccagctgcgctttggcaggcaacggttcatgcggttcttggaagcgctcggcatgaagagggcgaagggaccggacaaggatgtgccgtgggcgatcgagcaggctccagcggagatcgtcggcgcctttcttcgaggcttgttcgacgccgatggcacggtgatcgtcgaccgcaacaaggggtcctacgtttcccttggctcgatctcgacgggcttgctccgctcggtgcagcgactgctgacgacgttcggcatcacgagccggatctacaagacgcgttcggggtcgtcgaatgggtcgttctcgtacaccgggcgtgatggggacgtgagggtgtacccgaaccacgatgcttatcagctacggatcacctcggcgtcgatcgtgcgcttcgccgagcacgtcgggttcggcctcggcgccaagcaggcgcggctgcgcgacatcgtgggtggacagcagtcctacgaggttcggcggacggcgcggctgacggagcgtctcgaggacgggatcgagctcacctacaacctgagcgagcccaagaaccattcctacatcgtcgatgggattgtggtccggaactgctcggagtacatgcatctcgacaactcgtcgtgcaatttggcttccatcaacctgcttgcctacctggacgaggacggcaacttcgacgtcgaggggttccgtcacacggcgcgagtgctcatcacggcgcaagacatcctcgccggcaacgccgactacccgacaccgaggatcgcggagacgtcgcgggcctatcggcaactcgggctcggctatgcgaatctcggggcgatgctgatggcgctcgggctcccatacgactcagacggcgggcgcgcctatgcggctgcggtgacggcgctcatgacaggagctgcgtacgagcgttctgcagagctcgccgagcgcctcggccccttcgctggatacgccgacgatgctgagtccatgctgcgggtgctcgggatgcatcgcgacgccttggcgaaggtcgatggcgctccggaggcgatcgtcgaggccgctcgtgcttcgtgggacatggccatcgcgcgcgcgagcgaggtcggcgtccgtaatgcccaggcatcgctgctcgcgccgaccggcacgatcgggtttctcatggactgtgacaccaccggtatcgagccggacttctcactggtgaagtacaagaccctcgtcggtggcggcaccatgaagatcgtcaaccagaccgtgccacgggcgttgcggacactggggtatccggagcacgagatcgaccagatcacggcctatctcgccgagcacgactccatcgtcggtgcgcctgggctcaagccggagcacgaagccgtcttcgcatgcgctgtcggggaatacccgatcagcccgacgggacacctcgcgatgatgggggccgtgcagccgttcctctctggtgcgatctcgaagacggtgaacctgccgagcacctccaccgttgaggacgtggagcagacatacctggatgcctggcggctcgggatcaaggcggtcgcgctctatcgcgacggatcgaaggtcggtcagcccctttcgacgacccatgaggaggattctgaggccatcacgtcgctcaaggaacagctgagcgagctcgaacgccagctcgcagcctcgcggacgcgccccgttcgggaacgcttgccgcgacaccggcggagccgtacctatgcgttccaggtcgctgacgccgagggctacgtgacggtcggggagtatgacgacggtcgtccgggcgaggtgttcgtcaaggtctccaagcaaggctcgacgctcgctggtgtgatggacgcgttctctatcgcagtgtcgctcgggctccagcacggcgtgcctctcgagacgttcgtgcgcaagtacgtcaacatgcgcttcgaaccggccggcatgaccgatgacccggatgtgcgcatcgcctcgagcctcgtcgactacatcttccgccggctcgccatcgactatctgccgcgagaggtgcgcgaggacctgggggtgctgacgacggcggagcggcgaacggagttgctgttcccagtcgaggaggtcagtgagccgacaacgcgtgcgagtgcgcagacgtactctcaggctgagcatcgcttggactcgggtcgggatgacgtcgtgcatgagactgcgactcgtgagagcgggctgcacgtctcggcgagcgcgtcggacgcaccgtactgcttctcgtgtggcaacgtcatgcagaggtctggctcgtgctacgtctgtcctgcgtgcgggacgacgagcggttgtagttaggtcgagcctgtcgcgagttttcgcgttgcgagttgcgagtttcgcgacccggggtagacgcagacggtgaagggtcatgatgcaaccaggggcgccgcatgagcggctcccctggtgctgtcatacggtagggcgggagccgccttggcagcggttcctcacatcgatgctgctctccggtgagaagagtcgggcctctgatccctgcgagcgatcggccgagtagccgcgtcggtcgcccgcagagatcgtggtcgcggtcgaggcgtcgggccggcgggacgagagcgagcagcgctctcgtcgtgaaccagggccgaacgtcgggtcgtgctggaccacaagtcccttcgtggacccgctctgggagcgacgccatggccctactaataccctctggggtatgacgaataccacaacgtcgcacgagcggccggagggggtggggcggcgcatcgtcgtcgtcggtggcgtcgctggcggtatgtcggctgctgcgcgtcttcggcgactctgtgagcatgcttccatcaccgtgatcgagcgatccggacacgtctcctacgccaactgcggtttgccctactacgtcggctcggtgatcgaggaccgtgaggacctcgtgctccagacgcccgaacgtctccaggcccgcttccggttggacgttcgagtcaacgccgaggttgtctcgatcgatcgtgagcgtcgcgaggtccgtgtccgcagcgtggagaccggtgaggcctcggtgctcccctacgacacgctcatcctgagtcctggggcggtcccgatccgcccgagcatccccggggcagaccggatgcgcgtgctgcgcaccgtcgaagatgccgaacggctcgcctcggaggtgacgacgcggcctcggagcgcgatcgtcgtcggcgcggggttcgtcggtctcgagacggcagaaaacctggctcaccatggcatcccagtgacggtggtcgaggcgcgatcgcaggtgctgccggtgctcgatccagaactcgccatcgcgatcgaagagacgctggagcgccacggcgtccgtgtgatcacgggggctggggtggccgaggtccatgcgtggggcgtcacgctcgacgatggccaggaggtcgagggagacctggtcgtggctgctgtcggtgtgcgtccggacgttcgactggctcgcgcagcagggctcgagctcggtccgcacggcggcatcctggtcgacgagacctctcgcacgagcgacccggcgatctatgccgtgggtgacgcggtcgagaaggtcgacgccatcagcggatcgctcgagctcgtgacgctcgcacatgtcgccaaccgccaaggccggcgagtcgccgatcacatctgtggacgcgcggtcgaggcgcgaccgtcgatcggcaccgcgatcgtgcgcatcttcgacacggtcgccgcatcgaccggcctgagcgaacagcgcctacgggcactcggtcgtgcgtaccaggtcgtgcgcgcgcaccccatgagtcacgcgagctactacccaggtgcccagccgatgtcgctcaaggtcatgttcgacccgagcgacgggcgcatcctcggcgcgcaggcggtcggcggcgaaggggtcgacaagcgcatcgacgtgctcgcgacggcgatcgcggcaggattgccggtcgacgagctcgcgaacctggagctcgcctatgcaccgcccttctcgtcggcgaaggaccccgtgaacatggtgggttacatcgccgagaacatccggagcggtacctgcgacgtggtggagccggaggaggtggagtcgctggtgcgcgatgggtggacgctgctcgatgtgcgcaccgccgaggagcatcggcacggtgcaatcccaggcagcgtctcggtaccggtcgacgagctgcgcgagcacctcgaatcgctcggggacgggccgttcgtggtctactgcgccgtcgggctccgtggtcacgtcgctaccacggcgctcctcgagcatggcttcaaggctcgcaacctgaacggtgggcatcgctcgtgggcagcgtggaaggctgctgaacgcatggcgctcgccgggtgagccggctgaggctcacccggccacgatcggcgtcaccatcgacccatggctaggcccgctcggattctgccgtggtggcgaagtagtcgcggtactggcttcgaaggaggtgcttctggaccttgccggtggcggtgcgtgggagttcgtcgacgaggatcaccgcctttggcaccttgaagccggggagggcgctgcgggccgcggcgaggacgtcggtctcggtgagtcctgagccggggcgtggccgtacgatcgcaacgactgcctcggtccagtgcgcgtgcggcaggcccaccacgacgacctcgtcgatgcgcggctcagctccgtagagtgcacgctcgacctcgagggatgcgacgttctcgccgcccgtcttgatcacgtccttgcggcgatcctcgaaccacagcaccccgtcggcatcgaggtaacccacgtcgccggagtggaaccatcccccggcgaacgcctcgttcgtcgcctgctcgtcgtggagatagccctgcatcgcgtgaggaccgcgatagacgatctcgccacgcgtgtaagcgggcacgagctcgccggcgtcgttcacgatggcgacctgcacgttcggcaccgcgccccccacggcaccggcgtgggagagctgttgctccgggaggagcacggtggtgaggggattcatctcggtttggccgaagccgagggcgaggtcgcagccgagcacctccgtcacgcgcttgacgtcggtctcggccatgggcgccatggcgtagatcccgagtcggaggctcgagaggtcgcggcgggagacgtcggggtgatcgatgagcgcgcggtacatcatcggcaggaggaagatctgcgtgatccgttcgcgctcgatgctcgcgagcagagccgcagcgtcgaaggatcggtgcaggacgacggtgccgccgaggtagagcaggcccgtggtgaggccgttcagctgcgccgtgtggaacagtggcatcacgacggcactgcggtcggcgtcgctgtagtgcatcacgatcggaccggtgagcgactcgatgtagaccgcgacgtgactcgagaccacacccttgggcgccgacgtggtgccactcgtgtagaggtaggtcagcggatctcggtcgtcgacgaagcaggccggctcgctggttgcgttcgggtcgacgaaggcatcgagcgtgtgccaggtgccctgtggcgctggttcccactcggcccctgttccaggggcgacgatgacgtcgacgaggtcgtggtgctcggcgatcgccagcgcaccggagatgagggggacgaactgggcctcgaccaccgcgccgcgggctctggcgtggccgagcacgtaggccagctcgttgggcccccacgccagattgatgggcacgcagacggtgccggtcttggcgcaggcgtagtaggtgacgaggaactcgatgctgttgccgctgatgagcaggagtgcggtgcccctgccatagcccgcgtcgaggagggcatgggcgaatgcgttcacacggtcgttcagcgctcggtaggtcagtcgctcgtcgcccgcgatcaccgcctccttctcgccgagacgccacgcgctccgcgtgagcatgtcgccgacgttgacgcgctgaatcaggttgcgttcgagatcgtgcgatgtcatggttccccctgtcctcggggccggtcctcggggcctgtcctcgagcgtgtgctcggagctacgtgcgccagaccacctcgccccccgctcgttggcaagtatgccaggggctggtctcgctgtcgagggatcgaggaccgtctcggcgggcgggtgcgatcacccgtgagaaggtgcgatcagggagcgaggccgatggcgcgcgcccagatctcggtcatcgcatcgacggcggcctcgtcgtcgaaggggaggccgaggtcgtggctgcgctcgacgaagttctcgaccatcccgcacagcaacgccgccgtcacgtcggcgtcgagggtcgggtcggcgactccttgcgcttggagctggcggaggccacgagtggcccgctcgatgaacaccgagcgcgaggcgagtcggcgacgtcggacctcgtcgttgaaggacgcggcctggacgatcactccgtagaggttcccatggcgacggaacgcctcgacgaagcgcgcgttcgaggtgcggatgcgctggcgtgggtctggaccggcgacttccccgacgtgcgactgctcgtagagcgcggcgatgaacgcatcgacgagcgcgacgaagatcgcgtccttcgagtcgaagtaggtgtagaaggtcccgatcgcgacgttcgcgcgctcggcgatgtcgctcacccgggtctcgaggaagccacgctcctcgaagacggcacgagcggcctcgagcagccggtccctggtacgccgtccgcgttcggtgaccggggcggcgctcatcgcctcggctcgccggagcgctcgacgagtcgcacggtcggggtcgggagctggtcgaggctccggggatcattgcgtgcggtcacggtgacgggtacgctaccagatgaaagtgacgtcaggttcatgttctggcatcggcgtggccggcggccctcgcggtcgcctcgaatcgaggggggagcatgcgcttcaccgaggagcacgacgtctttcgacgcagcgtacgtggggtgctcgagcgcgaggtgctcccgcacctggaggagtgggaacgggctcacagcttcccgggccatacggtcttcaaggccctcggcgccgccggtctgctcggcctcgagtacgacccggcctacggcggccagggcgcggaccactcctacacggtcattttcggcgaggagctcggtcgcatgggcttcggggcgctcgccatggccatctcggtggtgaccgacatggcgaccccgtcgctggcccgttacggctcgcacgaactcaagctgcactatctcgtgccgaccctgcggggggactccatcgcatcggtcgcggtgtcggagccggacgcgggttctgacgtcgcggcgctccggactcgcgccgtgcgcgacggcgacgactgggtcatcaccggcaccaagctctacatcacgaatggcacccaggcagactggatctgcctgcttgcgcgcacgagcgatgagggcggctatcgggggatgtcccagatcgtcgtcccgaccgacgcgccggggtttcgggtcgcgcgcgccctcgacaagctcggcaaccacgcctccgacaccgccgagctggtgctcgaggagtgtcgcgtgcccgtgtcgaacaccatcgggaccatcgggcggggcttccagcagcagatggcacagttccagaacgagcgcatgatcgcgtcctactcggcggtcggcgcgatggaacgtgcgctcgagcgaaccgcggcctatgcacgcgagcggatggtcttcggggagccactccttgccaagcagtacgtgcagtttcgcttggcggagctcagcgccgaggtcgatctgcttcgtcactacaactacgcgtgcgccgaggcctatatggcaggcgaggacaccacgcgctttgccaccattgccaagctcaccgcgggccgcctgagccgcgccgtcgctgactggtgtctgcagctccacggtggggctggctacatggaggagacgtgggtgtcgcgctacttccgcgatgcgcggctcctctcgatcggaggcggtgccgacgaggtgatgctccagatcctgacgcgcctcgagggctacgagccatgagcggatccgggctcgatctcgtcgggctcatcgacgacctccaggccgagcaccgaaccctccgtgcgaccctccacgacgcagggtgggaggtgtgggagctcccgacgcgcgcagcgccgtggcggatccgagagcaggtggcccacctcaccttcttcgacgaggtggccatgtggtcgatcgaccaccctgagcgcctcgacacactgcgcgccgcgttcgacgcatccatcgatccgagcgagcgcgccgacgtggtctgggcacgcgagctcgctccccagaccctctgggagcgctggtgccgagcgaacgacactctcgttacccggctcgcccggctcgtcgacgaggatcccggacggcgcctcgactggatcgggccgtcgatggggcttgcgagcttcgtgagcgcgcggctcatggagacctgggcacacggggtcgacgtcgtcaacgcactcggccacgacgtggcggacacggtgagcgaccggcttcgccacgtgtgctttctcggttgggccgcgagacgcttcgcccttgcgacccacggcatcaccgacctcgacgatccactccgactcgaagcgatcgggccctcgggcgagctctgggcctgggggcccgaggatgccccgaatcgcgtgcgcggctcggcgctcgagatcgccctcgtcgtgacgcagcgacgccacgtgtcacgcacctcggtcgaggccacgggggcgcttgctcgtcgttggctcgaggtcgcccaggccttcgccggcccaccgacggtcgcctcgaaggagcgctgagccgtggcagcgccgatcctcgaacgccccgtcgacccgcgcgacccaggcttcgtcgcgaaccgggcggcgatggtcgagctcgtggaacagctcgagtcgctcctcgaccaagccgctctcgggggaggtgccgaggcccacgcgcgcagggccgcgcgaggcctgctcggggtgcgcgaacgtgtcggcctcctcgtcgatccggagagccccttcctcgagctgtcacccctggctggctatgggacggagtaccgactcggtggcgccatggtgcttggcatcggcgtcgtggaggggaccgagtgcgtcatcgtcgcgaacgacccatcggatctcggcggtgccctcacgcagatcagcgtgcgcaagctcctccgagggctcgagatcgctcgcgcgaatcggatgccgctcatccagctggtcgagtcggccgggggcgacctgcggggcttcgtaccaggcgacgatccggacgctgccctgcgtcgcaacctcgagcacttcgccacctccggccgcatgttccacgacatcaccaccctctctgccgagggcatcccgacgatcgccgtcgtgttcggctcgtcgaccgctggtggtgcgtaccaaccaggcctctccgactacaccatcctcgttcgcgaccgcgcgaaggtgttcctcggcggcccgccgctcgtgcgcatggcgaccggcgagctctccagcgacgaggagctcggcggcgccgagatgcacgcgacggtgagcggcctcgccgactatctcgcacgagacgagctcgacgccatccgcagcgcacgcagcgtcgtcgcccatctccagtggcgcaaggcgggtcccgggccggttcggcgcgatcctcgaccgccgcgctacgaccccgaggagctcctcgggctcatgcccatcgatctgcgcggcccggtcgacatgcgggcgatcatcgcgcgcatcgtcgacgacagccgtttcgaagagttcaagccctcctacggccccacgctcatcaccggatgggccgaggtgcacggctttgcggtcggcatcgtcgccaacgacggtgtgctcctctcggaggcgtctgccaagggggcgcagttcatccagctgtgcaaccagcgcgcgacgccgctcgtgttcttgcagcacatcaccggcttcatggtggggagcgactacgagcggtccgggatcatcaagcacggcagtcagctcatcaacgcggtctcgaactcgaccgtgcctcacgtgacgatcatcctcggtgcgagctacggtgcgggcaactacgccatgagcggtcaggcgttcgacacgcggttcgtgttcgcgtggccgacggcccggatcgcgatcatgggaccgacccagatggcgggtgtgatgtcgatcgtacggcacgagcaggcagctcggcgcggcgtcgagatcgacgaggaggccgaagcggtgcttcggtctcgggtcgaggcgttcgcgcacgcccagtcgttagcgctctacgcgacgggccgcgtcgccgacgacggcgtgatcgacccgcgcgacacccgcgacgtcgtgggcatggcgctctctgcgtgtcacagcgcgccggtcatcggggctcggggctacggagtgttccgcctatgatccgccgcctgctcatcgccaaccgtggcgagatcgtcgctcggatcgcgcgcacggcgcgcatgctcggtatctggaccgtgggggtgtacgcgccgcccgatcgctcagcgccgtggctggacgcgaccgatgacgtgatcgggttgatcggtgacggcgtccaggagacctacctgagtgtcgaggcgctcctgcgggcggcgcagcgtgtcggtgcggatgcgctccaccctggctacgggttcttgtcggaacatccgggctttgccgaagccgtgatcgccgccggcctcacgtggatcgggccgccaccggaggccatcgccctcatgggcgacaaggagcgcgccaaggcacacatggctcgcgcgggtgtgccgacgctaccgacgttcgcgcccgacgacccggacgtcgtgctgccggtcctcgtgaagcccactgccggcggcgggggcaagggcatggacgtcgtgcgcgagcgtgcggcgctcggcgcggccatcgacgctgctcgacgcacggctgcgggcgccttcggcgacgatcgggtcttcctcgagcgcttcgtcgaggtgggtcgacacgtcgagatccaggtggtcgccgacgggcacggggcagtggtgcactgcttcgagcgtgagtgctccatccagcgtcgtcaccagaaggtgctcgaggaggcgccctcgccggtcctcgatgcggaccttcgcgagcgcatgggggcagcggcgtgcgcggccgctcgcgcggtcggctaccgaggcgtggggacggtcgagttcctcctcgagcccgacgggtcgtactggttcctcgagatgaacacgcgcctccaggtcgagcacccggtgaccgaagccatcaccggcatcgacctcgtcgccgagcagctgcgcatcgccgagggccgaccgacgtcgctgcgccaggacggcctcggcatcgacggccacgcgatcgaggtccgcctctacgcggaggacccggcggccgggttcttgccccagaccggcacgctcgtcgagtgggcgcctgcggacgagcctgggatccggtgggattcggccgtggcgacgggcaccacggtcgcgatcgagtacgacccactgctcgccaaggtcatcgcgcacgctccgacgcgcgacgaggctgcccgtctgctcgctcgagccttgcgccgtagccggatccgtggcgtgacgacgaaccgggcgttcctcgtcgccctgctcgagcacccggagttcctcgccggtgcgacgaccaccgacttcatcgagcgcactggcatcgcccatctcgctgcggcgcatgcgcctctcgctgacgatgcgctcatcgcggcgtcgcttcgcgcacgtgccgacgaccgggctcgggtggagctcgcgacgacgctgcctgcgggtcggcgcctcgggcggctgccggcgacggcacgtacctggcgcgtcggcgacgaggtgcgcacggtcgcgctcacggaggatcgcgccgggcggttgtggatcggggatcgtcggctcgatcgggtgggggtcgaaggcggctgggtcgagtggttcgagcgggaggtgggctgcgagcttcgacgccggttccacgtgctgcgcgacggcgacaccttctacgtccagggcgacggggtggatgtgcgcatcgagcgcgtcgatccgtttgccgggcctgccacagagcccgcccttcggggcggcctcgaggcgccgatgcccggacgggtcctctcggtggaggtgggggtcggcgatcgggtacgcgccggggcgctgctcgcgatcctcgaggcgatgaagatggagcaccacgtcctcgcgccccacgacggcgtgatcggcgaggtgcgcgtggcggtcggggagcaggtcgatcgcggcgacgtgctggtggtcctcgaggaggggtagatggcgcgcccggttcgcatcgccaacgtgagtggcttctggggcgatcgcgtggccgccgcgcgcgagatggtcgacggcgggccggtagatgtgttgacgggggactggctcgccgagctcaccatggtcatcctcgcgcgccagcgggcccgagatccgctggccggctttgcgacctcctttctcacccaggtcgaggacgtgctcggcacctgtctcgatcgcgggatccgcttcgtcgccaacgcaggcggtctcgcacccgagcgttgcgcagcggcggtggaggcgatcgcagcccggctcggactcgcaccacgcgtggcgttcgtcgacggcgacgacctcgcaggttcgctcgaggcgatcgcagccggcgggacgccactcgtgcacgccgagacgggagaggccctcggtcagcggacggtcctcacggcgaacgcctacctcgggggctggggcatccgcaccgcgctcgacgacgacgccgacgtcgtcgtcactggacgcgtcgccgacgcatcgctcgtcgtaggggcggcagcgtggcaccacggttgggctcgcaccgatttcgaccgaatcgccggcgccatcgtggctgggcacgcgatcgagtgcggcacccaggtcaccgggggcaactacgccttcttcgacgagatcccgaacgccctccacctcggcttcccgatcgccgaggtcgcagacgacgggagtgccatcatcaccaagcaccccggtcacggtggtgcggtcaccgtcgggaccgtgaccgcacagctgctctacgagatcggggcgccgagctacgtcggaccggatgcgatcgcgcgcttcgacacgatcgtgctcgaggacctcggacacgatcgagtccgcattcacggcgtgcgcggggagccacctccccgaaccgccaaggttgggctcgccgtcgcagacggatggcgcctccgcctcggggttgcgatcaccggactcgacgtcgaggccaaggccgctctcttcgagcggcagctgcgcgcagccaccgagggtctcgggctgcgtcgactcgaggcgcacctcgtgcgcaccgacaagcgcgatccgcgctccaatgaggaggcgaccgccactctcgagatctccgccgacgccgacgacgaggcggtggtcgggcgagctctccgcgctcgcgtgaccgagctcgcactcgcgtccttcccgggcctctgggtgagaggggtcacggcccgcccagagcccttggtgcgcttctggccgaccttcgtcggctgggaatggattcacgaacgcgtcaccacgccatcggcgacgatcacgctggagccgccgccgtggagcgacggcgcgcatcgcgaggtcgcccaacccgagcccgccgtcgatgcgaccgtccagccgagcgatgcgttcggcccgtgccggatcgtgccgctcggtcggctcgtcggagcgcgctcgggcgacaaggggggctcggcgaacctcggggtgtgggccagaacggaggaagcctacgcctggctcgctggcttcttggacgtcgacgagctccgaaggctgctgccggaggttgcgccgctccaggtcgagcgctgtgcactccccaacctgcgagcgctcaacttcgtcatccatggactgctcggggagggcgcctcagcaccgcgacgggcggatgcgcaggccaagagtcttggcgaatggctgcgtgcccgactcgtccctattccgctacggttcctcgtgtgagcgagactgacgagatcctgctcctcgagcgtcgagacggcgtggtgaggatgaccctgaacgacgtcgcgcgacggaacgcgctctcgccagcgctcctcgatgcgctccatggtgccctgcgcgaggggagcagtgatgaggacgtgcgcgccatggtgatcacgaacgcgggatccgtcttttgcgcgggagccgatctcgccgcggcgggcacgagcgccggcgatcacgcgacgctcgccgacgtcctccttgccatcgaggagtccccgaagccggtcatcggccgcatcggcggacatgccttcggcggcgggctcgggctggctgcagcgtgcgacatctccatcgcttcgtcggaggcgcgcttcggcttcaccgaggtgcgcctcggtgtcgcacccgccatcatctcggtggtgtgcctcccgaagctgcgtcgcagcgacgcgctcgagctcttcttgaccgcagaacgcttcgaggcgactcgtgccgtcgcgagtgggctcatcacccgtgccgtcgagcccgctcgactcgacgccgaggtcgacgaggtgatcgctgccgtcctccgcggtgctccaggggcgctcgcggtcgcgaagcgcctcgccctcggtcacgatcgcgaggcctcgcgcgaggcctatgccgccatgaccgagctctcgcaggcgctgtttgcgggtgcggaggctgccgagggcatcgcggctttccgagagcgccgagctgccgcctgggttccactcgggctcgggggcgcacgcacctgagcccggtgcgagccgtggccgcgcgacagtgcagtcgcggcatctcgcgcgccgtcggtggatcgtgatcgcagatcccctcgcgcaagggtctcgtgccttgctcgaaccgcccggtcgtccgcggagacggtggggcgagcgcctggcggtgctggtgcgtgccggcccaggagacttcggctcgatggcgcacggcaagcgggcctcatcacgacgagcagggtccgagaggtccaacggtgggcctctccagcggccatcaccctgtgctgcggcgtcatcacggatcttctggacctcgccgcgggcggcggctaccatatcgtcaccattgcgagcgatgaagggggagatgagggtatgaccacagttccgtccggcgacggggataccgcgtcgggccatccgcggctcaggcacaacgcgctcggcgtcggtgacatcctcggggtgtcgttggccgatacggcgccggccatgagctttttcttttcgttcgccgcgatcgctgcggccgcaggcgtggcttcgccgatcgcgatcgtcgtcgccgcgatcgccgttctgctcaagctcaacagcctggtcgagttcaccaaggtgataccgagtgccgggtcgtacgtgtcctacatcgccaaggcgttcggcggtcgggtgggtgtggtcaccgcgtgggccctcgggttcggctacatcgtcgcggtcggctacgtgatggcggtgatgggtggcttcacctcccaggtgatccagcaatacctgcacgtccacgtgccctggcaaccgatcgcggtcgtcttcgtggtgctcgtgtcctacctcgtctatcgaggcgtcaccatcagtgcacgctgggcaagcgcctcgttcgcgttcgaactcgcgctgatcgtcgtagccatgattgccatcgttgtccactaccacaaccagctctcgctcgtgagcctcgatcccgccaagatctcgcggggcatctcgggtctcgggctcgccttcccgctggcggtgttcctcttcatcggcgtcgggaatccgggtgcgatggtggaggagacgcgtgatgcgcgccggagcgttccgcgagcgatctacacagcggtcatcgttgccaccatcatctacgtcctcatggcggtgacgacgtcgatcgcgttccacaacgatccgacgaccatcggcaaccttgccgcgcccttcgtgacggcggcgagccatgcactcgggccctttgcgatcctcgtctacctggccggcttgaccagcacgttctcgtcgctgctcggggcgacgacggcgcagacacggatcttgttcagcgcggggcgcgacggcatgttgccacgaggtctcgcgcgcctctcctcgcggcaccagaccccggtgagcgcgctcgcggtgtactggatcggggccggggtcatgaccttgatctgggccagcaccggcaacccgctggtgcttgccggtgacatcgccaccctcggaaccatcccgatcgcgctgacctacctcgcgctcaacatcgcactgccggtgtactacctgcgcttccaccgcgaggcgttcgccccgctgcgccatctcgtgatccctgtccttggcgttgcctcgctcatcttgccgctgtggggcctgatcaagcctggtcagccctacccgttcaacgtgttcccctacatcgcactcgcggtgatcgcgatcggtgtggtggtctcgctcgccacgggtcatcgtgtccggccgcttgccgaggcaccgttcgatccgctcgctgaggccaccgactgagatcgcccgagcccagctacgacactgccccggccagacgtggccggggcagtgtcgtgtgatgggtcacggcaggagaacggctcaggcggagcgagcggacccgcgagcctcggagaagagatcgtcgtcgggatcgaggaccccgagcgtgtccgcgatggcctcgacgaggcttgccgcggtctcggaggttgcgccctcaccgagcgtctccgcgatgaccgcacggcgcgcatcgtcgagtgcggcccgagcggttcgccccgcctcggtgagctcgatgacgtccgcgtcggtgcgcacgaggccagcgtcgcggagtcgagcgagcgcgtcggacagatcccagccggctcgcgtcgccatcgtgagcgtgctctgtggcagccgcccatcgcgcgcccggaagagcagccaggtcgccgccggagtcgtgccgagtccggcgtcttgtgcgagtcgtcgatacagccgctcgacaccgccgtcgcgtgagagccgttcgaggacgcggctgatggcgtccttggcgggatcggcttcgggcatggcgaatccctcaccgaggtccgcggccgcgacggagcggcgcaggcgcagctcgggcaggaagagcgtgagcacgaaggccaagaggccgatcggcgctgcgacgaggaagactcggtccagggagcttgcgaacgcgtgcaggagctggggcaggatctgggccgggatggcggtgagtgccttcgggctctcctcggcctgaaccgccaggttggccgggaggtggtagcgggtggcgacggcagcgagcttggagtcgagcgcattggtgaagatcgagccgaagatcgccacgccgaacgaggcgccgatggagcggaagaacgtcgccccagaggttgcgacgccgaggtcttcgtagcccaccgcgttctgcaccgcgatgacgagcacctgcatcacgccgccgatccccaccccgagcacgatcatgtcgaaggcgatgacgccgtaggacgtgtgcacgctgaggcggctcagcagccacagtccgaccgtcatgagggccgtgccgacgatcgggaagaccttgtagcgcccgaatcgactgatgagcaggcctgccccgatgctcatgacgagcaggccggccatgagcggcagcagctggatcccgctgaccgtgggggaggcaccgcgaacgatctgcaagaaggtggggaggaaggtgattgcgccgaacatcgcaaagccgaccacgaacccgatcgcactcgtcatcgagaaggtgcggttgcggaagaggcccatgcgcaagatgggctcggaggcgcgctgctcgacgaggacgaaggcgaccagggcgacggtggatgcgatcgtgagggtgatgatctgccacgaaccccatgggtacgtcaacccaccgagggtcgtgacgaggatgtagccggtcgcggcgagggccacgagcagcgtgccgaggtagtcgacgcgatgctggacgcgcgtggagagctggggcagggcgctcgagatcaccgcgatcgcgatgatgccgatgggcaggttgatgtagaacacccagcgccacgagagcgagtcgacgaagaagccaccgagcaacggtccgacgacgctcgcgaccccgaagatcgcgccgaagagcccctggtacttgccccgatcgcgcggtgacaccacgtcgccgatgatcgcttgcgcgcccacgatgaggccaccgccaccgagtccctggagaccgcggaacagaatcagctccagcatgttctgcgacaggccggagagcgccgaaccgacgaggaagatgaggatcgcgagctggaagaagcgcttgcgtccgtagaggtcgccgagcttgccccacagcggcgtcgaggcggtcgaggcgatgaggtatgccgtgaccacccagctcaggtggctgaagccatgcaggtcgttggcgatggtcgggagtgcggtggcgacgatggtctgatcgagggctgccaccagcatcccgagcaagaggccagtgagaatcagcccaaggcgagcgccgtgggcgcgtaccgtcgacgacggcgagagcgtggtgtcggtcatcgaatcctcctggtggtggtgtcggtcatggtgtggtcgaaggcactctggagatcggctccgaagcgccgaagtaggtgggcgagtgttgcaatgtcatcgtcgttccagtcggcgagcgcgtcgtcgaggaatcgtcgatgtccctcgcggatctgggcgaggtgtgctcgtcccttgtcggtaagggcgatgacctgcgccctgcggtcgttggcgtcactgcgacgcgtgacgtagccgagagcttcgaggctcgcgacgtgccgactggcgaccgagtgcgagaggccaaggtcgctggccacctcgccgaggcgcctgggtccgagcttcgcgagtacgccgaggatcgccagcgcgccaccttcgatctcgaggccgagggcgcgggcgagcggaccggtgtgttggcgcgcgatcctcgagagacgcgacagctcctcccagaccgcgctgacatcggctcgcgtcggagcgacgtcaccggaagcgcgcataatggtcgtcctctcattcatcggcgctcccgtctcctgggatcgtcgacggggcttgctcaataggtgtgtgacgaacacaacaatagacggtgcgtcgatgttcccgaccgcgtgccggcttgtggtccgatcggtgctcgagcgccatcagccagctctccgcgcggacaggcccttgcgtctgctgcagcggtcgcggatcgcggttcgtcaccagggggtcgataggctgccggctggggagcgagggagagccgacggtgtcgtatggagttgttggtccgctgctgcgcaatcgcagggccggaccttcgtcgttgttgtgggcgagcccggaggcacggggccctgagacgctcgtcgtcagctctccggcctttcgcgatggcgagccgctgccagatcgctaccgcggtcgcatggtcgggctgaacgtctcaccgccgcttcggtggtcgacgccacccgcgtcagccgtcgagctcgtcctcgtggtcgaggatccggacgcaccgcggcgccgggcaccggtgcacgcagtcgcacgaggcatcgagccggtgctcgagttcttgcccgaaggcgccctcgctcggccgagttcggtaccgggggtcgtgctcggcaagggactcctcggacagcaggcctgggtgggtccgatgccgctgcgcgcccacggtccgcaccactacacgttccagctcttcgcgctcgacgtccggctcgacctgccaagggtcttcacccgcgacgatgtacgcaccgcgatggacggccacgtcgttgcacggggtcagctggtggggacctacgaacgctgaacccctcggtcggcgcgagcgtggtgcgtcgtgttcggatcacgccgacggggactcgtcgaggcgagtcggtagctgggatcggtagatcgagtcgtcgacggccttgacgatcagccaggcgatcgcgaccgcgatcatcgctggtcccaacaaggcgatggtgccggtcatctccgcgaccatcagcatcaccgcgatcggtgcacgagagatgccgccgaacatcgccatcatgcccactacgacgaaggcggaggcgtcgtggccgatcgctgggacgagcggtgcgaggatgcgccagaccgcaaggccggtgaaggcaccgatgaccatgccgggcccgaacacgccaccggagcctccggtgccgatcgacagcgacgtcgcgacgatgcgagcgatgggcagcaccacgatcacgaggagcggggtgtggagcatctggtcgctgagacccttctggacccatccatagccggtcccgagcacctcggggagccagagggcgaggagaccgacgaggaggccgccgatcgccggacggaagtgtcgagggatcgggagccgtcgagcaaggcgcaccgtgccgtagaacgagcgcgcgtacagcaggccgatggccccggccacgaccccgacgatggcgaaccacacgagggtgagcggcgtcgtgagctcgaagtggccagcgacggcgaacagggggcggaacccgtagacagcgtcgaagatcgccgaggcgatgagcgaggcgagcagccctgggagcagtgcttcgtactcgaagtcgtcgcggtagacgatctcggccgcgagcacggcgccaccgagcggggcgccgaagatggcaccgatcccagacccgatcccgaccgagaccgcgacgcgcccgtcctcggtgccgaggtcgaggactcgagcaagcagcgagccgaagccggcgctgatctgggcggtgggtccctcgcgtccacccgagccacccgatccgatggtcagcgccgaggcgatgatcttgacgacgaccgcgcgcagacggataccccgggggtcgtggaggacggcatcgatggcggcgtccgtcccgtgcccctctgcttcgggtgcgagcgtgaacaccagcatgcccgcgccgatggcgcccagcaccacgctgagggggatcgcccatggccgcgcgtagtggagcgatcctggagcattgccctctccggctggcgtcgggacctgatagccggcgagcacggcgaggaactcatgggtggcgaacgtgagggccgcgtagaagatgacggcgccggccccggcgatgacgccgagcgcgatcgcgaggatcacccgtcgtagcagcgtgggctgccgacgaagccaccgtgacgtctgcgttcggatcgtcatcgccgagatcctcctgatcgacgagcaccgtctcgatgtgcgctcgagcgagggtgccaccgatcgggcgtcgcggctgggtcatcgagtcctctcgtcacgggtgctcctctggttctcgagactggccctgggccaggtgccggtcgcgggctccctcgatcaggaagttcaacgagatcgcgaactgctcgaccgtcgtgaagcgcgcgaggtccgcttccatcgggtcacgcggtacgtgctggttgcggaggcgctcggcgcgcaggacagcgaagccgatggtgtaggtgtggagggcggcgtagacctgatgggctgcctccggcgtgaacccgcccgccgcgagccgcgttgccatcgcgtccatacgggtacgagcgagctgcgtcgcgacgggccgacggaggtagagctcgagaagcggcgggtaggcgaggagcagctccagcagccgcgtggcggcgtcgacgatccagtcgcgccaggggagcgaagggtcaggctcccatcggttcgcgaagagcttgtcgaggagcgcttcgaggagatcgtcgcggtctcggacgtggccgtagatcgtcatcggcgccacgccgagcctgcgggcaagggtgcgcatggtgagcccgctcccgctcggatcggtcgcgagcgactcgagggctgcggcgacgacacgctcccgcgtgagcgcgactcgccgagacgtggtcggtttcgagccggcgccgccgactgctccagcatgcacgacgatcagcctagcgcgtctatccgtacgcgtacggcactggttcaccgagattacgcgccgcgagtggcgaggcgacgagtacggacacggcgcccgtggggcgacactcctgcagccgacgacgggcggtgagccctcgctgtgggtcgatcgtcggcgagactcagtcggatgccgcaggggtcgggttcgtctcgctgggcgatgccatgatgcgacgagatcgacgagcccgcggtcgtgtggaggccgtcgccgcctcggctgcgagagccgcctcccgcgagggtgcgaccatgtcggactcgagctcgtcgaaggagcggatgccgaggagtgccatggtgcgcgtgacgccgtcggcgaggatgcgccctgcgaccgcgacgccgcgctctcccccggccatgaggccatagaggtaggcccgcccgacgagcacgaactgtgctcccaggccgatcgcggccacgacatcggatccggcgcgtacgccgccgtcgacccatacctccacccggccatcgagacgctctcggacgatgggtaggagcgcgaggggcgcgagggttcgatcgagctggcgccccccgtggttggagaccacgatggcgtcgaccccgatcgcagcgaggcgctcggcgtcgtcgatacgctggacgcccttcacgacgatcttgcccgaccacagcgatcgaacccactcgatgtcgtcgaaggtgacggtgggatcgaacatgcggtcgatgaaggagccagcggtcccttcgaagcccgtctcgagcgatgcgaagcgaacgggcggcttggtgagaaaatctcgcgaccacgctggatgcagtgcaccctggaggaacgtccgaagcgagggtgtcggcggcagcgtgaggccgttgcgcacgtcacgcatgcgtgccccggccacggggacgtcgacggtcaggattaatgcctcgaaccccgcctctcgggctcgctcgacgaaggcccgggtcggaccccgatcgcgccagacgtagagctggaaccagcgacgcaggtgcggcagttcggccgcgagttcttccggcgtggtcgtaccgaccgtcgagaggccataggggataccaagagacgctgcgacacgaccgaccgcgagttcgccgtcggtgtgcatcatgcgtgtgaagcccgtcggggcaaagccgaaggggagcgcactcggactgccgaggacggtccaggtcgggtcaaccgagctgacgtcacgcaggacatggggtcggaagacgacgtcggcgaacgagccctcgttgcgaagcatggaccgctccgcttcggcggcgccgtcgacgtagtcgaagaccggccgaggggtacggagcttggcgagacgccgcaggtcgtcgatcgttgcggcccggtccagggtcggcaggagcgtgcgcaggccacctcgtggcttgatgaggtcccagcgctcgcgcagctcgtgcactcgtgtcacgtccacctcccatcgcgtcgcgtgaggatcggtggcgagggcgaccggctccacgaggccgccgatggagtacgccgcacggtgagtcagcgcctcgcctgcagcgcctcgacgatgaagcgccgttcctcgctcccttcgacgaagaactcggcgacgggatgataggtgtccgccgttcgcacgatgcgctcggcgacctcgcagcgtcggagcagttctccaatgccgagagtgtccaggatggcccgcggatcgctgacattggcgcagccatgagccgccagaagttcggcgagcgtcgcgctcagggtttcgaggccctcgtcgatggatggcgcgtgcgcgctgtcgtagtcagccatggacacctccgcctcgctggtgagtgtagctcggtcctctgctgggtgctggacggccaggtggacgcacacaatcccgcgaccggccgaagtctcggagtacttcgtcgtggctgcagggatcgatgatcgcgcgccgtgcaacctgcgcagtgtggctcgcgtcgatcaggtcggaagcgctcgcccgcgcgaacgggtccgtcgaggcgaccggggagcgaggagtcgttccgggtcgaacgtgcgcgcgagcaccgcgaggccgacgatctcgacgaggaggagcgcacctgcgagtgcaacgccgtcggccacgctcaggctgataactccttgcacgagtaagacgatcacgaggaggaccgggacggacgcaagcgccgagagctgctgtgccacgcgaacatcactcgcacgactggatgcgaacagtccaaccagcaccgcccaaccgctgagcagcacatcgaggccgagttgacgcacgacgaggggagcggtgatgagatgggcactgaccgatgcggcggctgcgaagtgaacgacgacgagggtgagcgcgtacaggccccacgatccgatgaacgtcggcgcgaggacggcgagcagcttggcgacgtagagttcggtcgcgctgaggggggagctgagcagcggctcgagcgtcccctgatcccgctcgccgacgatggcaaagcccgccagcacgcccgggagcacgagcggggggagcaggaactcgatgctgctcgccgtcgtcaccttgtcgaggagggacatgggggcagcttccggcagcgaggtcagggagagcaccggcgcgaccagcgaaatgaggggcagagcgaccatgctgtagagcacgtagcggttccgacgaaagtcggtgaactccttggcgatgaccgcccgtatccgccaccacgtcatcgatcgctctccttggtttcgcccccgacaagctcgaggtagacctcttccaagcgctctcgggggcttgcgagctcgaggaggcggtcaccggcgtggaccagcgcctccgcgacgactggtgccagctcgtccggctcagctccgtcgatgcgcaacgtgtgttcgtcggtgacgacgacatgggcggcctcgacgacgggtgcgagatgcgccttggcgtcctctgcggcacctccgacgcggacgacgagggaccgctgactcccgagtccgagttcccctggcttgccgacagcgaggagacgctgacgaaggatcgcgacgcgatcgcacacccgttccgcctcatcgagccgatgcgtcgtgatgagtacggtgcggccctgggctcgcagactggcaatgagttcgagaacatcgcgggctgcgaccgggtcgagaccggacgtgggttcgtcgaggaagatcagttccggctggccgaggagcgtacgagcgatggcgacgcgctgacggagacccttcgacagggcgcgacaggcatcgtcgcgtcgactcgagagatcgaccgcgtcgagggcctcacgaatggcgcggtcgacgtcgtggactccgtagagccgtgcgaacaggcgcaggttctcgacgacgctgaggttgccgtagaggcctggagcctccggcatcaccgcgatccggcgtcggatctcgggcccgttggaggcctcgaggtcgataccgagcacacgcgcgcgcccctcgctggggcgcaccagggtcgcacaggtccgtaccagcgtggtcttcccagcgccgttcggccccaagagtccgaagacctcgccgcgatcgactcgaagggtcacgctctcgaaggcgacgcgatcgccgaagcgcttcgtgagaccatcaagctcgagtgcagggtgagcgtgagagtctccagcactccagtcggcgctcgtcgccgagagagcgtggtcgggcatgacctcgaacactaccagctgtcgtgatcctcatcatgccccggacgcggtgagacgaggaacatcgcgacacgtgctgactgaacacgtccgcgaagaccgtcgtgccctactcggaaccaacaccggatgctgcgcgccagcgcgtcttcgttcacctgagtgtggggcatactgacgaggaccatgctcgaggatcgtgagcacgatgtccggctccgggtggtccgcctcgccgccgcgtcgttcgtgttcgcgggcgacatctggcaagttgtcgcgacgggacgcggctgacacctctggttgaggagcctcgtcgtcggctctctccttgtgggactgacggcaccctgcaacgatcccacccggtgtgtgacgatcccgatcagccagaccgcacgggagggagaccacctgatgggagcacgcgccacacaggcgaaggtcacgcttgtgctggcaccaaccacgccgaagccgtcgctgccgttgacaggaaggctgaggcggtagcgccgaggccagcaggttctggtggagggaggatcgtgagctcgcgatgcaaggcgcccgacggtgtgagcgcgacgatcctcgtgatcgaggggaggggcggcgaggccagggtgagagcgagcaagcagccgtcgtggttgcacgcgagggcggcgttgatcggcagtgccgaggctggtgccgcgaggcggagctggtgcaccgcgaagcctgatcccgtgacggtgccggtgtacacgagtgccgacaggcccgtgcgcggctggaggttacttgcgctgacgacgccgacgcacccggtgtcgtggcaggacagggcggtcgctgggtcatcggcgagggccctgggttcagggccgcgcacggtcatgagatgccagatgcggccgccgtcgcggctctccgcgatggcgggggcgatggaaccgtagccgagagcgaaatcgtgctcggcgatcgccacgcaggacaaccccgtcgggcatgcgatcgaaagcaccgagaggtcgttcggggcgttggtgatggtcgctcgctcgaaggtcgtcccggcgttgtcggtgacgagcaccgggaagccgtggtggtggcttatgcccgcgactgccaccacgcagtggcgtgcgcttgcgcacgcgagtccctgggccagcgtcccacgagggagggtatggtccgccacgacatggccgtgctcgagctcgacgaggaacgtcggaccattgatcgatccggtgagcaggtcgcagacggtcgtcgttgggcacgagagtgcgatgggcgagagcagtacggccgcgttggggagctgtagcacctctctcatgctcgggcgtgtcgcgagggagttgaagccgaggagctgcggaccacgtgctgcctcgagcacctcgaagcagatcgattgcacacaggaggtcaggctcgcaggtgatgggttcatcccgagctgctgaccgaggctgatcgaggaaccgacggcgagacggttgccgcgaggtgcgacgtggataatgacggccggtccggcgctgcccggggttgcggtcgcgatgcactcagtcgcaccctgcgtgcagaacaggctgagctcctcagcggccgggctcgatggcagcgtgagcgcgcgaggacgaggtccgagctggaacaccacggacgtggtcttcgtggcacccgagagctgggcgagacagaaggagctcgagcacgccagaccgcgcagcgcggaggtcgacgatggtgcggagatcgtcacggcggtcgcgtgtgctgcggtgagctcggttgcctggaccgctccgctcgaggtgaccgggttcgcgacgaaccagcagttcgctgggtcgcagctcgcttggagtccgaaggcgttcgggctcgggtgggcgagcaccgtcgcaaagcccttcgagagcgagccctcgtaggccccgctctcgaaggggccgttcgtgttggccgtgggagtcgccccttgcgggggagggagcgtcgagaccacgtcgacgcacaaggaggcgttggcgcaggcgatcgagttgcgctctgccggcgcgatgtcggggagctggagcggttcccagggtgcagcagaggtgaggcggacgtagccggcggtggtgccgtcacgcgtaccagtggtccagcagggtccggaagggatgcaacccagtgtggatggttcgtagccggctgcgaccgcgacgctctggagaccgacgctgtcggcagtatcggtctcgaagagctggcccgtgccggagttctcgagtgggggctcggcgaggacgtagcagacccggggactctggcaggcggtcgcgggaacgaaggcgtcggacgggagcgaaatgggggagaaggtgaggcttgcgttcgtgcttgcccagaggctgctcgccccctgcgcgttcgatgtggcgagaaggcaggtcgatccggcgcacgagtactgcctcgagagccctggagtactgacgctctgcccctcgccgaccgcgatcgggatggctcgcaggttcgtcggcagggaagcggcgccggccgggggagccgggcgcgacgacgtcgaggcgatgacgacagcgagcgttcctcccacgaggacgatgacgagggccgggacgacgagtgggccggtacgagcggagcgcgccatggtgggattctacatcacgttgtcgacacggaaagggctgtcgcccggcaacggtgcgagcgtgaacccgtaggaacagctggtgggcgcgatgtcgagcgacgacctcgttggggaccggtcgagtgcacggcgctcctcagggagctgtcgtgccgacactctctgaaccacccccaagtttcgtgcacacctcgtgacgtgtgaacggtctcggactcggccgccagatggccatcgtactcctgttcgacctcgacgggcggacgacgtcccagccggtgcgtgagcctgcgcgtgctggagcggtgcacccaggctgaggtcgtctcctcgaggtccgtgaggctcacgaggggcccgcgcgcgcagggtgagccaggccacacgcactcggttgtggagagaccgatcgtggtctcggcgagcgcgttgtcatagccatccccgacagagccgatcgagggcaccaggcccggcagcaggagcgatttgccaacgtgaagcgccgagtgggtttggcctgcatcttgcgtgatggatcgtgcgttcggttgcgggggtgcccctcgtgtgctcgtcggccctcggccatgcgcagggcacgctcgacgagtcgggtgtcgtggcaaagcacgagacccaccccctttgagatcgtgccggcgaaggcgtcgatcacgaaggccgtggtggcacgccacccgtgagccggacgcaggtgacgtccgccgcgcacagctcgttatggggccccctggtgggggacccggtgctcgcgacggccatcctggaccgcttgctccaccacgccacggtcctgaacatccgaggcgagagctaccgcctgaaggaccgcaccaagcaacggctccgcggtgggctgctgccccaggcagccgaggccatggcgaagggaggtgatgccgagcaccacgctctggggagctatcccctatagttgtgtcgcaggtgggtcacttctgaccggtgatctcgggtcaaaagaaggccggtgcctacaatcggcacccggcgagatcagcgagcggtagcgtgaggacgtcgggtctcacattgagggtggactcggttgtgggggccggtcacatggcatcgagctttctcgggcatctatcgaacaacgatcacctccaggtcatgcgccatcctgcgcagcagcacaacgtcaacgtcatcgagtcgctcatccgtcgtcttcgtcaatgccgcaccttcgaccagtacgacgacgttcagcgcgagctgttccagcacctacactgccgcgaacagcaccgttccgactgccgacgctgtgctgctcgacttcagcggggacgatctcttcccgcattactcccgcagctccctctcggtgtagacccactcgacccagagacctggcgcatcgaggacctcgtcttcgatcgcgtatgtcgccagctccgagcggtcggcgacgcactcgcgtggcgggcatcgggctacgaccgccggtacgtcatcgcgctgagcagcaacgcctccccgggggtcatggcgggaaagactggcctgcctgctgaacttggtgctgcgaccgagcttcgcaagagagggagcttcgctctcctccacgatctcacgaactgcctgcgcatcggggacatcacggagttcaagtcggatggttcgaagctcctctacgaaatcaagtcaagtcccacggcgaagaaaggaccacaacgcagacgcatggaggccgctgtcgaagccgttatgaccggcggcgagcttcccggacgaccgggacaacggatcgtgagcccgacccagcgctgcggaacgcacatccgtgcgttcgtaaccggcatcgacgaggccgtccgccgaggtatcgccggggccgccatttcggatgcccgtgcattgactgccttctcgtttcccacgctcgcgcagactcgatcgaacgattcggcacggcagcttctcgacgatttccatgctgagcgccagagcgcgatcgaacgtgcgggaatcgccaatgttttgcatcacgtaacggtcgcaagcgcaacgcgcaatcacgacttcgttccctctgtgatgcccttcgcgctctttcccctgccacccatccaggccgctctcctcatctgcgactacatcggcttcagcattaccgtcgcgccggagcgaatcgccgatcactttgagcgcctggggttcactgccgacattccgcttgtcacggccaacgacagccttgtcgccactgacacgatcatcaacgtgcgacggggctcccggggtatccggctgcacccaggtgccctctacgaactcctcatcgagtgcctcgacctcggatcgtgggctacggccattgctgaagttgtcgatgactcggacgctccgccccatcccgtgcttgctttcttgacgactcgtgtttggcgctgaggcccacgccagaggggtcgaccaaagcctttccccgacttgaccctcggtgactgtaagcagcgggctggccttcccccctccaggttgacacctgctataggaggaagggatgagccagacaccgaatccaccaccgggcgaggcccccgttcgtcgatgacgaggccgttacccgagccagttcctcaaaggacgccgcagcgttggtgctcgaccagtaccgcaccatcgctgacgtcgctcgcgaacttggcatcaacgagcagacccttgggaactgggtgcgtcaggaacgcatcgaccgaggtgagcgagaaggcctgacgagcgccgagcgcgaggagatgacccgcctgcgccgccaggtcaagcagctcaccatagaacgagacctggcgaaacgttgcctggcctttgcggatcctgcgagggcaaccagtgacccgctaccgctgggttgccaaccaggaggccgagggcgtcccagtagcggcggcgtgccgagtagcgatggtctcccgccaggcgtactacgcctggcgacgctggcgcgagcgcggccctgaccacgagcacctggtgctcacgagcgagcttcgcgccatctgggaggcgagcgacggcacctacggcagcccccgcatcacccacgagctgcgacgacgtggttactgcgtcaaccacaagcgggtggaacgcctgatgcgcgagctcgagatagccgcctgcccacgccggcgcttcgtagccacgacgaggcggggagaggacgcagcgctcctggacctcgtccgtcaggacttcgctcttggtgagccgaagcgcaggtatgtgagcgacatcaccgacgtccgaagcgacgaggggttctgctacctcgccacggtggcagatcttggctcgaggcgcatcgtgggctggtcgctccagcgtcacatgcccgatgacctggtggtcgaggcgatctgcggagctcttcggacccggggcagcctggcaggggcgctcttccacagcgatcgcggtagccagtacctctcccggaaggttcgccagctctgcgcaatgctcgggcttcgccagtcggtgggcagggtcgcgacctgctacgacaacgccgtggccgaggccttcttcgggagcctgaagcgcgagctggtggctcgctaccgcttcgcgaacctcgccccgaggctcgctctgccatcgctacctggatccaccgctacaacacggtccgcctgcactcgagcctcgggtacgtgccgcccgtcgagtacgagctctcctgggcctgccgggaggtggccgtggcctacattcagactgtcaagcaaatggggggaagcccatgacctctcctggctgacggctggagggaaatcgcggacgccgaattcgtggctgcgttcacgaacccttccgtccccatgaagctttgcacccagaccattgtcgaagagcgcaacctctgggtcgagaccagcgacatgctcgctctgggccggctgctcgcagagagcggccaggttgccatctcattgtcggggcatgctcgacgggcgcctcctgggcggatctccacggtggcaagcgctccgtcccacacgatggcaagctggccttggtgagcgtcggcatctcgggacagctcagtcagcctgagcacctcgccagcttgcgcttactcctggccgggtcgaggtcccacggttcgcagacacctcggtggtgccgacgatctcttacgatcccaccagcgcggcgtcgccagcgatcggggaggtgccggccagctccacgaacagacgctcggatcggcggccaatggtcgggaaggggcgcggccacgacaagcaccctcgttgggtggggctggccacgtcctcggtccacctcactccacgaagagtgcctcggcgttgagctcgcggaggatgccttcgaggtcgtcggcagtgggacggaaagggaagtcgcggaacggctcgctggctcggtaggacccgtagggccgggtgcacccaggggagccgtcctcgcctgggcagccgttggtcatgaaagccagcccctcgttggcgacgcgcaagagggtgtcgcgctgaaccgctcgcaccgcgacgaggctccctgcgtcgtcgaacgagaagtcctcgaccccgaaaccgtcgtgctcgatgaggtgtttggcgagctggatccgacgccaacgggtaatcgaggtcttcggcacggcccccatccgggagtcgggctcgggattgaagcagaagagatacggaaggatctgtcggtcgaggagccggacgaagagctcgatcagatcacggtctcgttccccgaggcctaccaccgtgtgacagttcactttccatggaccgaagagctctcgggcatcgtcgacgacctgccaatacttggcccaggacagtccagcgcctccagcggggacatcggttcgcagcgagcggaagagttgttcggtcacggcgtcgaggccgatgccgatcatgtccacccccagcctgcgaaagcgctcgagcttgcgacggttcagtgtcggtggggcaacgaggatggagaggggggtgcggacgcgcgctcggatgcgctcggtgatctcgcacgtgtcctcgaaggcgtagggagaggtcaccatggagatgcacagacgggtcaggcgtcgctcgagcatcgccatgcgctccacaaggtcgtctgtgcgcacgaggggccactccactctgatgaacgacttgtcctcgtagtcgccggggcgggtccgcgcgaggccgcagtagccgcagtcgctccggcagccgtccccgtaattgagcaagaggttgatcccgccgaaggcgaagtctctgctgaagcgaccggagcggaacccgagtgcgatcgccgaggcggccgagatccgcacccactccgggctctcgtgctcacccagcgtccgtcgtcggcgcagggcgaggggcgtcgaggtggtcatgaatgtctcctttctgggagtaggcaggatccgagtcggtggggggcggcgagcgggctgaggctcgcgtggaaggcttccgtgatgcgtcgaggcggagcgaggtggccaagcacgtcgcacgctcgatccgcgaggtagctcgggtcggcgggctcgaaacgcagcgcccgggtgagcgtgatcagccgggcatcaacttcgagaaagtccccggagacctgcacggagctcaccactccaccccgaacgtcgaggtgcagttcgacggtcccgatggccgttcgcagggtcacccgagtcgcgctcggctcgtgagccgagctaccgtggatccagtcccgatcggcgtaggtcgagatctcgaggtcacgtgccagcatgagctcctcggcgcgcggcgcgctctggacccatcgtgaccgaccaaggcccatcgcgaccgcgtcggccaccacggtgacgaggtccgcgccgcaccaggcctccccacggagctcgctgacggtgacgacggagcgtgcgagtagcttggcgcgcttgtcggcaagcttggcggcgggtgggcgtaggacctcgaggaggaggcgatggtcgaggtcggcgaggatcgaagcgtggcagagggtgcccccacgcgcaggtcgatacatccccagaccggcgatcttgcgcccatccacgagcaggtcgttcttgccctcgagggtcgcccgcaggccgatggtttcgagtgcgccgatgaggagccgggcgaacgccgtcagaacttcccgaggggtcgcacgccgctcgggcagggccaatgccacgccaagctgggcatctcccatgaggatggtgccaccgccagtaggtctgcgcccaaggtcgagccccaggcgctcgacggtgacgaggtcgacctcggccgcagcgcgctggtggcgaccgacgaggaccgtatggttacggtacgtgtagcagcgcaggaccggctcgtcgacggcgcactggacgagcgcatcgtcgagggcgagaccctcggcggcaccgacgccgtggtcgaggatgacgcgaagcgagctcacgacacgcgcaccgtggtgaggtcgtcgtcgacgcctgcccagctcatcgagcaacaccactcgtggagcaccggggtgagcccctgctcgcgggcgtaggcgatggtgccctcggcagggtacgcgatgcctgcgaagccgaggtcgacggccgctcggtcgagggcgaccttcgtggtgcccatgggtcgggcgcaccccaggttcgtgcgcagcgagggcaccagcgttcgtgcagcccggaagacctcgaccgtcgcctcgagggatggcggcgggaggtgtcccatcggcgttcccacgagcggtgtgagcaccacaaggatgagggtgtctacccggtgcctcgcgatgagctcaagggcgcgatactccccgaggatgcgaccgtagtgcaggccgatgaccacatgcgggatcactcggaggccggtgtcgtccaagagaccgagggctcgatcgaagtcgtcgacgctcagatcgaggtgatagacctcacgtatggtggcgtcggcgccgatgatgtcgagcatgacggcatccacccccgcgtcggcgagttgggcagcgaggggaggcgtgacgactccggtgtgcaccacgacccgcatgtcgagctcgtctcggatgcgtggcacccaggggaggtgacgcgcgagcggcacgaagccccgcttggtggagccacccgatacgaggatgccctgagatcccgcggccttgagcctacgtgccacatcgaagaggttcgagcccagaccgaccgacaccatcccgtcgaggaccttggacccgcagtgatcacaattgagcgcgcacgccgagccggtcacggacaccggcaggaaccgtctcgggttcgtcgggcgccactccttcgtgctccaatgcttgaggccaggagcgtagaactcgatggtgcgcggttccgacgctgcgtcgtctactgtgcccacggcaggatccactaccacgccagcaccccggccgcacgaaacgcctcgacgcgcttggtgaagtcctcaagcgcctcgtcgggggtgacgaggtgatcgagcgcgcccggctcggttgccatctcgacgagccacgcctcgtagcatcccgcgtagagctgcgtgacgtcgcgaacgaggtggtcattcgtcctcaagatcgttccggcgagaggtgccgcgagtgccccgacgtacttctcggcctcgagtgagccgatggggtcaccctccaccacccggcacgggggctcgaccagtgtcagctgcgccagggtgccgttcacctcgagtcccagcgcgtcgagaccgacgcgcacgatatcgtcgccgaccggcaacgcccagaggttcgtatcgtggtggtagaagcggtcgctacgaacctcaaagccgcggtaaacgtgtgacgtcatcaactcctcctcttcggtatgtccgatcgtcctcgtctccgaggctggcgccgacggaggcgaggagcatggcgagagaacggtcgcgctcgatccttcgccgcaggagcgctggatcggtcacggccgagccctcctcgtggcgcaggcgcgtgaggcgtccttcctccaccaggagcacgcaacgccgaccctcgtgttccaggtcgtggagccacacccccgctcgaatcttgacgctacgtcgtgccgagttgggggctccacggacccagccatcattgtcctcgtcgacgagcgatcgatagcgagcgatgaggtcttggtcgagttcgaggatcccgggccgggggtcaccgaggatctcggccagttcttgcaccagactggcaacgaaatcttcggggtcgaccacgagcgcccgagatggaccgacgtgacggcgcatcgccgcgacggcctcctcacgtgcaatcctcgacagggagaggatgccggcggctgcctctggatcgaaggcttcgagcaggtttccgacgacgaccagactcgcggcgatctcaccggacccatgaccacagaccttgcgaccctgacagctgatctctccgtggccatcgagcacggtctccagcccgagacgcctccaacttcgggcgactcgctcgaggatccacgcagcgaacttcgggcctcgaacggccgctacgacgtggtctcggggcaggatgacctggaaaaagcgttggcgctggtcgagccagaccgggcccccaccaacccggcggcgtacgacggggaccctgcgcgcctggatctcgccccagtcgagctcctctctatgccggtggtagccgagggagacgtacgcggagcgcggtcgtgcgacgagcagcgtcggccgttcacagcgatgggcgaaggcgtgccagatggcatgggagtccactggttcgaggtcgccgagatcgaggacgtcgaggcagcttcgacgcacgaacgctcgggtccgactcccgtcagcgacgggtctacgaaccccgtccgacacgttccccccttcggacgcgacgtcaccacccctcggtgacgaccatgtgagtcatcaagtgcgcatatgcgcatgcgactcccgtagcgtacttgaggcgccacagcgggtgcaaggattttcacgaatcaaggggggtgtaccggtgccaaatcgagccgttgaggatcgttgggcggtcgtgacgggtgcctcgtccgtcatcggattagaggtcgcacggtcattgagcgagatcgggtactcgctcatcctccagggtgcgcgccacgccaacgcgctcgagctccttgcagacgagctggggtcgcgcgggcgtaggcccgtcgtggtacgcgcgaacctcgccagcgagcggggcgtcgaccacctcatggccaccatccgagagcgcacctcgcacctcgacgcgctgtgctggctcgctgcggctggggtcatgcgaccggtgagcgcactcagtctgcaccacctggagtggacgttccgcgtgacggcggggtcgttcgcggtcgtaactgcgggcttgcggccgcgagtgagcatcgccgtctcgtcgctcggctcccagcgcatcgcccccgagtacgccgccatcggcgccgcgaagtcggccctggaaacgctagtcaggtatctcgccgtagaactcgcgccagcctccagtgtcttcgggctgagggttggcctcatcgacacgccggccgcacgacgtctcagccgctacgaggagctcgaggcgctcctgcgaaggcgcgcgcccatggggaggctcgtgacaccagaggacgttgcggctgcggtcgtgaccatggtcacggagatgtcgagcatggcaagcgggtcgttcctcaccgttgacggcggagtcgggcttgtgctgtaagctcgtccgcgtcgtggcctgacgaccacccggatatgactgcgccctgccactgagagtgctccgagcgacaggcccgcgacctaggtcgagaacgccgaaccgatggggttcggatgcgccggggcggtatcgcgctggcgtcagctcgttcattggtgaaccgcgctctgcgtcccggcgcgagccaacggagcccgcttgactcgtgtgtcggatccacccaccgtgaccgcgcgtaggggcgaacacaaagtcatcctgttcgcggcgacggcgcccggccaaccagtgggggccacgctgtggcccatggcagtccgcccaggcgtcgccacgctcggtcgccgtcgcgcactgttatagtccgaacctcgcgggcagccacgatgaaggtgcacactcgagcgctggcgccgagaagcggtattctgtcaagttctggcgaggactgagatgcccgacactccgtcgagggtactgctacgattccccgcgtgcggaggctgcgaacgtcggttgggatcgtgcttcgagggttgcgatggcgcctcgcaacgaccgtgatgctggtggtcacgggaaccttggcggtcgcgacggtgatactcgcaccgctctacataccttcggccaaggatgcgctcgtcgtcagcgtcgtgcgtgcgacctcgctccagcaagatggtctgcagctcaatggcttcggcctcagcgacgattcgcgggctgcgctcgaacgcctgttcgcccgggccccacggctcgaccatcgaccgctgttcggttcgccgcttgcgacggcgttcatgaccgtatcgctgccctcactcaagatcccgtcacgaacgccagggggtgtggcgcagtccgtggtgcagaccacggcgctactcgagaggaccgcaatctgctcgcacctgaggttcgtcgcgggtacctgtccgcgacgcggatctcagggcgtcgcggtctcgacgagggacgcggctgcactgcatctgcacgtcggatccaacgtcaccttcgctgctggtgccatcgcgcccggaacccccggagccctgccatcggtgaaggctccggtcgtgggcatctatgacccgccgaccaccctcagcgcctactggtggggcacgcagtatttcgatttcagctccacgccgaccggcaacgtctatgacccctttgtcgtcgcccctggttacttcgacgggattgcgattcccggtccaccggtcgtcctccgcggtcacggcacggcaacgagtccggcattcgtcgtcggctcgcagtatcgctacctggtcgcactctcgtcgagcgggtcgcccggaggggtcttcttcgcagcgaactcgttgctgggccgcaccttgcaggccccgctcgcagcaccgcagcgcatcacgaacacgaccgctccgggtctcttgcggtcgatatcgggctacctcgactcggtgaacaagcatgcagcgctgaacgtcgtgggttcccaaggcttcgggccattgcccgtcgccgcgtcgtcgctgccgggaaccctcaccaaggcgctcgctcaccagcacagcttctcgacgatctccatcgtcgtcgtggtcgagatgctggcgatcggcgaactggtgctcagcgctgtgatcgcacggtcgatcttggcgcgcgatcccgagctgcgtctcgcacagttgcggggcctcggaacgaggcgtatcgttcagagggcgatcgcagagccactcgtcgccatcgtcctcacgattccgctcggcacggcggttggggtcggcgtcatgcatctcgtcgcgagtcgcgtcttgcccagcggcgtcaccgtcactcttacgacgacagccgtgttgacggcggtcggcacggccgtcgtcggcctgctcaccacggcggtcatcatcatgattgcggttcgacgcggcgtcgtcgaggctccgcgtgccacacagcggcgccgcgtcgtgttccgagtggcgctcgacgtggcactgctcgcgatcgccgcgacgggaaccttcgaactcgtcacggcgatctccgcctccagcggcattgcacctctcgcggccggcgcccccgcgctcttggcgctcggactctctgtcatcgctgcatggctcctcaccatcacagctcggctggtcgctcgtctcacgcgctccctgaaacgcccctcggtctacgtcgccacgcgtcagttacgccagcgcgccagtgcgctgcaccgtgccctggtcgttgggcttgccatcggactcgtcacgttcggcatcggcctcgacgacgtgggaaactcgctggcgcgaaccggtgctgcggtcacgaacggcgctaccgaggtggccgaggtgaccctgccaccatccttgacgatcgccgaagccgtcgatcgcgccgatccttcgggccacgaggcgatggcggcgcagcgagtgtcaactcctgccggtacgacactggcgatccaagcgcggcgtgcgccggggatcttgacgtggtccccgacgctgggcctgcacccggcgctcgcgcaggtggtccagggacttgacccacggtccgctggcggctttcctgtccgcggtcgtcgcgtcgctgtgacggtggagatctccctcacgaaggcccaggcagcacagctggagcgatcctcagcaggcaccgtcacgcccgcaacgctcggcgtatccactgtcaccatggagatcaccacaccgacccccgcgggtctcatcgagtccgtcggtgtgctgtcgggggccgggaaggcggtgacggtgagcgcgaatgtcccgaccgcgtgccgcagcggaggttgtgacctcgtgggtatcagcttctccttggcccagacgttcaccaacttcgagatctccatccttggagtgagcgggattgcgccgtcgcctggcggtccggtactcgcagcgagttcctggcgcgcgagtggggcactccatcgcgcatcacgacctgcgagctggaccgttgccccgtcccaaggtgccctcgacctggtaccacgctcgctaccgccgaccatcccggccatcacgaccgacctaccaccgggacaagccacggctcagatcgtgggcctcgacagctcgaccatcaccgcgacgcccatcgcccaggagcatgccctgccggtcctcggcgcgagcggcgccatcgtcgacctgcggctcgccgagcagtacctccaggcaaccgaccatgcgcaatcgctcgtcttcctcggcccgcgggacccatccgcggtcctccgctcactcgcggccgaaggggcccacgtcgggccaatcacgacggtcgcccagatcgtcaccgccgcacgcaccagtccgacggcgctcgcccaagacctcgtcctcccggcgggcatcgcggcggcggtcctggtcgcagccggcctgctcttcgagaccgtgaccgacgggcgcgcccgaatcgccgagctcgcggcgcttcgggtactcggcatgcgccggagccagctcgtcaccgcgctcgtgctcgagggcatcgctgtcgttgtgctcggtgccgtggtcggcgtcgtcgcaggtgtcgtcggcgcgcacttcgtcttgccacatgtgctaccgccgccaaccacgctcgccgcatccttcgtcattccctactctcttccaacggccccccttgcacgagctgcgctgctcgtcgtgatcctggggggagcagccgtgctcgcaagcgccgtgcgcgtggtcgcccgggcctcgttcgaacagctgcgagctggtgagcgatgactgatcagcttggcggactccccctccggctcgagggcgtggtgcacctctaccccatccccggaggagacgtcgttgcactgcgcggcgtcgacctacgcatccaagcgggcgagatcgtcggactgctcggaccatctggcatgggcaagtcgacgctgcttcgcctccttgcggccctctaccctccttctgccggtcgcatctggattggtgataccgacatcgcccaactcggaccccgagggcgtcgcaagctgcgcggccggaccgtgtccctcgtcctgcagggtccggcggtcaacctcttgccctatgcgaccgttgagcagaacctcgctttcgcggcacgcgatcgcgcctctcgacaccgcgtcggtggcctgttggaactcttcgggcttggacccctccgtcatcgcgtcgtggccacgctctcaggaggccagcagcaacgtgccgccatcgcgacggcgctcgtgcccgggccgcgtgtgctgcttgccgacgagccaaccagccagctcgatcacgaggcgcgcgacgacgtcgtgcgagccctgttcgatgtgcaacgcaacctcggggcgacggtggtgatggtgacgcacgacccggtcgtcgcgagagagctgccgaggctgctcacgatacgcgatggccgtgtcggcgcagagggtcgctcaggcgaggagttcgctgtcctcggcgaggacggtacgatccagcttccccctcacgttcgcgcgatgattccgcctcactcgctcctgcgcgtccgcgtgatcgacgagggattcttgctcgagccggctgaccatgtgtccgaccaaggagatggcctgtgagcgagcccttcgagctcgtcctcgagccgatcgtggtgcgacgggggcgaggatccatcctcgagcttcccgaacttgcgctcgcatccggtgagctcacggcgatcatcggaccgtcggggtctgggaagaccacgctcctccacgtcctcgcacgcattctcgaacccgacgaggggcgcgtcctctggcgcgatgcacacggcgatcaccgactgcgccgccgccagagcgtcctcgtaccgcaagcattcggactggttgctgcgctcaccgtcgcagagaacatcgcgctggcgctcaagctccgcggtgaacgcgcctcggatcgttccccgctggtacgagacgcgctcgcctcggtcgggctcgacgggctggcgaaccgactggtcggtgagttgtcgggcggccagcagcagcgtgttgcggtcgcccgagcattggccgtcgacagccctatcctgatcgccgacgagccgaccagcgagctcgaccccgacaaccgtgcgctcgtgctcgatctccttctcgagcgagcgcgcagcggtccactcgtcgtcctggcttcccatgatccgctcgtcgccgagcgtgcccaccgaacactggaactcgccgagggtcgactcgtcgacgatcgctggacccccgagagccaacgcaacggaagccctgagcagccgtgatgtgtcaggccgctggcgtcgccggctcgacttcgggatcggctgctcggcggccccgcccacgcgacagtgacaacaacgcggcaatggcgatgaacaccatcgaggtgtagaaggcggcgtgcagaccgtgcgtgaagacgtctgccaagtgtccgctgagcttggtggtgccgacgaagatcgcgaatgcgagccctcgcgggatggaacgtgccgcagaaaggatggcgacggagaaggagaagaccatcccgatgttcgagaacgtccggagcatgcccgaggcgatgccgaacacttcggggggagcagctttcatgacggccgagttgttcgcggggaagaagctcgagccgccgatgccgttgatgatgctcgcgacgacgacgagcgccagcgtgacatcgttgctgagctgtgcgtagacgaacagcgcgatcacctgcacggcgaggccgacggtcgcagggatgactgggccgacacggtccgcgagtcgccccgcaaacggaccgacgacaccgcccaggagatagcccggtacgagcagcaaggaagcgtcgagagcgctcaggccccgcggtccttgcaggtacatgatcacgaggaagagaactgcgtagttcccgagggcctgaaacgtcgctgccaggagcgacggtgtcatcgtcgggatgcgaaagatgcgcaggttcaccatcggctcgggatggcgtagctcgatcaggacgaagacgccgaggatgacgagtccgccgacgaagaacgcgacgatgtgggagtcgagcggccgcgtcgcgagttgcgtcactgcccagagcagcccgaagatcccggcgccgagcgtgagcatgcccccgatgtcgaaacggtggtgccgtgaggtcgcttcgttgtggagcacacgcgtcgcgagggccacggcgacgatgccgatcgggacgttgatccagaagatccaccgccacgagacataggtgacgatgaccccgcccaacacgatcccgaggaccgcacccaggctccaccccactgcgttgaagccataggcccgaccccggcgatgaggcgggaagatgtcagcgatgacggcaccggagttggccgacacgagtgcgcccccgacaccctggagcactcggaatccgatgatcgctgcttcgttccaagacagcgcgcacaaggcggaaccgacgacgaagaccacgaaccctgcttcgtacatgcgcacacgtccgaagaggtcgccgagcttaccgacctgggtggcgagcagcgtgatcgtcaagaggtacccgatcacgacccaaatcaccgaactcagggccacgtgcagcgcacgctggatctccggcaaggcgagcaccacgatggtggtgtccaccgcagcgatgagcacgccggccatgatgaccgccaaggcgagctgcgggtgatcggtcacggacgagtggtaggacgcatcatcagtgcgagtagccatggctctccccggtcgaaggctcgtcgaagcttgctagttccaaccttatcgacgagtcgggtgttcccgtctcagaatctgcgatgcgtcgaggacgggggcgagcggtaggcttcgtagctgctgtggcgggtagttcaattggcagaacgcctgactttggatcaggaggctccaggttcgagccctggcccgccagccatcgccgttcctctcgacgcgctctgcgtggagctgtccggccttcgaacggcctttgggtcgccgacgttccccacgtgagactgagcgcctcgggccgaccgctgtggtagcaaggcgcacccgacgaatcatgagcatggctcgatcacccgctgccgcgacggcgaccgaacccgactccgccggcacgaacgcatcgggaacgtgagcagccgaatccatgtgaccacgcgccgccagaaccccgacgttgccatcgttgccgcttgacccagcgcttgcaggagtcgaccgttcttcctcgcattcgccaggtcgtgcagagcgtcccttcggctggaagatcatcgggaatcgccaacggcctgcgcaccgctgatcccgccacgaacacccgagccgtgcgtcaaccgagccgaggggccacggcatggtccatgtgtgaagccggggcgctccgtgtcgccagtcgtgacgaacgtgtgccgatcgctgctctcggccactcgcgagccgcggaacgcgacgcggcgaagcgcacgcgctgggttggagcaacgtcgaccgcaacgctcgcacagtggccgtcacaagggccgcctcacgaagatgcgcgtcgagcctcgcgacgccgtcaccgaggtccaagcgaggacagctcgcagcatgcctcgcgtgctcgcatccaaaccgctcgtctggttcctcgaggagcaccgggcacaccagcgccgggagatcgaacgccctcgccccctcagcggtcgagctggggcctgctcccggttcccctctgccttcggtcggccccttgcgcttggtgcgccgaaccagcacttcggatgcctgtctgtgacttctctggccatcatctcctcgagccaaggagccttacggcctcgcctcctcgtctcgcgcgtgtcgttcgcgcctctctgcggccgtcctccgctcgaaggcatcggcctcgggcagggcaagagcagttcgggtgatcaccgacactgcgtccgcagccccgaccacccagcgggacctaggctcgaccatcgtggtcgctggcgcacgtcatccggttcgttggttcctcgccgaacgcggcttgctggcggctgcggtgggcatgcttccggtcggcctgtccttctcgctcctcgacatctacgctcgcgcgagcgcgctcgggatcgtgctcgcactacagggcgtcggcctcgtcgtcagcttgatcgtcctcggtggcgtcggcgacctcatcgcacctcgtcgcctcctcgtcctcgccgatgcgctctacgcagcctcggctgcggcgttggccctgctcgcgcagacccacagccacgcactcgtcgcctatggggccgcctccatcgtcaccggtgcctccgcgggtctcgtcaactcggctctgcaggctctcctggctgcggtggtgtcgccacaggatcgacagcgcgtgaacggtctacggagtctgttgcgcaatctcgtccaggtcgcagctcctgcgttcgcaggactcgtgagcgcgatcgcatccccaaccgtcgtgctctggctcgccgcgatcgtcgccgccctcggcacgctcgctgctcgcgcgctccccgatacaggcgcgggagcacaccacgacgctggcctgctcgccgaactgcgcagcggttggcgagcgtactgggcctacgggtggctcgtcgctgtcgacggcgccttcgcactgtggcacctcgtcgtctacggaccgctcttcgtgctcggccctgtcgtcgcgcgtgcccatgatcacggtgcgctgggctggggcctcatgctggccggcgtcagcgttggtggcgtcctggggggcgcgctcgtcgtgcgcctgaggcctcgtcgcccactctccttcgccctcatcgcattctcggttacgtcggtgtggctcggtgcgctctggttcgaggcgcccctacccgtcctcgtcgtcgccgccgcgatcgccggggtcggcttcgagcttctcatggggctgtgggacaccgtcttccagggcacgatcccccggagtgtgctcggcaagctcgcagcctacgactacctcgcctccgtcggaaccctgccgctcggctacgccttggcagcgccgctggccgcgatcgtgggcgcacgcggtgtcttcggacttggtgtcgtgatcacggtcgcgatcacgctgggcaccctcgctgtgccgagcgttcgtcatctcccctcgccggcacttcccatcgacgagtgagcgccgacgactcctcggccgcgggttgagtccccgcgccgcatcgtcgcgggctccgctggcagctaccgtacaacgcacctgatccaaggagtgtcccatgaccgatagcgtcagccaactcgccgatgaccagcccacgacacgcctccagcgtgtgctgaatctcgtcccgcgagcgctgtcatcgagaccccacatcatcttcctcgcggtgctcggtgtctacctcgtgctcctccccctcgcccacgtgcacgtgtcggcgttcgcggaactcgtcggcgggaactacacgaacgttacgagcgatctcggggcctgcatcgccgccggcggtacgatccacatcatgcgctcgcaccggcagcaccgcagcgagctcgccgagctacgccgactggtcgaggacctgtcgcgcacgctcgggtcggggtccgagtaaatccgtcgccgctcgcaccacgatccgtcgacgctcgcggccggctgcgcggtgcctcgagacggcacgtcacaccagctcggacggccatccgtcctatcctggaggcgtggcacgcgcacagcccccgggcgcagctgagccacgtcgaccccgccgacgtggttggcaccgtcgcacctttgaaccggagcgcggatggggatcgctgggcgacgagggacgcgccgtcctgcgtgcggcgcagcggcgcatcgcacgcctcgtgtcctcggactcgctggccgagctgccaccagagcccgaggaggaggtggcctatcgcctcctcaccgccgcccttcgggcaggcgccgtcctcctcgcggctggggccgccacgctcgatgtcgagcagaccgtcctcacctttgccaacgccctcggcctcgcagggtgcgaggtcgacgtcacgttcacgtcactcaccggctcgtaccgtcgtggtgcaaccttgaagcccatcaccacgctcgtcgtggtgcgcgatcggacgctcaacttcgccaagttggccgcgatgacccagctgcgtgcggccgtcctcgcgggcgaggttcccccggtcgatgtcgagcagcgactcgaggcgatcgagcggctcaccgtgcgccgcggtcgcttcgtcgtggccggctgggcgggcatggcggctgcgttcacgatcctgctcggcggacagctcctcgccggtgcgcttggcttcgtggcgaccgccttgatctacgtcctcaaccgcggtctcgcccggcgcggcgtcccagacttcttcttgagcgccatcggggcgacgctcgcgaccaccacggctctgctcgcgatcgtggcgcacgcgccgaccgtgcctgccctcgtcgtcgctggcggcatcatggccctcgtgcccggcgtgaagctcgtctcgagcgtccaggacgccctaagcggtttcccgttgtcagggaccgcccgtggcgtcgaggtcctcgtcatcgccaccggcatcgtgaccggcgtcagcctcgtgatctacgtggcacgactcgcgggtctgcacctcgccatcggccccatcccgctcgcctccttgctctatgtgccggtccagatcgcggccgcggcggtcgcggcagccctctatggcatcgcgacatcggtgccgcgttcgttcctcccttgggcggcagtcaccggagcgctcggatgggggattgtcctcgtgctcgaacacaacggcgtctcgctcgtcgtgtcgacggcgctggccgcggtctgtgtcggcctcctcggccaggcgctcgcctccatccacaccacccatccctacctcttcgtcgtccccggcatcatgccgctcgtgcccgggctcaccgtcttcgagggcatgctcgcactcgtcgaggggcacggcggtgccgcgggtctgctcctgcagggcctcgccatcggcctcgcgatcgcggcgggggtcagtctcggttacctcatcttgcgctcgcctgtgagccgaccgactcggcttcgctaggcggtcgcgacctgtcggccgccgcggtgcacctccccggtgcggcctcgcgaacgtgggcggtctcgtgtcgtggtgccacgcccgccgtcatcatgcaggcgctgcatgacgagcccagcagaccggctagggttgaccggctcagctaccttgcgtcgttcctttggagctccgatgtctccgcgtcccgtccgtcgtcgtcacctcgctggggtcgtcctcgcaggcattcccttcaacgtggctcagggggccgcgttcccctactgggtgctgtatctccacagcgacctgcacttccccaccgccttggcgggtctcgtgatcggcaccgagggtctcgcctcgctcggaggcgcgctggtcggcggggccttccaggatcacttcgggcctcgacgaacggcgcaactgggcgcagtgatcgaagccgtggccgcagcgtcgcttgtcgttgctcgtagcccgcttgcggtcgcgggctgcttcgtcctcttcggtatgtcgaccttgcgctatccggcccgatcgagcgcgctcctcgccgcactgccggacgatctctcggcgaccaccttctttagctgggacttcatgggcgcgaacaccggcttcgggctcgggatcgtggtcggggcgctgctcatcggtgccggtgacgcgacggtgatgcggggcttgttcgccgccctcgcggtgacgagtgccctcctcgccgtgacctacgagctcatcccgaaccagagaatggctcgcgaacacctcgagcacgcgtcgtatcgcgcagccatgcgttcgtcgctgttctggtacgtcggcgcgtggggcctgctgctctcgctcgcgagctactcgtcgttcgacgctggcgtgccggccctgatcggcatcgagctccacgcgtcgccgcacctgatcgcgctcggctttctcacgaatcccgtgctcatcgtcgcgttccagcaacccgtgagacgcctggtccaccgactccggtggcgccgcgcaaccatggcgaccgcagcgatcttcggcgcgtcgtggttcatcttgttcggggccctgtggctgcggaccgagttcgagctcgccgtcctcgtcgtcagcttcgccgcgaccttctcgctcgccgagatgctgatggctccccttcgaacccagctcatcgccgcgctcgcacctgagcatctccgcggtcgcttctacgggatgagccacttcgcccgcggtgtcgccggtctcgtcgggccgagcgtcgcaggggccatgatcggtgcaggcctcggcttctggtggctgccgctcgtcgcgagctcgggtgccggtgccgcctgggtcagccgaaagatctttcggacagctcccgccgagctgtccgagcgcacctgacgcaaccggttcgacggctcagacggcgctcgcgtcgactcctgccccaaaggccggacagtgcggcgccagcggacaggagcgacactggtagccgggtacggcatcggcccagagaccgtcggggacggaatcacgacgcagtgtctcgcgaagctcgcggagacggcgagcccgtcggacgacggtcccgatcgcgcccacgccctcgtcgagcagcgcctcatcgacgaggcgacgccgagagcgaccggcttcgatgtcgacgaggcccacccagtcgagatcgacaccaccgatcgtcgcgaccaccgcctcgaacgcgagcgcggtgtcttcgtagccgtagggtcgatgatcgaggacgaagacgcccgcccgctcgcccttcgcatcgaggagctggaggtcgatgaggctccgcagctggacggcgccgaagcgcacggtgcgccgacgcggctcgagcgcaccggcgtgctcggcctcgagcacgccgatcgtctccgctgcgaaggtgatcacttcctgctgaacgaggagtcgctccccgcgtgtgatcgccttcgtcgcatggccgctcacccagtcccaggcccagtggtcgcggatcgaggagcggagcgcgcgatagagcgcgtgcggggtcggtgcctgctcacgctcgtcgtaccagcgcacgacgagctccatcgcgagggtacggcgcacgaccgcgacggacggctcgaacggggcatcgatcaccgaggagccgaggtcgcacgcttcgcggaggtctcggctcgtgaggcggaccggcgcgccgccgccacgcagctcacggacgatcgcctcgacacgtcgcccgaggtctgctcgctcccctcgtgtgcggctcacggcgccgccgcctctgcgtaggtggcacagtcctcgcggaacggacactgggtacagcgcggacctgcgcgctcgatcggcgcaccagcgaggccacgcgcggcggcccgaagcgcatcggcgaccaggcgtgcgccatcgcgcacgacgcgctcgctcatcacgagctgtcgcgcatcggcgaccgcttcgccagggccgaggaggatgatgctcgctggaggtggcccgtagcgcaggccagccagcagcgcgtagaagcggagctcgctctcgtgctcctcgctgagggcgagcgacgacttgatctcgacgaggtggtggggtctcccgctcgcggccccacccaccacgagatcgaagcgcccggtgagcagcacgtggtcggtgaggtccgcccgtgcgcgcacctcggttcgtggccaccacgcctcctcgatgccaagacgctcgacgagtcgcgcgcgccgggtgacgacgtctgccatctgctccgcatcgagctcgaccgtcccaccgtcggcagtgacggcttcgagccacagcgcgacgtcgtcgccggcatggtactcggcgccgtaggcgaaccacgagcgcaccccggcctcgaagaccgtgccgaggtccatggcgcggttgcgcggcgtggcgatctcacggcgcagctcggccgtcccgtagcgctcacaggccacgagtgaggccacgatgcgcttggtcaagcgccaggtctgctcggtggggagttggctggccagctcggcgagctcgtgacggacctcggcgatgacgtcacccgcgaccgggtcgcctgggcgccagagcgcctcgacgagcgctgcctcgctctcgagccagacgatgtccgtggcgctcacgaggccgactccgaactctccagcgaagccggcacgtcgaggggtttgagacgacccgcaagcaacgcgtcgcagaccgcgagcgtgccctcgacgaacgagcgaccgagcgctccggcgacctccgagtcgacacgcgaggcactccagccggtgagcgccagccgacgggcgaccacgagcggccacacacgtgccaaccaccgctcctcgatcctcgcccgacgaccgtagcccctgatccacgccgcagcacgctcctcgcagtgcggggcgtcctcgaggaagctcagcgctccggccagatctgccatcgggtgtgcgaagccagcgtcgtcgaagtcgatcggcaccaacgccgagctctgggtgcgcacgacgttggcggcgcgcagatccgagtggatgaggagcatctcgtccaccgcatcgagcatgctggcgacacgttcggcggctcggtccatgagacgccgctcggacgagctcgcgcaggcaagctggtagctcccccagtgggcatgcggccccaccagcgcgccagcatcccagcgccaccgacgaaaccacggtggcgggcgccaccgacgcgcgtggttctggagttgggcagcaacctcaccaaggcgctcgaaacttgccggatcgtcgctgtcgcctgctcccacttcgcccgccgtccagctcaccacgaccaccggtccgtctctggtgtcgacgagacccggggggccatggagctgggcgatgggccgcggggcggcgacacctgccgcatccagcgctgcgagccaggcgagttcgctcgccagttcggtgaccgtgcgatagccaggacgcgggacccggagcgcggccaccggaacaccgtcgcaagaggcctggaacaccacgttctcggagacggcgacgggcgtcaccgtcgccccgtcgagcagcggcaccacgcggcacgcggcttcggcagcctgaacggcccgctccaggagatcggccatgaccgaacgctacccgctcgctgagcgccctacactgcatcgtgccgatgcaggtcctccgtccgcagctcgccgtgctcgtggccgccgtcgccagcctcgctgcctgcggtagcgccgtcccctcgccgaaggctcaccgcctcctcccggcgacccatccgctcgcacctcggccggtcctcgtcgctccctctgccgtctcgaccgaccccggaccaggtgccctcccacagacacccgcgcttccgtctgcgacgacccagagcttcaagaccagtgtcgctgacctgtgggctgcgatcgtcaccgataatccggccctcgccatgcccgccttctttccgctcccggcctacctgcaggtcaagtcgctcaccgacgacgcgcacgactgggcggttcgcctcgtcgcgcacttcgtgctcgacatcgaggcagcgcacgcggtcgtgacgtctcatggcggcaccccgacgctggtgggcctcgaggtgcccacgacgaacgcgaactgggtgccgccgggcacctgctacaaccgactcggctactggcacgtacccggctcccgcctcgtctaccaggtcggcacgacgacctactcgatcggtgtgctctcgctgatctcctggcgcggcacgtggtacgtggtgcacctcggcgcgatcaaccgcccgagcgacgaaggtgccgtcgacgcgcccgccgtcggggtcggttccttcgggcccccgggcggttgctgagcggcggtcgagtaccgttccaagggctcggcaccggctccggtgccgaggcacccacgatcgacgggaggggaacgagcatgctcatggtggcgagtgcgaatggccgggccggcatcgatgccgtatttcctcggctcctcgaaggagcgctgaccccgttggacgccgtcgaagaggcggcctgggtcaccgaggacgatccggccgatcactcagtcggtaccgggggcctccccaacatcttcggtgccgtcgagctcgatgcgtccatcatggacgggaccaccctcaaggccggtgcggtcgcggcgttgcgaggctttcgtcaccccatcagcgtggcccgagccgtgatggaacgatccccccatgtcctgctcgttggtgagggtgccgcagcgttcgcacgcgcggtcggagccgaggccgccgtgctcgagaccgctgaggcgctcgcttcttggagaacggcgatcgcctccctgcacgccgaggagctcgcctcgacgctcgcgatggcacgagcactcacccgcgatcccgagcgggccgtcggtacggtcaactacctggcactcgacgaccgaggccgcatggccagtgccgtgtcgacgagcggatgggccttcaagtggccagggcgagccggtgacagccccgtcatcggcgccggcaactactgcgatgcccgtgtcggcgcggcggcatgcacaggctttggcgagctctcgctccggactcagctcgccagccgctgcgttggcttcctcgaggccggggccacctgcgaggaggctgctgtgcgtgcgatcgagctggtgaaccgcctgcaggtcgatcccgccgagcgcatcatgcacatcgtggtcctcgatcgagatgggaaccacgcggcggcgtcgacgcgagcgggaacgacgtatgcctggcgtgatgggtcacaaccacactgccagctctccccgagaacgcacgtcccccccgagggctcatccgtcgtaggctaagcagcacacgatccgacgggaggtagtcgtggctcctgaggaacgcaggacactgccgggctccgccatgcctcgtccggcgggcgcccaggtgctcggccagatccccgacgacgaacgtgtcgaggtgaccgtcgtactccaaccgcgcgcccccctccctgagccagggccgacccccatgtcgcgagcggagcttgccgatctgcgcagtccacccgagggagcgctcgaagcgatcgctcgctacgtcgccggtcagggcctcgaggtcatcgcagccgacgcacctcgacgccgcatcgtgctcgcgggaagcgcagcacggatcgcggctctctttggtatcagcttcgtgcgactccagctcgagggccgacggtatcggacctacgaaggggagatctcgcttccggccgagctcgcccccctcgtggtcgcggtcctcggtctcgacacccgccccttcgcgcgctcccatcggcgtccggcggtggcgccgaacgcacccacgaccgctccgaccgtcgcgcgcgcctacgacttcccgaccgcctacgacgggcgcggtacgacgatcgggttcatcgagctcggaggcggcttccaagagagcgacctcgtgcgctactgcgaggggctcggcctctcgacgccccaggtcagcgtcgtcggcgtcgacggcgcccgcaacgccccgaccggcgaccccaacgggcccgacgcggaggtgatgctcgatctcgaggtcgccaccggggtggccaacggcgccgacctcgtgctctacatggcggcgaacaccgacgcggcgttctacagcgcgatcgccaccgcgcttcgcgacgccacacacgctcccgtcgcgatctcgatctcctggggcgcaccggaggagtcctacccagccaccacgatcgcggccttcgagagcgtgctcgaggaggcggtccatgtcggcgtgacggtcctcgtcgcggccggcgaccaaggctccacggacggcgtcgacgacggacgcgcacacgtggactaccccgcggcgagcccctacgtgctcgcgtgcggtggtacgcgcctcgacctcgacggcaccacgatcgtcgccgagacggtctggaacgacctgccgaacggcggcgcgaccggcggagggatctctgcgctcttcccggtcccgtcgtggcaagcaggcatcgcaatgccaccgagcgccaatcccggtgccggaccaggacgcggcgtccccgacgtcgcgggcaacgccgatcccgacacgggctatcggatcgttgtcgatggggtcgcaaccgtcgtcgggggcacgagtgccgtcgcaccactctgggctggcctcgtggcacgctgtcaccaagccggcgctcgtggcggcttctggaacccgctcctctacgcagcccggggatcgtcggcgttccacgagatcaccgtggggtcgaacggagcctacgacgcagggcccatctggaatgcgtgttgcggcctcggctcaccgaacggcaccgccatcctccaaacgctcagagcgtgaccccgacgaacgcaaccctctgggccacgtccgatccgacgcagcccagggcgtgccgtgtgagtgtcccgcgtcgaggcgtacccggctcacaccaccgcaagttgacgcgtgatcgcgacgtcacgctcgagcgtcgcgtgcacggggcaacggcgatcgacctcgttggcgagctgctcgtagcgttctggcgtgctcgggccacgaagctcgacgtgaacgaccacgtcgctcacacagggccgagccgcaccgtcgagcgtcgcgggatccagcgatccctcgacacggaccgtgaccgaatcgagtggaacgttctgcgcctcggccacgtgctggtaggtcaacacctggcacgaggcgagcgcgccaaggaggaactccaccggacttgccagcgtgccatcggatgcgacctcgaagcggcgaccccgtgcgagctcgatctcggcacggccggcggcgctcgtcgtcgccgtcgctccaaagcgcacgacgggtcgtggaccggacgatgacggatttgatgctgaacgtgtcatacgcatagcttactatcccgatcggctttatcaggtataggtcgactggttatcaccgcaccggttacggaggttgcatgcagcaggtcatcaccgggtggacgaccgacgacgagggcgactgggtcgcactcctcgcgtgtggccatcgacgccatgtacgccatcgccctccactcttcccagcgccctgggtcctcgacgagatcggacgctccgaccacgtcggtcagccgatcgactgtggccgctgccgccaagggatcttgccgccgctcaccgacgagacggcaaccctgacctggatcgacgctcgggcgaccgacgtcgagtgggtcatggggggacggacgaatcactgggagctcgtcgtcgtagccgaggggcgagtgcacctggagctcaccttcgctgacggcgacacgacgacgtggtggctcgagggcggcatgcagcgggccctcccggtcggctgcgcgtaccgcctccgaacggcgacccacgcgtcggtccttctcgcacgcttcgaccagtcctgactcgaccgacgaccgcagtgacgctcgagcccgcgagcgcaccgctccctcgccgagacgcccgctcaccccagcaccggcgacggacccaccacgatcaagccgagcccgatgagcgtcacgaagaccaccccgagcacccgctgtagcacgcgcatcgcaacctccgaatccgggccagacacagtcccaacgcctcgacacagccccaacgcacgacgagccgggatcccgaaggatcccggctcgtcacgaaagcccggtcggcggcgccctactctcccagggggtctccccccaagtaccatcggcgctggtgggcttaacggccgtgttcggaatgggaacgggtgtttccccaccgccatggccaccgcccggacgatctgcggcgtcgagcgctccagagcgagcacgaggagctccaagtcctcggccgattagtaccggtcggctgaacacgttgccgtgcgtacacctccggcctatcaacgtggtcgtctaccacgggccttaccaggttgaccctgtgggaaacctcatcttgagacgagcttcgcgcttatatgctttcagcgcttatcccttccgtaggtcgctaaccagccgtgcccttggcaggacaactggcacacgagcgctacgtccgtcccggtcctctcgtactagggacagcctctctcaagtttcctacggctgcatcggatagggaccgaactgtctcacgacgttctaaacccagctcgcgtaccgctttaatgggcgaacagcccaacccttgggaccgacttcagccccaggatgcgacgagccgacatcgaggtgccaaaccttgccgtcgatatggactcttgggcaagatgagcctgttatccccggggtaccttttatccgttgagcgacggcgcttccacatgcgaccgccggatcactatgccctgctttcgcacctgctcgacatgtgggtctcgcagtcaagctcccttgtgccattgcactcgacgactgattgccaaccagtctgagggaacctttgggcgcctccgttactctttaggaggcgaccgccccagtcaaactgcccacctgacgcggtcccggacccggattcacgggtcgcggttagagctccagcaccgacagggtggtatttcaaggacgcctccagggaagctagcgctcccctttcgcaggctcccacctatcctacacagtcggaaccaaagctcaacatcaagctacagtaaaggtccacggggtctttccgtcctgatgcagctaacgagcatctttactcgtacttcaatttcgccgggtctgtggttgagacagtggggaagtcgttacgccattcgtgcgggtcggaacttacccgacaaggaatttcgctaccttagcaccgttatagttacggcggccgtttaccggggcttaggttcagagcttcgcccttgcgggctaacccctccccgtaaccttccggcaccgggcaggcgtcacagcgtatacatcgtcttggcgacttggcacgctgctgtgtttttagtaaacagtcgcttccccctggtttgtgacaccccctcgggctccgggcgcgaggcccttcaccctaccgaggtcttccttatcccgaagttacggaagtaatttgccgagttccttaaccacagttctcccgctcgccttggtattctctacctgcctacctgtgtcggtttggggtacgggcgcctcgatcactcgctagaagcttttctcggcagcatgggatcagtgacttcgcccgaagtgggctcggagtcgcgtctcaggcttcgtgaggtccggatttgcctggccctcgccctacacgctttccccaggaacgaccaacgcctgggatcacctaccctcctgcgtccctccatcgctcaaacgcgatcggggcggtaccggaatatgaaccggttgtgcatcgactacgccttgcggcctcgccttagctcccgactcaccctgggtggacgagccttgcccaggaaccctgaggcattcggcggaggggattctcacccctcgttcgctactcatgccagcattctcactcgagcgcgctccagctcggctcacgcctcaccttcacggcacgctcgacgctcccctaccgcccggtgacgtacgtcaccggacccgcagcttcggtgaccggcttagccccgttacattatccgcgcggaaccactcgaccagtgagctattacgcactctttgaagggtggctgcttctaagccaacctcctggctgtctgggcggttccacatcgttttccacttagccggtactttgggaccttagctggcggtctgggctgtttccctctcgaccacgaagctcatcccccgtggtctcactgccaggctctggagcatcggcattcggagtttggttgggatcagtaaggctgtgggcccccatagcccatccagtgctctacctccgatgctgaacacctgacgctgcacctcaatgcatttcggggagaaccagctatcaccgagtttgattggcctttcacccctatccacaggtcatcccccctgttttcaaccagggtgggttcggccctccacgggatcttacccccgcttcagcctgcccatggatagatcactcggcttcgggtctaccgcaggcaactctcgtcgccctgttcagactcgctttcgcttcggctcccccacgcatgggttaacctcgctacctacggtaactcgctggctcattcttcaaaaggcacgccatcgccctcacgggctctgactgcttgtagaccaacggtttcaggatctgtttcactcccctctcggggtgcttttcacctttccctcacggtactagttcgctatcggtcgcctgggagtacttagccttacgaggtggtcctcgcagattcacacgggctttcccggatcccgcgctacttgggtggcgacggggaggcagctcgcttcgcctacggggctgtcaccccctgtggcgcgacgttccagtcgcttcggctcacgcgctgcttggtaactccctggaggggctggcgcaccctcctcgtcgctcccgctacccccggacggcaacgccgccaggcttgacaccgcccgggtttgggctgatccccgttcgctcgccgctactaggggagtcgcggttgctttcctctcctgggggtactgagatgtttcaattccccccgttccctcctcctgccctatgtgttcaggcaggggtgacgtggcattccccacgccgggtttccccattcggacatccatggatcaacgcttggtcgacagctccccatggcttatcgcagtcgcccacgtccttcatcggctccaggcgccaaggcattcaccgttggcccttcgtaccttggagttgtgatactcgtgctcgctctggagttctcaagctgccgcgcagcaggtgcttcgcgaagagggagccagtgcttcgactgggtgcggccactcgttgtggccactccttagaaaggaggtgatccagccgcaccttccggtacggctaccttgttacgacttcaccccaatcgccgaccccaccttcgacggctccctcccttgcgggttgggccaccggcttcgggtgttgccgactttcgtggtgtgacgggcggtgtgtacaaggcccgggaacgtattcaccccggcgtgctgatccgggattactagcgactccgacttcacgcagtcgagttgcagactgcgatccgaactgagaccggttttttgggattggctccccctcgcgggttggcgaccctttgtaccggccattgtagcatgcgtgcagccctggacgtaaggggcatgatgacttgacgtcgtccccaccttcctccgaattaactccggcagtcccctacgagtccccggcatgacccgctggcaacatagggcaagggttgcgctcgttgcgggacttaacccaacatctcacgacacgagctgacgacagccatgcaccacctgtgaagggccccgaaggacaccgcatctctgcggcttttccctccatgtcaagcccaggtgaggttcttcgcgttgcatcgaattaagccgcatgctccgccgcttgtgcgggcccccgtcaattcctttgagttttagccttgcggccgtactccccaggcggggcacttaatgcgttagcgtcggcacggagcccgtcgaatgaggccccacacctagtgcccaacgtttagggcgtggactaccagggtatctaatcctgttcgctccccacgctttcgctcctcagcgtcagtaccggcccagatcgctgccttcgccattggtgttcctcctgatatctgcgcatttcaccgctacaccaggaattccacgatcctctaccggactcaagccatggcagtatcggatggcgacaccaggttgagcctggtgatttcacatccgacttgccaagccgcctacgagctctttacgcccagtaaatccggacaacgctcgccccctacgtcttaccgcggctgctggcacgtagttagccggggcttcttctgcaggtaccgtcagtttcgtccctgctgaaaggagtttacaacccgaaggccttcgtcctccacgcggcgttgctgcgtcaggctttcgcccattgcgcaatattccccactgctgcctcccgtaggagtctgggccgtgtctcagtcccagtgtggctgatcgtcctctcagaccagctacccgtcgtcgccttggtgggccgttaccccaccaacaagctgataggccgcgaggccgtcccgtcgcgcccgaaggctttgctccctcgaccatgcggtcaggggagcacatgcggtattagcaccggtttcccggtgttatcccccacgtcggggtgggttcctcacgtgttacgcacccgttcgccactcggtggcaagccaccgcgtacgacttgcatgtgttaggcacgccgccagcgttcgtcctgagccaggatcaaactctccattggagatcgttccgagggtggagtccaccctcgctcgcctcgccccgggacacgtgggtctcgggtgagggagagtcgatcatggttggtgggtttggtcccaccgtttgtgttgtcggggtgacaccgagcttgtgctcgggtcgcccgcactggcttgtcttccctcttcgcgatgtcaacctgcgcccctgtcggggctctgccacgagggcacccgaaggtgctcgttgtggatggtgggttgccccacccccagcggtgctcttggagcacgtgggattcatcagtgtagcggggtcggaacgggtcgtgcacggttgggggacatcttctgtcgagatgggacgtcccgcgtcaagtaccatcggcccatgcctgtctatcgactcggttcccgcagcccccgcatccatcccgacgcattcgttcatcccgatgcggtcgtgatcggcgacgtcgagatcgacgaggaggcatccatctggccgcacgccgtcctgcgcggcgactacggccacatccatatcggcgcccgcacgtcgatccaagacggcaccgtcgtgcacgccacggccgacctcgcgacacgcatcggggcggcctgcgtcgtcggacaccttgcccacctcgagggctgcaccgtcgaggatcacgtcctcatcgggtctgggtcggtggtcttgcaccgcgccgtcatccactcccacgcgctcgtcggcgcccatgcgacggtgaccaacgacaccgaggttccatcccacgccctcgcactcggaacacccgcggcgatccaccccgatcgcgtgcccgccggcaccttcgacgatgcggtgcagcgctacgtcgagaacgcgcgccgctaccgcacggatctcatccgcatcgagtagcggtcgattcgcgcgacgagccgaccgcccacctcggtcaccgtgacgggcatgccgaagaccgcggcgagcgcatcggcgtcctggaggatcgcacgagtaccaaagcgggtgatccccgctccgacgaggagcacgtggctcacctgggcggggagctcctcgacatggtgggtcacgatgaacgccgcgcgcggtcgtggcgaccgctcgagcagctcttcgagcgcccacagggcctcctcgcgaccgatgagatcgagatgcgaggttggctcatcgagcacgatgatctcagggcgccccgcaaaggctctggcgaggaggactcgctgacgctgaccagcagacagatcctcgatggctcgatcacccacgttcgccaggcccaccctcgccaacagccggtccgcttcgacgagttcctcgtcggagagctcgaaccacgcacgacgaaggccagcatgaggaccgagcgcgaccgcatcgcgggcgctcgtcgtcggcaccagctgagtcgtgagctcgtccgcgaagtacccgacccgtgcgcggaagctgcgcacgtcaccgtggcgcaggtcgcagtcgaggactcgaagctctcccgagcgcgggcgcaaccggcccgcgatggccgcggcgatggtcgacttgccggcaccgttcggacccacgaccgcgaccaccgcgccgtcggggacgtcgagcgtcagcccttcgagcaccgtcttcgtaccacgggcgatcgagagattcgtcgcgctgatcaccgtcgcgttcgccatggaacgccaccctacgcgacctagatggcgattagcagcacagcgaccatcgctagcaccatgccgacgatctggcgcgggctcgggctgacacgatcgatgacgagaccgagcacgagcgtcacgaccggatagacggcagtcacggccacgatgggtgctgccgttccaagcggcgcggctcgcagagcgagaaagtagagcaagtaaccggcgacacccgcgaccccggccgcgatcgcaagtggccccatgtagggccgcaagaacgcgatcgatggtaaggcaatgacggcctcgacgagcacgacaccgagccagagcgacagtgcggaagccgaatgacccgcccgagcggagaagtacccccacaccccccacgcaagcgcgctcccaaccgcaagcagcaccccgaggagaacggatcgcaccgctccagcctacgtctcgcgaactgccggcgattcctcaagttcgcgtcgaccgcacccgatacgatcgcagggagggtcatgggacacgactcgagttcgatcatcctgcgagggcgcgaccagatcacgcacgacgcgctcgcacaacagcttcggctcctcaggacccacgcgggcgcgatgggtgtcgccgtcgtgcgggtcggagacgatgggcgcgtcgtcatcgaggcgctcgacatggaccgagccctcctgcgtgagggtgaggagatcgtcgtcaccgacccaaaggtgctgcctgagcgcgcagacgcaccgagtctgcgaccggggcgcatcgaaagcgacctcttgacgttctcgccactgcatggtctcgtcctcgtccccttcgagagtccacaggaccagtcgctcgcactccttgtgttcgctgcgcgcccgctcctcgtgaccgacgacgcactggtgcttgcagcccgcaccatcgagaccttcctgatcgccgcgagccgctttaccgaggaactgcgctacctgaagggcaccctcacacagtcggagttctactccgaccgagaccccctcacccacgcgctcaatcgtcgtggtttcatcggcctgctgcatcgcctcgaagccgactggccgcaccggcgaatggcctacgcgatcatcgtggccgacctcgatcatctcaagcaagtgaacgaccaccaagggcatgccgccggtgacgcgctgatccagcgcttcgtcgagaccctccgctccaacctgcgtgagccggagaacgtcgggcgtctggggggagatgagtttgcggtcgtcgccaagctcaggacacccgccgagacgcagatcctcctgaaccgcttgcgcaccgcactcgacgccgcggggatcgctgcctccctcggagcggcgagccgcgacgtcccgatgccgctcgaggaactcctcgtcctcgccgaccgagcgatgtacgacgacaagttccgtcgccacgaagccatcgagggcatcgaggccacggcaccatcgctcttcgaaccaaccctctagcgatcgctgcctgtcgttcgccaccggtcccgatgccgatcggaacgcggggctcatacgcgcctcgctgacaccacagcaaagccacacatgagcaagggggcgcgctgcgcccccttgccttcgatcatgtccctagcccgggccctgacggatgcggccaagttgaccgctgcgggcaccgacgtgcaggcgctgatgagtgcgagacgccgcactcagcggagtggctcaggcgtccgcgctgtcgtcgtcgcccgtgccgtcaccggttccctcctcgccctgaggcgggccgatgtagttgccctcgtcgtcgtagtactcggcaaaggcctctcggtactcgggtgcgagctccccgccctcgagcgcctgacggatcgacaggctgatgcgccgacgaccggggtcgagatcgatgatcttgacccacagctcctcgccgaccgagaccacctgctccgggagatcgacgtggtggagggccatctccgagatgtgcacaagaccttcgatcccgggcgcaacttgcacgaagcacccgaacggcacgatcttggtgacccgtccgtagaccagctccccgatcttgtgagccgaagcgaactcctgccacgggtcccgctgcgtcgccttgagcgacagtgagatgcgctcgtgctcctggtcgacctcgagcaccaggacctgcacctcatcgccgaccgagacgaccgacgatgggtgatcgacatgattccacgagagttccgacacgtgcacgagcccgtccataccgccaaggtcgacgaagacgccgaagtgcacgatcgacgagacgacgcccttgcgcacctcgcccgggcgaatcgaggtcaagaagcgctcgcgctgatcgcgctgattctcctcaaggtaggcccgccgactcagcacgacgttgttgcggccccgatcgagttcgatgatcttggcctcgatgtcttggcccacgaacggtgcgagatcacgcacccgtcgcaggtccacatgggacgcgggcagaaagcctcgcagtccgatgtcgacgatgaggccacccttgacgacctcgatgacctcgccgcggaccacgccgtcgcgagccttgatcgcctcgatctccttccaggccttctcgaactgggcccgcttcttcgacaggaccaatcgcccctcgcggtcttccttctggaggaccaaggcgtcgatccggtcgccaacgctgaccacgtcggcggggctcacgtccttacggatcgagagctctcggagcgggatgaccccctccgacttgtagccaatgtccaggaggacctcatccttgtccaccttgacgaccagtccgctgacgatgtcaccctcgtcgaactcgacgaggctcttggcaatcgcctcctcgagtccctgctcgccaaggtcgtcgaggacgatcgcgtccgaggccgcgggagccccatgctcggatcccagctcgcgttcgctcgcggactccgacgccatctcttcagtcatgctcgatccgatatccttctgcttcttccaacgccaccagcgcggacgtgccacgccatggccgaggatagtcggccgaatgccggccgctgcggctcatgcgtcagctttggcacgaccccaacttcggccgacgccgctctgtactcgcagcggcacccgtagtgcaaaggcgtgctcgagcacgtcctcgacgagggcacggacgtcgtgcgcgcgctccgcgacagcctcgaccacgacttcgtcgtggacttggagcacgagtgcgccatcggtagggctcagcgcagcgtgcaagcgcaccagggcgatcttgaagatgtcggccgcaagaccctgtgtccccgcgttcatcgcctgccgctcggcgccttggcgaacggtgcgattgggtgagtcgaggtcggggagatagcggcgccgtccgagcagcgtcgtagtgaaaccctgcgctctcgccgcatcgacggaagcatcgcggtagtgccgcagccccggaaaggccgcgaagaaatctgccagtatcccctcggcctccgcgggagggacaccaagacgttgggcgaggccgtaggcctccatgccataggacagaccataggtcaccatcttggctaccgaccgctgctgcggcgtgacgcgctctgctggtacgccgaagacacgcgcagccacgagggtgtggacatcgccatcgcccgagaggatccgtaccagctcctcgtcgcccgacaggtgtgcgaggacccggagctcgatctgtgagtagtcggccgccacgagcacgtgaccctccgtcgccacgaaggcgtcgcggaaccgcttgccctcgtcggtacggaccgggatgttctggaggttcggtcgctcggaagagatccggcccgtgcgtgcgacggcctggttgaaggtggcgtggatgcggccgtcggcaccgatctcactgcgcagaccttcgtagaacgtcgacagcagcttgtcgagctcgcgaaagcgaaggatcgccgcgacgatgggatgagcgtcgcgcaagctctcgagcacacgggcgtccgtcgagtaccccgtcttcgtcttccggcctgccggcaacccaagccgctcgaacaggaccaccgcgagctggcgcggtgagttcgggttcagctcaccaccggcgtagtgccggacctccgcgagagcacgatcgcgctcggtggcgagctccgtaccgatcgccgccaggacgtcgcggtcgatcgctaccccatggatctccatgtccgtcaggactcgcgtgagcgggatctccacgtcggtcgcgagacgccacagatcgtcctccgtcaggcgccgctccaacgcttcgcgaatcggatggacgacctcgacccactgcctcgctccgagcggcgccgcttccgcttcgaggggcccccggtcgtcgaggtgtctcccgagccagcgccgcgccagttggtcgagaccgtgagcaacgtccgcagagtcgaccagccacccgagcacctcgagatcgacgagcgcgcgtggctcgagcggcaccgcatgctccatcacgagcgagcgcacgatctccttcgggcctgctcccacgaggacgcacgacccgagggcctcccacagatgcgtgggggcatcctccggagagcccgcccaaaccacgccctcgacgccgagcgcgagctcgaccacgcggctacgtccggggtctccagcgaacgtagccgccaccgccaccgtggcacctggtgcgagccgctcgacgacggcggcggcgctgacgtcggtgaggtgcgcaaccggcgactcgaccggcggtggttcgtcgccggcggtcggccgaccctcgaacgcccgcaccagggcctgaaacggacgccgcagctcgaaggtccccaccatgagcgtctcggcccgccgcgggtcccacggaccgagtcgcagcgcatcgagggaaggtagctccgcgacgtctcgacgcagctgcgtcagcaggcgtgcctcgaggagctgtgagcgcgcctgctccagcgcctcgcgttgccgcgccgagagggcatcgaggtgagccaagatcccttcgatcgactcgaaccgatcgagcagggcggcggcggtcttcggcccaatccctggcacgcccgggaggttgtcggagctatcccctcgcagggaggccagatcgccgtagcgggctggtggaaccccgtaggtctcgaggaccttggcctcatcgaaggcctcgagattggagacccccttgcgcgtgaggagcaccacaatgagcgggtcctcgaccagctgcaagaggtcccgatcgccggtcacgatgcgggtggcgatcccggcgtcgcgggcgcgcgtggcgagggttgcgatgacgtcatcggcttcgaacccgctcgcctcgacagcggggacgccgatcgcctcgagcaacccacgagccgcatcgagctgctgtcgcaggtcatctggggtcggtgccctcgtccccttgtagctctcgaggatggcgtcgcgaaaggtcgggccctccgcgtccaacgcgaccgcgaggtgcgtgggccgggtttgggcgacgacgttggcgagcatgctcgcgaacccgaacagggcgttggtcgcgaccccgctctccgtgcgcatcatcggctcccgcagggcgtagaaagcacgaaagaggagtgagtagccgtcgagcaggaggaggagctggcggtcagtcggttgtggagctgggactgagctcaccgttgatcacctgctcggcgatggaccgcacccgcgtgcgctggttcatcgcggtcttctgcaagaaccgaaatgcctgcgcctcggtgaagccatcacgctccatcagcaccgccttggcacggtcgaggagcacgcgcgtctcgagacgctccgcgatccgttcgtgctcgtcacgcaatctggccagctcagcctcgatgatctgtcgctcgtcgaaccgagccctggcgagctcgagcgcagcgacgagctctcctgcctggaagggcttgaccagatacgccatgaccccagcgtctcgcgcctcctcgacaagggcacgctgtgagaaggcggtcaagatgaccaccgcgaccgggacggagccttgcacgcgtcgcgccacatcgagcccgtcgagtcccggcatcttgatgtcgagcacggcgagatccggcttgagcgcaccgatcgcctcgagcgcctcgtcgccccgcccgaggtcggcgacgacctcgtagccctcgagctccaacatctcgcgcaggtcgcgccgaacgatcgcctcgtcctctgcgatgatcacgcgtgccgacatgcacccctcgctgctcgactcgcgcccacgctagccgcagcccggttccggtgctctcgccctagcctccagatcgtgatcaccgccctttccctctgggtcgccggcacgaacgcgtggatcgcgtctgccgacggccgagagtgcgtcatcgtcgatgcgcctccagagccatggcacatcgtcgagcggctcgacgcactcggcctccgcgtcagcgcgatcattgcaacgcatggtcatctcgaccacatcgggggcatgcacgatctccaacgcgcccgtaaggaagatgggctggtcgaggtgtggcgttccccagcggatgcgcactacttcgtggaccccctcgggaacgccccgctgctcgcagacgccgtcgacagatcccgtgtcaccgtcgccacgccagaaatgatccgcgatctcgacgacggcaccgtggtgcgtggggcaggtatcgagctgcgtgcaatctggacccccggacacacgccgggatcgacctgcctcctcgcgaccatcggcgacgaaggcaccgtgctcttcagcggcgatcacctcttcgcgggctcgatcggacgcacggatctccccggtggctcactcgagcacctgctcgcctcgatgcgcgatcgtatcctgccgctccccgacgacctggtagtcctgcctggccacggaccaacaaccacgatcggcagagagcgagcaacgaacccgtatctccaagacctgcgctgaccacaggcagcgcaatgaacgtctcggcggattggaacccggggctcgccgaggcgatggcgccgtgcccggggcgggactcgaacccgcacgcctgttggggcagaggcttttgaggcccccgtgtctaccattccaccacccgggcttggccgcagcctaccgtggctcccccaccgagccaagccgcgcgcacgtcacggtgaccggccccaagaccggatccaccctcacggtgggacccgacgtcctcacgctaccgctcgcaggtccccccgggcaccgatcatctcgagtgcggagaacgtccgactcctcgtcgaggtgcagaggatgtgccgctggctctcgacgtcgagcccccggacctcggcggggccgaggtagccggcggatccacaggcccacgttgtgttggtgcggtgcgagtcgtgcccgaggagcactccggcctccgacacagagccgaacagctccccatcgagcacctcctcgcggacctgggcgcacagtgactcgcacaccccgttaccgccacagcgagcccggatcggtgaaccacgaggtcactccgagttcgctcgcccagcttgccacggaacccgcgacgaactccggggcgttgtcgacccgaagaaagccttgggctcctcgctcggcgacgaggccatcgagggtggcgacacgtcttcggcgtcgatcgagtgccccaccacgcaaggccagctcctccctggtggaggcgtccaccacgcatcgcaccgtgagcgccctcccgtcgtcggtcgcgtcgaaccggctccagtgcccagatcgcgttcgcctggatgggcaggtgagacaccgtttgtcaaccccccacgcagccggcgactcctcgcatggcgcgggaggactcaggcggcagcccgaggcgatggtccgggggcacgtccaagggcacggttccggttcgccacgtgacgcccctcgtcgtagggcacgccctggcgagggttcgccagggcgaaggtacgcaagacctcggtgatggtcgcatccaggctggactcgggcttcgtcggcacccgacgctgggtggagcgaggctggcctgtcacccggcacgctcgtcgctcggagacctgagaaccgctggcggagccggcgcacggctccccgccggcggtccggggtcagacgtttccctcggccagctcctcagagctgtcgatgtcgagggagaactctgccaccaacttcttcaagcgccggttctcggctcagagctccttgagcctcttcacgtctggccccttcatgccgccggaggtctgcttccagccgctaccaggtggtcttggtgatgtgcaaaggcccgggcgacctcggcgaccgtggcgcccttggtgagcagctgtccctctcggccagcctccggaggatctgctccggcctgtggggcttcgggcccttcatgtggtctccctcccgcatgtccagtctggtcggggttctcacagagcgggtggtctcgttgcaggggggccagccaagttggggtacaggtcatcgatggcacccagttgcatatcaccaaatcctctcccactggcgtcaaatagatggactcgaggagacgagagcacgtgtgagagaggatgtcaaccgatcatcggtaagtcgggtggctggtagcatgtccctgtcgtggtcgcgtaggctgcagcccgttcagtcgccgccgtgtgtcggcgatccaagccgacccggcgcgaagatgccggccggatcgaacaggcgcttgatgcccgcgtcgatgcgcaactcggtcgcgctcgcgtgggtccggaactcctcaagcttggcgaccccgatgccgtgctcgcccgacaccgcccccccacggcgaacgccctcggcaaccacttcttccacgacacgccgtgcgctggccacatcgtcggcgaacaccgacaggtggacgttcccatcgccgacgtggcccgttgcggcgaggcgcaccccataggtggaggcgacggccgcgaccgcatcgaagtagtctccgagcctggctggcggaacgaccacgtcgacgatgtcgcgggcaccgagagccctcaccgtccacagggccgcttctcgggcgcgcagcacggcccggccttcggtcttgccgagaacccatacgccatcggcgccagccccctcgagtacggctcccgccagctcgaccgctcgtgcaacgtcgtccgcgtcgacacgctccaccgcaacgacgaggatcgcgccgtcggcgagcgcccagccgggtagcccgagggtcacgcccgcaaagtgagccatcgcctcgagcgcgctcggttcgaggtactcgatcacgcttggtggcggctcgatcgactgcagagcctgcaccgccccgagcgcaccacgcatggtcggggcatgagcaacgaacaccgcctcctcggcacgcggcgcgagccgcaatatcgctcgctccacgatgccgagcgtgccttcggatccgatgacgagctgcaggaggtcgtaacccgacgagcgcttgtagagggagcctccgagcgtcaagacgcgaccgccacccgtgaccactgtggcaccgagaacgttctgcctggtcgtaccgaagcgcaccgctcgcattccgccggcgttcgtcgcgaccgtcccgccgatcgaagcggcgttctcgccaggcgacacggtgtagcgcaagccgtgatcggcgagcacgtgatcgagttcggcgaggctcgtgccggcacggacgacggcgacgcgggacaccgtgtcgacgtcgtccaccccgctgagccgctcggtactgacacagacctcggttggccgacagaccgctccgccggccagccccgtccccgcccctcgcacgacgagcgggacctggcgacgctcggcccagcggacgagctcgacgagctcgtccgtgtccgctgggcgcacgagcgccatcggccggctcggcgcgaccgtcaaggactcgtcgtgccagtagcgctcctcgatcatctcgccgacggcgagatgatcgggtcccacgatcgaaccgagctcctcgaatgcacgctgcacggatcgaccttaggcagtggggctccggagggcaaggcttgccccggtttcgccatgcccgacacccacgcagcctcgagtctgtaacccaatccgacgcgagagcatctaactgatgaaggctggagaaggggcaggtacctacgcagtgacggagcggcgcagacgcacaccgagcagggcacctcacgcagggtagctcgtcagtgtcatcggctctggtggcgcgacacgaggcactcgccctagggcgtggctacgagggagaggtcgtgcgcacgggatggggcgtcaggcgccacgatggatcgaggtccgtcggacgcgcacgagcgcagcggcaggtagtcagcaggtagtacggagagagggaaagggagtacagccatggtggtgtttctgttccccggtcagggctcacagcagcccggtatgggggcagcctggcgcgaccatccctcgttcgaactcgtcgacgaggccagcgacgtgctcggtcgcgacatggcctggctgctcctcgaggcggatgccgagacgctccagatcacgcggaacacccaggtggcgacgctcctcatgagcgcgatcgcgctcgacgccatcgagcgcctcggcatcgcaccgcagctcgctgcaggccactccctcggtgagtatgccgccctcgtggccgcgggcgggatctcacttgaggcagggctgctcctcgttcaagagcgcggcgacgcgatggcccaagccgccgaggcatccccgggcgcgatgatcgccctcctcggcgcgacgcttgaccaggcgcttcagctcgtcgatgcgatcggaccggatctgtggctcgccaaccacaactccgacacccagatcgtgctctccggcacgaccgacgcggtcgcgagtgcggaggagcttgcacgcgagtacgggatccggcgggtcacgcggctcaaggtcggtggcgccttccattcgccctacatgctcgaggccaaggatcgcctgcgcaaggccatcgcccagacgaagttctacgacctcgaggttccggtgatcgctaacgtcgatgcgcgcgagcacgtccttgcgagcgaatggcccacgctcctcgccgagcagctcaccagcccggtgcgttgggccgagacgatgagcgccatcgccgccgctcggccggccctcatcgtcgaggtcggccccggcggagtgctcgccaacctcgccaagcgcgccatcgccgacattccaacgatcgcggtggccaccccagatgacctcgaaaccctggtggaacggctcgccggcgacggaccggtcgccgaatgggcgacctcccaccagggcgagcgcctctacggctctgagcgccttatcgtcgcgccggtcacgggcgtgttccagccagcccggccggctccggagcccggcgcgcccgtccgagtcggtaccgaagtagggacgatcggcgacactccggttcgatcggccttcgccggtacgctaaaggagatgctggccgtcccgggcgagcgcgtcaccgctggccagccggtcgcctggctgtcggagacgagcgcttccgaccacgcaccggccgccatcgcaacccccctccacgaaagcaggtaagtcacactatgggagcacggatcatcggggtcggccaggccgtcccggatcgggtcgtcaccaacgccgatttcgaggcctatctcgacacctctgacacctggatcaccgaacgcaccggcatccgcgagcgccgcttcggcggcaccacctcgagcctggccatcgaggcggggcgacgcgcgatcgccgacgccgggttgacccccggcgacatcgacttcctcgtcctgtcgacgacgacgcccgatcagacggtcccggccacatctgccgaggtatcccaccagctcggaacccgcggtggcgccatggacctcaatgctgcctgcgcgggctacgtctatgccctcgtggtcgcacgtggcatgatcgcctctggggcacaccgggtgctcgtcatcggatccgacaccctctcgcgcatcaccgaccagaacgaccgctcgacggccgtcctcttcgcagacggtgctggtgcggtcgtcatggagcgtgccgacgaggacgacctcctcggctgggacctcggtgtcgacggggcggcgcgccccatcttgtactgcgaccacggcggctacatgtacatggagggacgcgaggtgttcaagcgcgccgttcgcgtcatggttgagtcgtcggagaccgcgatgaagcaagctggcgtgaacgccgacgacatcgcgctgctcgtaccccaccaggcaaacctgcgcatcatccaagccgccaacgaacgcctcggcatctcgctcgaccgtacggccgtcgtgctcgatcgctacggcaacacctcgtccggctcgatcccgctggccttggccgacgccgtcgcccaagggcgcctccatcccggtgatcacgtcctcttcacgggctttggtgccggcatgacctgggcaagtgcggtctggcggtgggccagatgacccacgtcctcgtcaccggcgccgcaagcggcatcggcctcgcgaccgtacgcaccctccaagcgagtgggtttaccatctcggccggcgtccaccaccgccccatgcccgacgacgtgctcgcagcgggcaacgtgacccccgtcgagctcgacgtcacgaactccgagagcgtcctcaaggcggtggcagcggccgaggcggccaacgggaccatcgaggcactcatcgccaacgccggcctcaccgacgatcagctcctgcttcgcatggatgaggcgtcgtgggccgcgacgatcgacctcaacctcacgtccgcattccgactcgccaaggccgtcgtcccgcgcatgctcaaagcccgtcgcggacgcatcgtcttcgtctcgtccgttgttgccctgctcggttcgccaggccagacgagctacgcagcagcgaaggccgggctcgtcggcttcgcgcgttcactcgcgcgcgaagtcggatctcgcggcatcaccgtcaacgtggtgatgccgggcatgatcgacaccgatctgctgcgcgcgaccggagagcaacgactcgcgtccatcctctcccaggtgccgctcggtcgcaccggtcggccggaggaagcggcgtcggttctcgcctttttggtctcggacgccgcgagctacgtgaccggatccgtcatccccgtcgacgggggtctcggaatgggcatctagcgcactcgcgcagcgcgagcggagagcctgtcggccgctcacgcgcccgtcgtgacaggcagtacggccgcaaggccatggaccagtaccacacaggaggaaccacaatggaccgcaccgaggcattcgagaagttcaaggtcaccacggtcaaggtgctcggcgtcgagccggaccaggtcgtgatggacgccagcttcgcgaacgatctcgacgccgactcgctggatctcgtcgagctgatcatggcgctcgaagacgagttctccgtctccgtgcccgagtccgagctcgagggcgtcgataccgtgggcaaggcgttcgagctggtctacgggaagctctcgtgagagttgaggcatccgagcccgaacggttcgcgtctcggcgcgtcgccgtcacgggcatcggcgtcgtgagcgctgtgggcatcggcaaggaggccttctgggagggcctccttgcaccagcacgcacgggtgtgcggcgcatcgaaggatgggatccgtctgcctggctcgggccgaaggagatccgccgccacgatcgctacaaccagttcggcgtcgccgcagcgcagatggcatgggacgacgccggagcgccatcggtcgatccggcgcgcgccggtgtgatcatggggaccggcgtcggcgggctcgagagcctcgagaaccagatcgtcatggcggagaagcgcggctacgaccgcatcacgccgttcctcgtcccgctcttcatggccaactccaacgccgcgtcgatctcgatgcgcttcggtctcaacggtccttgcgagaccatctcgacggcgtgcgcggccgggaaccacgccatcgccaacgctgcgcacctggtcgcgatggggcgcctcgacgtggccctcgcgggcggtgccgaggcagcgatcacgccctcggcgacagctggcttcaccaacatgaccgcactgtcgaaggaggggatctctcgaccgttcgatcgtgaccgagacgggttcgtgatggccgaaggtgccgcggtgctcgtgctcgaggatgccgagcatgctcgagcacgtggcgcgcacatctacgcctacatcgaggggacggcctcgaccgccgacgcccaccacatcaccgcacccgcccctggcggcgtcggtgcgcgcagcgccatcgagctcgccctcgccgatgccggcatcacccctcgtgacgttggccacgtcaacgcccatggcacctcaacaccgctcaacgaccttgccgaggctggtgcgcttcgtgccgtctttggtgacgccgtaccgccggtgaccagcatgaagggggcgctcggccacgcgctcggcgccgccgccgcgctggaggcggtcggggtcatgctcaccttcgagcaccagctgatccccccgacgcaggggacggtcgccctcgatccggagatcgacatcgacgtggtcctcaaagatcctcgcccgctgccgccggggcgcatcatctcgaatgcgttcggcttcggcggtcacaatgcggtgatcgtcttcggcccgccttcgacggactgaacctcgcgctcgccgcgcagcacacgcagcgagacaacacgaagggtcgcccgaaacgcctcgggcgaccctttgctgtgccacctggctgtagtccggctgcgcgcttgacgcatggtcgcccgatcggtcatcgtcatagcaacgaaccacggggccgagccccgacccttagcgagggtcgcaagcatccgccaaccctcacgtccgctctccgctcccggcgccccggcgttcgcccctgtagcggacgctcggggatgcgagactcagcgctcgcgagaggcgtgttcgccgaggatgatctcggcgccacgctcggcgatcgcgatggtcggtgcgttggtgtggccgcgaacgatctctggcatcaccgatgcatcgacgacgcggagcgccccgacgcccctcacccgcagcatcgggtcgaccaccgagcgctcgtcacgtcccatacgtgcggtggaggtcgggtgatagatggtgtgggccacgctctcgagcgcgagtaccgctcgttcgtgggggtcgagccgctccccatggtccggcatcaaaagacgtccggtcgtgtgcgcccggagcgccctcgaggtccgcagcacctcgagccgctccagccctgcgatcatgcggttcctgtcgtgtccgtcggggtcggacagataggcggggtcgatacgtgggcccacgagcggatcggggctcgccagcgtgacgctgccgcggctctcgggcgtgagtaggatcaccccgagcgtcagtccatcgaccgtgatgggcacgagaccctcgccgagataggcgaccggcgcgaagaggacctcgagatcgggtgccgcaaggcccggatcggatcgccagaacccgtaggcctcggcgatgttcgaggtcagcatgcccctccggcccacgaagtagcgcaccacttcggcagcgctggtcgctgagcgcagcgtcggttcggtcgtctcgaggaccataccggccacgaggtgatcgcggaggttccggcccacctcgggggcgtggtacaccacccgaatcccaagccgtcgcagtgcaccctcgtcaccgatgcccgagagcatgaggagctggggcgtgttgaccgctccggcagcgaggatgacctcggcgcgcgcgcccagcgcacgccgctcacggccgacgagatactccacgccaacggcgcgccccccctccacgatcacccgcgtcacacgagcctgcgtgcgcacgacgaggttggggcgatggcgcaccggccgcaggtacgcatcggcaacgctcgcacggcgtcccgacgcctgcgtgaccaccgtctcggtgaagccttccgggctcgggaggttcggggcctcgacgaccccgccggtctcgcggatcgcgtcgaggaacgcgcgcgtcacgggccgtggatcgcgctgagcctcgacgggaacgaccgcacgccgcatcgccgccatcatcgggtcgaagccccacgcaggaccggcgagctcggcccagcggtcgtagtcggctcgcatcccgacgacccacatcatcgcgttgatcgacgaggagcccccgaggcccttgccacgcggccagtagatggagcgtccttggaggttcggttgcgcaacggtgcgataggcccagtcgtagcgcgatcgaaacagtcgcgcgaacccggcggggatatggatgagtggcgatcgatcgcgcggacccgcctcgagcaccacgacgcgatgccgaccatcggcactcaagcggttggcgagcaccgcaccggccgatcccgccccgacgatcacgtagtcggcgtgctcgtccaccaccgccccttacgactcgctggccccgctgcgactgcgtcgaccgggtcggcgaccacgctcgtgggcctccatccgccgccgaatgagctcgcgccgttctcgcagctcgcgataggtcagctgctccgtcgtctcgtcgacgccgaggctcgccttcacgcccgacagatcgatcagctccggcgagaccgccacgccgatctcggacgtgatgcgcgcaccgtacttcgtcatgaagtaggcagccagacgagcgatctcggcgaagaggtcgatgtcgggggcgagcgtggcgagcgacgcgtccacgaagagcatgttcttcacgaagagcatcagctccttgggcatgcgagcacccgagccgagcagcgccttcgtgatctcctggagctcagcgacgagctgctcgggctcgagttccgtgggatcgacagccggctggtccagcccgagatcgtcgatcacctgctcgggatcggtcccaggcgggagcgcaccgagatcgatcagcgcctgcacctgcgtcgtgagatcgttcatcgagcccgccatcaacagccgcaagaaagcgaggcgcttcggctcgctcaggcggccggtgatcccgaagtcgagcagcgccaccgtgccgtctggctgcacgaacaagttgccaccgtgcaggtcgccatggaacacgccgtggagcatcgcgccctcgaggaagctgacgagcgccgcacgcaccacctcggtcgtgtcgatccccgcgtcgtgcatcccgcgggcgtcgtcccaccggtagccgtcgaggcgctccatcacgagcacccgccgcgtcacgaactccgggtggggcctcgggacgacgatggcgcgctgctcggtcgcggcgagcacggcagcgatgtcgagcatgttggcggcctcgatgcgaaagtcgagctcctcgacgatcgtctcggcaaacagctcgacgagtgccggcgggttggccagtgccgccaccgggatcctgccgacgaggtgcggcgtgatccacgccatcgcggcgaggtcccggcgcaccagctcggcgacgcgcgatcgctggaccttgaccgccaccggcgtgccatcgcggagggtcgcgtagtagacctgggcaatcgacgccgcagccaccggagatggatcgaaggatgcgaacagctcttcgagcggcgcatcgagctcctcctcgatggtcgagcggacgacggcgaagggctcggccggcacgcgatcgcgcagctgcttgaactcctcgaccagctccaccgggaagatcccctcccccgatgagatgatctggccgagcttgatgtaggtggggccgagcgtctcgaaggctcgtcggagccgcctcgagaggccccggcgcgacgcggcacgaccccgagggcgatcgaacaaccgccatgccccgagggcgacgccaagggacaggcccgtcccaaggacacggcgcgccggcggcacccgccgcggcgccgtcaacctggggatctgcgcctgtgccctcgcccgcagcgcgggcacaccctcggcccacaggagccgacctgcctccacgcgccatggaccatgttcggtgaaggaccactgctgttcgtcagaggccacgatggcgagcctaccgggccctctcgcgcaccgaccggttctaggggcggcgctcctcatggcctccgaactcccggcgcagcgccgagagcacccgattggcgaacgcgtcctcgccccgagaggcgtagcgcgcaaagagcgcggatgcgatcaccggcgcgggcaccgtctcgtcgatggcggcgagcacggtccagcgaccctcgcccgaatcggcgacacgaccctcgagctgttcaaggtgggggtcgtccgccaaggcccgcgcggcgagatcgagaagccaggatccgaccacgctccctcgacgccagagctctgcgatcttggccacgtcgagttcgtagcggtaggcgtcgggctcacgcatgggggccgtctcggcgtccgcggcgagcgcgaccgaacccgcgttggcatgctcgaggatggagaagccctcggcgaacgccgccatgaggccgtactcgatgccgttgtgcaccatcttgacgaagtgtccagcaccgtgcgggccgcagaggagatagccctgctcctcaggacccaccgcgacgtcggctcgcgtgcgcggcgccgcgtccacaccgggcgcgagggccgcgaacgccggctccaggcgtgcgaacacgtcggggtcaccaccgatcatcaagcagtagccacgctcgcggccccatacaccccctgacgtgccgacgtcgagatgatggatgccccgagcagccagggtcgctgcatgggtcacgtcgtcgcgatagaacccgttgcccccgtcgacgacgacgtcgtccggggcgaggagggagccgagctcgtcgacgagctggctcgtcagcgcggcgggcaccatgagccacaccacgcgcggtgcctcgagtgcatgcacgagttcgtcgagggagccatgcacgctgaccccgagggcgctcgcggaggcgcgtgcggcctcggcggggtcgaatccgtgcacctcgatgcccccgcgctcacggagccgagccgccatgttggcacccattcgacccaagcccaccatgccgatctgcatctcacggcctcctctcgcctcgcctacgctactggttgacgtcctcgatgctccatcgcacgatcccccgcttcgtgcaacgcacgcacgaactcgccgagctccgccggtggtgccccctcgagcaccctgcgcacgatcgccgaacccaccaccgcgccgtcggcaccggcctcgacgaccgcagccgcgtgctccgggctcgagaccccgatcccgacgagcaccgccaactcagcacgcccggcgagccgcccggcgatctcggtcgccgtctcggcgagctggtcgcgctcaccggtgacgcccatcaacccgaccgcgtagacgaagccctccgcagcgcgcacgatgcgctccatgcgcgccgggggcgtcgatggcgcgacgagctgcacggtctcgagaccgacctcgcgcgccgcccgccaccacggctccgcctcctcgatcgacagatccgggatgatgacgcccgcaacgccggcctcggccaggcgtccagcggcacgttcgagcccctggtgatagagcaggttgtagtaggtcatgaccacgagcggcacgccaacgaccaggttccggagcgcagcgatcgtaccggcgaccgtcgtgcctcgctggagcgcgacctcgctggctcgctggatggtcggcccgtccatggaggggtcggagaacggtatgccgatctcgatcgcgtccgcaccaccctctgcgagcgcgacgacgtcgtcttcccagccgtcgcgcgcgccagcgcacacgtacgggacgatcacggaccgtccacgctcgaccctggagcgaaggtgggcaccgaggccgctcaccgccgacccccgaggtacgcagcgaccgtctccgcgtccttgtcgccccgtcctgacagagtcaccacgatgcggtcaccgggctgtgtgcgcgccgatccctcacgcagcacccacgcgagagcgtgggccgattcgagggccggaacgatgccctccgtccgcgacaacgccaccagcgcatcgacgacctcgtcgtcgccgaccggttcgtaactcacgcggcccgtgctcgcccagtaggcgtgttccggaccgaccccggggtagtcgagaccggccgagatggactcggcctcgcgcacctgaccgtcctcgtcctggaggagcatggagtgcatgccgtgcaccacccctggccccccgcgtccgatggcggcaccaccggccggctcgaccccgacgagccgtgccgacgtctcgacgaagcccgtgaaggtcccggccgcgttggaaccaccgccgacgcaggcgacgacgagctcggggacgccaccggcctgggcagcgaactgctcgcgcgcctcgtcgccgatgacacgctggaactcgcgcaccatccaagggtacggatgcggacccatgaccgaaccgatgcagtagtgcgtgtccccgagttcggcaacccaggcgcgcatcgcctcgttcaccgcgtccttgagcgtgcgacttcccgccgtgacctccacgacctccgcaccgagcagtcgcatccgaaagacgttgagcgcctggcgctcggcgtcgaccgctcccatgtacaccctcgcctcgagcccgaggaacgccgctgccgtcgccgtcgcgacaccgtgctggccggctcccgtctcggcgatgagtcgccgcttgcccaaccgccgcgccagcagcgcctgaccgagcacgttgttgatcttgtgcgagccggtgtgggcgaggtcctcccgcttcagccagacctcgcgcccgacgagctccgagaagcgctctgcccgatagagcagggtgggccggccggcatacgtcgccaacagacgcgcgtattcgtcccggaatgcgacgtcggcccacgcagctcgaaatccgctctcgagctcgagcaccgccggcatcaacgactccgggacgaagcggcctccgaagtcgccgaagcgaccagtcgcgtccggcgcgttcgtccccttaggctcgatcatggtcatcggtctctccttccaatgctgcagcggcccctcgcgcagcctcgatgaactgtcgcaggcggatcgggtccttgtggccaggtcgagcctcgacaccgctcgagacgtcgacgccgaacggcatcaccgtctcgatggcctgcctgacgttgtcgggtcgcagcccgccggcgaggatgagtcgccgcatcggcgagatcccgtcgacgagcgaccagtcgaacaccgtgcccgagccggggctcgcggcgtcgacgagcagcgcccacgccggttgctcgatcgcgcgatcgaactccggcgatccggccgcaacggcgcggatcacccacggcgtgcgctctgcgagccaggcgagcccgtcgttcgagatctgaccgtggacctggacgccaccgagtccggtctcggcgaggacctgcgccatgcgctcgggcagttcgtcgcgaaacacgccgaaggtccgtacgccagaaggcaactgcgggaggatctgggcgatccgcacgggcgacacctgcctcgggctcggcgcgagcacgaagccgagcgcgtcggcaccgagggcaacggccagcagggcgtcagactgattcgtgatgccgcagatcttgatgaacactcgcacctcgctcgacgagcgcccggacggtcgcgtaggggtcccgagcacgcatgcaggcctcaccgatcaggacaccgtcgaagcccacgagccccgcgagatcatcgggaccacgcacgcccgactcagcgagcctggccgcgcccggcgggagcgccgcgagcacgcgacgcgcccgatcggtgtccacgcgaaaactcgtcaggtcgcgttgattgacgccgacgacgtccgcggcggcaagctcagcaagctcgagctcgctgagctcgtggatctcgaggagcacctcgagcccgacgtcgtgggcgacaccagcgagagatgcgacctcctccggctggagcgccgccgcgatcagcaagaccgcgctcgctcccgcgcgacgggcccggagaagctccctcgcgtcgacgatgaagtccttgcgcacgatgggaagctcgacgtgctgcgcagctcgctcgaggtcagcgagggtgcccccgaagtgcggtgtgtccgtgagcacgctgaccgcgaccgccccagctcgctcgtaggccgagactcgcgtcgcaacgtcggtctctggctcgacgaaccagcccttcgacgggctgcggcgcttgaactcagcgacgacaccgaggccagccgatgccaggagcgccgagcgaaggctcgggcggggctcgatggcgtcgagtccggcgagcagactcgtgaacgactcgtcgtccaaggcggcacgccgacgatggtaggcgacgatgtcggtcaggtagtcggccatgggcccagcctaggtgccctgcggcccggctcgaggcaggccgcctcgcagctcagggcaccgtgtgataccggtccgttttgcttgcacaatgcaacagaaggtctcgacttcgctagaatgtggccagagcgcaccgcagtacgcgccagctacggaggtcgatcagcgtgacgaagtccaggggatccatcagggaacggagcttccgcctcaccgaacacccgcactacaagtggatcgccctctccaacacgacgctcggcatcttgatggccacgatcaactcgtccatcgtgctcatctccctcccggagatcttcaacgggatccatctcaacccgctcgcaccgtcgaacacgtcgtacttcctgtgggtcctcatgggctatctcctcgtcacggcggtgctggtcgtgagcttcggacgcctcggagacatgtacggccgcgcacggatgtacaacctcggctttgcgatcttcaccctgttctcgatcgcgctctcagcgacctatctccacgggaccgccggtgcgtggtggctcatcgtcatgcgcatcggccagggcatcggtggtgccctcctctttgcgaactcggctgccatcttgaccgacgccttccctccgaaccaacgtggcctcgccctcgggatcaacaacgtcgccggtatcgcgggctcgttcatcggcctcatcctcggtgggctcctcgccccggtctcctggcgtgccgtcttcctcgtctcggtcccggtcggcctcatcgggaccgtgtgggcctacctcatgctgcacgacctcggtcagcgggtgcgagcccacatcgactggctgggtaacgccgtgttcgcggtcggcctcatctcgatcctcgtcgggatcacctatggcctcgaaccctacggcggaagcgacatgggctggggcaacccgggcgtcatcgcggccatcctcggcggtcttgcaaccctcggcgtcttcgtctggatcgaacagcacgttccccaacccatgatcaacgtgcggctgttcaagatccgggcctacctcgccggcaacctggcgagcctgctcgcctcgctcggccgtggtgggatgatgttcatcctcatcatctggctccaggggatctggctccccgagcatggctactcctactcgcagacaccgctctgggccggcatctacctcgttcccctcaccatcggcttcctggtcgcaggaccggtctctggattcctgtcggatcacttcggcgcccgtccgttcgcgaccggcggcatgatcgtcgccgcgatctccttcatcgccctgctcaccttgcccgtcaacttctcgtatctcaccttcgccggtctcttgctgctcaacggactcgcaatgggcctgttcgcctcacccaaccgcgccggaatcatgaacagcctgccggtcaacgagcgcggcgtcggggcggggatggcagcgacgttccagaacgcggcgatggtgctgtccatcgggatcttcttcaccctcatgatcttcgggctcaaggcgagcctgcctcgccatctctacgacgggctcacccaacagcacgtgcccgcctccatcgcccacgcactcgccaccctgccacctgtcggcgtcctcttcgccgccttcttgggctacaacccgatggccaagctcctcgggcccaaggtcatcagtgccctcccgcactcgaacgcggcgtatctgaccggccggtccttcttcccgaacctcatcgcctcgccattcggtcacggcttgacggaggccttcaccttcgcagccatcgcgtgtgtggtggcggcggtcgcctcgtggctgcgcggtggcaagtacaccgcggccgacgtcgagccatcggactcggccgatccctccgtcgccgacgccgtctccgagccggtcgctgggggcgacgcctgagcgaagcgcctgctcgcctgcccctgctaggttgaccgccgtgggacgccatgtcctcgtcgtcgaagacgatccggcgatcgccgatctcctctgcgtgtactttgccaaggaggagggcgaggtccgtgtcgtctccaacggcgaggacgcgctcagcgcgttcgatgcctcggtgaccctggtgatcctcgacctcaacttgccggggcgcctcgatggcctcgaggtcgcgcgggcgattcgccaccgctcgaccgtcccgatcatcgtgctctctgcgcgcgacaacgaactcgatcgagtcaccggactcgaactcggtgcggacgactacgtcacaaaacccttctcaccgcgcgagctcctcgcgcgggtccgggcgatcgagcgtcgtgtcgaggcgaatccctcgtccgcagcggcgctctcgttcaacggcgtcgactgggacccacgggcgcgtcaggtcctccgtgacggggtgccggttgcgctcacgaaccgggagttcgacctcctcgggtacttctttgcccacccggcgacggcactcacccgccgtgagctgctcgacggggtgtgggggccggagtggtacggggacgaccgaaccgtcgacgtccacgtcctgcagctgcgcaagaagctcggcggcgccatcgccatctcgaccgtctggggtgtcggctaccggttcgaccccgaggagcactagcgtgcgacgacgccgtcgcccgacgatccgaacgacgctccgcgccgggctcgcgaccaccgccgtgacgaccgccctggcagccggcgtcggcacgctgctcatcttccgctccatcgctctgcacgagaacgagagcttcctcgcgcgccaagcgagcgtggcggccaacgtcgcaagccgcgccgagcacttcttcctcggtccccacggcgcccataccttcggcgcgcgcaggttggtgcgcctcgatccgtccggccatctcggcggccccgtcccggccgagctgcacggcgtcgtcctccatccgccacagctcgttcccggtcacgtctccttcgtggtgcgaggtgacaccgtctgggccctcgaccccgtcatcctcgtcgaccgccacgcccaacgcacctacgcggtcgtcctccatcgctcgctcccgtccgagctggtcccagccctcttcgtcgtggcgctgaccttgctggcggcgctcgtggccatcttgctcgccgacgcctacacccgccgcgtctcgtcggtggtggcggacctcgcggcgctcgccgaacgagtcagccgtggcgaccttgcccaggcaccgccgtccgagccgatcgcccagcgagaactcgacgatctgcgacaggcccttgcggagatgatcgcctcgctgcgcagtgcgagcgagcgtcagacatccttcctcctcgccatctcccacgacctgcgcacgccgctcacgagcatccggggcttcgccgaggccatcgaggacggcgaggtggttcagccggcccatgccgcaagcgtcatccaacgcgaggcgcagcgcatcgagcgcctcctggccgacctgatgagcctcgcacgcctcgaggccgatggcttccgcgtcaccgtgacccccctcgatctcggcgatctcgtcgagcaccttgccgagaccgctcgtctgcgcggccgcacccaagggctcgaggtgcacgcgtcgctcgcaccggatgcgcgctccgtgctcggcgacccggagcggctctcgcaggcgctcgccaacatcctcgacaacgccgtcaagttcgcgcgcagctcgatcgacgtgatcgtcacccggcgcttggagagcgtccgcatcgagatcaccgacgacggacccggcatcccgccgtccgtgcgcgaccagctcttcagccgccaggtcgcgccacgcccaggtcgcaacaacgagatcggctctgggctcggcctcttgatcgccgcacgcctcgtccaggccatgcatggtcgcctcggcgcgagctccccgatccgatccgacggcggaacacgcatcgtgctcgaactaccggccgccgtccacgaccgcgtaccctcgcaggtcggctgagccagaggccgacgcttcactcgcaatcgcggccaccagtgcatcggtgagcgttgtaggcgagcctgcgtcgccgcgaccgtggacgaccagatggagcgcggcaagtgcgcccgtgagcgctggcgtgatcggacaggcctcgactgcgcactcgtggccgcctcgatggcgccagtgccacgcgagcgcgcccggcagcgtcgtgtaggccgccccgacggcctcggcggcgacgccaggatcgacccaggcagcatcggcgcgtgccagttccgggcgaccgaggaagtagccctgtccgagctcgatgccgagcgcgcgcgccacctcgaactgggcacgtgtctcgatgccctcgagcacgaccgagcacccctggccctcgccaaggcgcgccacggcatcgagggtcacgatggcctgcaggggattctcaccgagggcagcgaccacgtcgctcgcgaccttcacgagatccaccgacaagctcgcgagccggacgatcccctgaccgctgctcccgacgtcgtcgagtgcccgacgcacgccaagcgctcccagcgcaacgagcgtggcctcgagcgatgagggtgctccggtcgagtcctccaggacctcgatcgtgagccgccacggcgcgaccgcgtagcgctcgaggacccggcggatggtgtcgaccgaactcgggttggcgagcaccgcggtcggtgcgttgaccccgatcgcgaggtcggggcgcaggcagttcgccgccaggccgactgcgtcatcgaggacccgctcgaagagctcgccgagctcggcagcggagagaaagggcaggaactccgccggcgaccagagtcgacctcggccatcgtcgagccgtgcgagcgcttcgagcccgatgacactcgcgtcgccgaggcgaacaatcggctggagtgcgagccgtacgcctccaccacgcagacgcgtgaggatctcacgccggccaagcgtcgagtgatacccacgacggagcaacgcgatacggtcgcagatcgcctcgacgagccgaccgagcaagggttctgtcgcatcgggtgcgacctcgaccgcgaccacgagcccccagacgctcgagtcctcgcgtcggcacacgatcgccccgtcgccgacgacctgctcgtccacgccgatgacgcgccgcgccagcggtcccgacggctcctccagcgcggcgacgagcgcggctcgctcgcgcccagcgcttcctcgaacgcgcaaccgacccgccccggtgacctcgacgagcgccgcgccatggactccggcgagcccgcccgcgacgtcgacctcctcgaggaccgacccgagcggtcgaccgtcgaggccgtcgagcgcctcggaccagcgggccctcagcacccgacggcgagcaccggcgacgttgagaccggtctcgagtcgcgccatggcgatgcgggtcgacggcggtacgtcagcgagctcggccacggcgccgccaccccatctcgccaccgccctcgctgccgccgccggaccgtcgacgagcgcgtcgagcacctcgtcggggagcgcgcctccgagcgcgacccgccacgaagggtcctccgcgagctccgccgtggcttcggggccccacggatccacgatggcactgcgggcgtcgctcgctcctgcacctcggacactccgggcgcgcttcgcctcgtacatcgtggcatcggccacgcggagcagccccgcgagatcgccggcgtcccgcggccaccaggaccatccgacgctcgccccgatcgtcaccgcaaggccggcctcgagctccacgggtcgccggagggcacggccgatgcgctgtgcgagatcgcgtgccgccgcctcgtccatcgcaagcgctgcgaggatgacgaactcgtcgccaccgaagcgtgccaccagtgccgacggcagccggcgcgcgacctcaccggccacacgcctcgccgcctcgatgaggacctgatcgccgacgacgtgaccaaaggagtcgttcacctccttgaagtcatccaggtcgatgagcatgcacacgaccgcacccacactcgcatcgctcgtcaggcgaacgagccgctcggtgagcgccatccggttcgcgaggccggtgagtggatcccgcctggcgatcgacctcgcctcggcttcggcacggcgcagtcgatccacgagtgcgaactctgcgacctcgcggtcgatggcgccacggatgcgaggctcgaacggcgcgagccaagcgcgacggcgtggatcgtcggcgacgacctcgagaccgtcgccgtcccttccctgcagcacccgcacgcccggcacgcggccgaggatgcccgccgccgcttccaggaaggctccgacgctctgggcaccctcggcggcaccagcgagctccgcgagcgcgcgctcgagcgcctcccgccaggcgagttcggcctggtagcgctcggagtctcgcacgaagcgctgcgtgacgagcgccgacgcacccaccagcacgacgatggcagccacgagtgcgctcatgggtccgctcgcggcgtcgaggacgctcgttcgggcagtgaactccacctcgaccggcccgagcgcactcgcaacctgtacgtgcatcgtggccgcagtggcacgatcgaacacgcgcacgcccccgatcgcaaggctcaccgccctgacgccggtctgtgccggggctgcgacctgcaacgttcccggcgcgacaagggcctcgacgaggtagtcgacctgcgcacttcggcgtgcatggatcgcaacggcgatctcgaacccgttggacacacgaaccaacctcgtccccgacgcgccgacggcgacaggatcgaccgcacgcccggcccgccaccagatggatcctccgtgcggggccacgaccgcgatcccctcgatggctgattgacgggcgacgaaggcctcgagcaccggcaccatggtcgccggcaacgacgcgagcgtcggacgaggcccgatgagcaccgtcccgacggtgtcgagatcggcgacgacgaggtcggctcgcaccgcgacgcgccgagcccacgcccgtgcaacggcgttcgcaagcgctcgctccgacgacacactggacgcgtccacacgccgcaaccacgaggccccgacggtgagcgcgaggaggagcggcatccagatggcggcgaggacgacgagacgccaccgtccccgcagccgccatgtcataccgagagtgatcgaccaaccaggtcgcagagttgaggcgcctagcctgggagcatggacgccacgacggtcgccacagcctcggggccgagcgacgcctcggggcccagcgacgcgttcaccgcacccttcgttcgggtccaggtcaccggtcgggatgcggctcgctacctccagggtcagctgtcccaggacgtctcgaccctgaaggcggacggccagggggcgatcagcgtgctcctcggcgtcgatggccacctcgtgacctggctcagggtacgtcgcctcgccgacgatgccttctggctcgtcgtcgccgaggcgcatggcgaacgcgtccgccaacgcctcgagcacttccgcatccgcacccaggccaccatcgagctcctccctggccacctccacgttcggcctccagagggcctcgagcctctctggcccctcgaccaggacgcaccgttcgtcgacgcgcccgccgacctcgcccgcttccacgccgaacgcctcgtggccggcgccttcgatcctgcgagcgatctcgtcgacggtctgctcgcccacggagtacccacactcgtcgagcgtgcagtgagcttcaccaagggctgctacaccggtcaagagctcgtcgcacgcacgtcctcgcgaggagcgccggccccgatcggcctcgtcgcactcgagctggccgagccgatcgccgtcgctcccggtacggcgctcgtcgtcggcggtgtcgacgccggagcgatcacgagtgccgcggtggtcggcgaccgtggctacgccgtcgcctaccggcgccggcgcgcgcgcgagcacacgcacttcgacgtcggcggcgtcggtgcgacggtgcgatcgtccgcaccctagcgaggctcacacgaaccgctcagagccgcagacctctgcccgtgacgctgcctcgcacagtggcgagggtcgatcgcgcgctcaccgctgaccacagctcgccccaggggacctcgtgtgacgacggcgttcagacctcgatgaggcgatcggcgacggcgactgcccgggccaccgccgctgccttcgccacgcactcggtcgcctcccgttccgggtccgagcctgcgacgatgccggccccagcctgcaggagcacccgaccgttctcgagccagacggcggtacgaatcgcgatcgcgaagtccatcaccgcgctctcggggtcggtgccatcgcgaccgacgtagccgacgacgccgccgtagaccacgcgtcgcttggactcgagctcgtcgatcagctgcatcgcgcgcaccttcggggcacctgacagcgtgcccgccgggagggtcgccgcgagcgcgtcgatcgggccgacgccgtcggtcagctgaccatggacgctcgaggtgagatggatcacgcgcgcgaagcgctcgggcaccatgaactcatcgaccacgacgctcccgaagcgtgccacacggccgacgtcattgcgggcgagatcgaccagcatcaggtgttcggccctttccttcgggtcggcgagcagctcctcgatgagagcctcgtcgctcgccccacccgaaccccgcggccgggaaccggcgatcggtcgcgtccagacgacgccgtcgcgcaccgtcgcgagggcctcgggcgaggagccaacgatcgcacccccggcgtccgtgatgagatacatgtacggcgacgggttggtgaggcgcagcgctcgatagagcgcgagagggttcgcccgggtcgtgagctcgaagcgatgcgacagcaccacctggaacacctcgccctcgtcgatcgcctgcttcgcgagccggacggcgtgcgcgaacggctcccgaaacccttgatcgagcagcgccaccccctcgctgggatcgtcaccaagtggccaggcacgcaccggtcgcccgacggccgactcgaggtcggcctcgagacgactgagcgccgccctcgccgctgccgcggccccgacgggatcgtcctccacgagcagcgccgacgagagcgtgagcgactgcgcccagtgatcgatcacggcgaggtcacccgcgaggaggagccgcgcctccggcaggccgacgtcgtccgggtgcgaactcggcacgctcggctcgcgctctcggaccgcctcgtagccgacgtggccgacgaacgctgccgagaacggtccggccatcgggcacccgtcgtcgacggcgtcgacctcgagcccctccgaccaccgacgcagcccatcgagaatgcccggtgcctcgtcgaggaccgagccgtcggcagcctcgagtcgggcgtggccgacctcgccgatgacgcgcgccaagggccgacgcccgacgaccgagtaacgcgaccagcgaccctgctggtcgaccgactcgaggatgaagcccgcctcgccgggcgccaccaaccgctcgaacacctcgatgggtgtgagtgcgtcggcgacgtagcgggcccggacctgaacgagacgcagcctcacgactgccccagcaccggatgcatgaagcaactccacgcgcccgtgtggcacgcaccgaccccacgctgacgcacgcgcacgaggagcgcgtcaccgtcgcagtcggtggtgacggagcgaacctcttgcacggcgcccgaggtctccccctttgcccagtaggtccgccgtgatcgcgagtagaaccacgtccgtccgtcacgaagggttcgtcggagcgcctccgcgtccatgtaggcgagcatcaggacctggtcgtcctcgtcgacgacgaccgccgggacgagtccatcgggaccgaaggcgacgacgtccacggagaccgcctcgcctggggcaaccccctcgatatcgctcacaggtacaaccccgtctcgtcgtcgagccgatcggaggccaccgcgtggagatcccgctcgcgcaagatcacgtaggtctccgagccgatctccacctcgtaacgatcctcgggcgcgaacagcacgagatcacccggacgcaccgagcgcaccgccggaccgaccgcgctcacctctgaccacacgagacgtttggcgatctgcgcggtcgcggggatcacgatgcccgagcgcgcgtggcgctccccctccgacggagggacgctgaccaggacacggtcggccaacatcgtgatcgcagccttcttgggctccaccgccacctcccgttgcaccacgctagccgccgatggggcgcacgacgagacccgccgcgtcgagcgcggccttgacctgagcgacgctgagttcgccgtagtggaacacgctggcggccagcaggcccgtgacgccggtccgcgcgccgtcgacgaagtgttcgacgatcccgacgccacccgacgcgatgacgggcaagctcgtgcacgacagcaccagctcgtagaggtcggtgtcgtagcccgcacgcgtgccgtcgcgatccatggaggtcacgaggagctcgccggcgccggcatccgaaacccgccggacccacgtctcgacgtcgagaccggtggggcgacgcccgccgtgggtacgcacttcccagtcgcccgcgcccgtacgagcagcgtcgatggccaccacggcacattgggacccgtagcgaccggcgaccgcctcgacgaggccgagatcggcgaccgccgccgaattcatcgacaccttatcggctccagcctcgagcaacgcggccacgtcgccgagcacacggacaccgccgcccacggtgaaagggatgaagactcgtgacgcgacacgctcgacgagatcaacgagcgtcgagcgctcctcgatcgaggcggtgatgtcaaggaacaccagctcgtcggcgccctcggcgacgtagcgctcggcgagctcgacaggatctcccgcgtcacgcagctcgacgaaactgacgcccttgacgaccctaccctcggcgacgtcgagacaggggatcaccctcacgctctgcatgcgctgagtgcctcgtcgaacccgagcgagccatcgaggagcgcagtcccgacgacggccccccacacggcccctcgtgcccctcggatcgccgcgagctttgccaggtcgtcagcggaggcgaccccgcctgaggcgatcacctcgaccggcacgacctcgcacagcccctgataggtaccgagatccggtccgctcgccatgccgtcgcgtccgacgtcggtcaggagctgggtccgtacgccgcgtgcgaacagtcgagcggacgcctcgaggagccgccgaccaccagagcgttcccatgcgctcacgacgacctcgagcgccccttcgtcgccacgccgatagtcgagcgccgcgaccagatgctccggatcgagctcgtcgagcgtctcctcgacgagtgccgtcccgagcaccacgcgcgacgcgcccgtctccagcagttcggcgatgtccctggccgtacgcacgccgccaccgacctcgaccgacccgccggcctcgcgcacgagcgcgatcaggtcgccgaccatgtcggcgttacgacggtcgccgggcgtgcgggcacgatcgaggtccaccacgtggaaccaccgcgcgcctgcgtcgagggcgccctcgacgtagcggcgaggatcgccgaaacgccgcggcgcatcgaaccggccctgccgcagccggacagcctctccgtcgagcagatcgacggcgaccacgagttccacgcctaacactcctcctggacccatcgccacagcgcatcgaggaagcgcagacccttcgcccccgagcgctcggggtggaactgcacaccgagcagcgcatcgcgaccggcggcggcgacccaggtgccaccgaactcctcgaaggcaagcgccgcaggcgtcgtcgcgacggcgtaactgtggacgaagtacacccacgcaccctcgaggaccgccagtggccccgaggccccctccgccactcgcaaccggttccactgcatctccggcagacggggcgcagggctcatgcgctcgacccagccgggcaagagaccaagtcccacacgatcgggcgcctcgtcgccgccgtcgaagagcgcctgcatgcccacgcagacgcccaaggtcgccatgccgcgctcgcgacggcgcaccatcgcctcgtcgagaccggtcgccgcgagagcgtcgagcacgctgccgaggtgaccgacgccgggcacgacgagcagccgcgcctcgtcgaaatcggctcggtcgctcccccgcctgaccggatggccgagtgcccgccacgcccccacggcagccccgatgttgccgataccgatgtcggcaacaacgatggcagcgctcacaaggagcccttggtggagggaatctcgccgcccccgctgacggccgtcgcctgggcgagtgcccggccgagcgccttggccatcgcctcgatctggtggtgggtgttcgcgccccgaatcgaccggacgtgcagcgtcaagcggccgcctcgagccagaccccacaggaactcctcgacgtgctcgagcgcgacccccgggctgcccaggaggagcccacgctcgccctcgagggcgacccatgcgccgggcctcccggacaggtcgacgacgacctcgacgagcgtctcgtcgagcgggatggtggcagccccgaagcgctcgatgccgcgtcgctcaccgagtgccccatcgagcgcctgaccgagcgcgatgccgaggtcctcggtgaggtggtgggcgtccacctcgacgtcgccgcgtgctgcgacctcgaggccaatcctcccgtggcgcgcgatctgggtcaggacgtggtcgaagaagggcagccccgtcgacacgtcctcgcgtgggcccccgtcgagctcgagccgtacccggatgagcgtctcgcgagtctcgcgatcgatgatccccacacgcccactcacgcgagcacctccccgagtgcagcgaggaacgcatcgttctcgtccgcggtgccgatcgtgacccgaagcgtgttggagagcccgggccagcgcgacgcatcgcggatgaggatccctttcgccacgagtccctcccatacctcggtcgcaggccgacccggatcgaacaagatgaagttggtcgcactcggccacacgcgcgcagcgagcgtgccgagggcctggccgactcgctcgcgttctcgaacgacgagggctgcgcgtcgtgcgatctcgtccacatcggccagcgcagcgacggcgaccgcctgcgtcaccgcgttcacgtgatacggcaggcacgccgaccagagcacgtcggcgacctcgggcgcacagacggcataacccagccggagtcccgcaagcccggcggccttcgagagcgtacggatccgcaccacgtgatccccaagcagggtcgcagggccgagatcggcgaagtcggcgtaggcctcgtccacgagcaccagccgatcgtcgcaggccaggacgcggtccatcacctcgggcggctcgagcatccccgtcgggttgttcggctggcacacgatcacgagctccgagtcggcctccagactcgacggatcaatcgacccgtcggatcggcgcgcaccggcgaccaccgtggtgcgcgtcacacgggcgatctggcggtacatgccataggtcggctccgcgagccacaggcgtcgaccgggcccaccccaggccgcgagcacggtctcgagcacctcgttcgacccgttcgcgacgaagatcgaggtcggcgcgacaccgtggagcctgccgagcgcagcgcgcagcgcctcggcgcgccgatcgggatagcgcgccagatcgagcgcgaccgcctcctcgagcgccctcgcgacggcgggcggcggaccatacggcgactcgttggtgttgaggcgaaccctggcgggaacctgggccgagtggtagctcgcccccagcgcatcctcgagcgacggagccggcctcaccatccggcctcccgacggatgcggatcgagtccgcgtgcgcgacgagcccctctgcgtcggcgagcgcctcgacggcccagcccagccgactgagcgcctcgtcgtggacctcgacgacgtggaggcgacgctggaagtcttcgaggccgagcacgctcgcaaaacgcgccgtcccagccgtcggcaggacgtgtgaggggccggccacgtagtccccgaacgcggcactggctgctcgtccgacgaagaccacaccggcgtggcggacccgatcagcgtcccgaaccgcctggtcgtagagcagctcgaggtgctcaggcgcgatcgcgtcggccaccaggcgagcttgatcccggtcgcgcacgagcgcgagatagccgtgcgcctcgagcgtgctctcgagctgggcgcgcctgggactcgcctccacgtaggccgcgagctcttcgagcacctgctcggcccagcgggcgtcccaggtcacgagccaggccaggccatgggggccgtgctcggcctggaccgcgacgtcgatcgccgcgacgcgcggctcaagggagccgtccgcgaccacgaccacctccgaggggccggcgaaggcacccggcacaccgacgtcggccgcgacctcttgcttggccagcgagacgaagaggttgcccggacccacgatgacgtcgacacgctcgagcgactccgtgccataggcgagcgccgcgaccgcctgcgcgccaccggcgagcagcacggtgtcgaccccggccagatgacaggcggcgagcgtcgcgtcgtcgaggccaccgtcgggcaacggcggtgtggcgacgacgacatcgcgtacgcccgcaacccgagccaccgtcgcggtgtgcacgacgcttgagggatagcgagcctgtcccccgggcacgtagcagccggctcgctccaccgggacgatcctgcggcgcacctcgatgccgtcggccaccagcgacgacgccgccgggcgctcggcctcgtaggcctcgcgcacgcgatcgcgagcgacccgcaacgcctcggccagccgccgatcgaggcgctcgtaggcggcggccatcgcctcgcgaccgaggacgagcgctcgcggccgcacgccgtcgaagcgctccgtcagatccgccagggccccgtccccacccgtgcgcacactctggacgatctcacgcacgagtgcccgtggcccttccaccggcaacgccaccccgggaagatcgtcgcgccgcagggcgccagtcgtctcgcgaagatcgacaagggtcagcgatgccatgggactcctcggacagcagggcagctcagcggcgctagtctaccggcggcgaccgcgacgaggaacgtggcgaccgtaacggaggaacgctgtggccgaggctcacgagctcgcctcgatcgcgagcacctacgaggagctcgctcgacgcatcgaggccatcgagcgctcgctgctcgccgaccatcgagacgggccggcccagtcgctgcgggccgcgtgggcactgaaccgagccctcctgcgcgaactcgatgaggcgcgtcgccgtctcgagagctgatgcgggtcccagccctcgctacgttcgcggcaaccttcgcgtaacgtacccctggtagtcttcgctccatgacccacctcatcgaaacgtggggcgtgctcgcggtcttcgcgctctcggtcgcacagtcgctcggcgtacccacctcctctgagctcaccttcggcctcgtcggcctcctctgggccctcggacggatgaaccccgtggcgggcatcgccgccggtgtcatcggcgaactcatcggagcgatcgtcgcctggtggcttgccgccgctgcggtcgagtctcactggtgggcgcgcttcgaggcgcacccgctcgtggccgcctttcgtggtgtgctcacctccctccttcgccgccgcttcggcgtgctgatctcgcgcctcatccccctcgagcgcaacgtcgcagcctgggcggctggcgtcgccgaggtctcgctcggtgcgctcgccctccagagtgtcgtcggatcggcgatcttcgccaccgcgtttgccctggccggctacgaggccaaggacgcgatcaccaccatcgcgcaccgagccggccagatcggcgaggtcgtcgcggtcattctcgtcgtcggcgtcgtgctcgccatccgtcagatggcccatcgtcaactcgggcgcagccgcgcagctcgctccggccacgcggccacccaacccgacgccaccgcacccgacaccaccgccaccgaggatcgactcgtcctccagctgctgccgtcggagccactctcgtcggccgcctacctcgacgcgctcggccggatccatcagaccgaaccgccatctccggacgtctccgccgacgagggccgccgcgccccacggcgcgatctcccgacctcaggtagccgctagcgagcgcctccccgccccagacccacgccggacggctctcggtgccgaccggcacccacacgccaacggaccgacttgcgccacgtgcgggcgcgtcatcggcgctgcaggcacccgaggagtcgagcacgcccatcggtgagcgccatgtcccaggaccgtgcgtagcgacccgtggcaccgcggacctcccgttccgcacggcccctcgctgcagcagcgcccctagacgccctcggccggcgcgaagaacccgtcgcccaccgcctggagcttgatcaggttcgtcgttccacgcacaccgaacgggatgcccgccacgatgacgacgagttcgccgacctcggcgagacctcgctcgacagccgccgcgagcgcctcgtgcaccatcagctcggtcgacggcgtcctcgccacgacgtgcgggatgacaccccagctcagtgtcagcgaccgcgcagcgcgcggatcgggggtcgcgccgaggatcgccaccgctggacggaagcgcgccagcacccgagcactgtgtcccgactcggtgagggccaccaccgcacgcaccgggacggatcgagtcatccgcgtggcggcctctccgatcgcatcggcgacggagtgggccacaggcgagggcctcgtgagcagcgtgagcgcctggttgtccacctcgcgctcggtcgcacgcgcgatgcgatccatggtggcgatggcctcgaccggaaaggccccaacggccgtctcggccgacagcatcagtgcgtccgagccatcgagaatcgcgttggcgacgtcggatgcctcggccctcgtcggcgaccccgcctcgatcatcgactcgagcatctgggtcgcagtgatcaccggcttgccggcttcgttggccaggtggatgatctgcttctgcaggagtgggatccgctcgacgggcatctcgactccgagatcgccgcgggcgaccatcacggcgtccgaggcagcgacgatctcgccgatgcgctggatcgcctccttgcgctcgatcttcgcaacgagcatcacgcggctcgccgcgcccgcgcggtcgatctggcgtcgagcaacctcgaggtccgaggccgagcccacgaacgacagcgcgatgaagtcgacgcccgcctccagcccaaaggcgatgtcggcgaagtcgtcttcggtgagtgcgggcagctccagatacgaatccgggaagttcacgcccttgcggaccgacagtggccccccctggacgaccgtggcctccacccagccgtcctccgagcggtcgaccacgaggcggaccgcgccgtcagcgaaggcgatcgtcgcccctgggggcacggtatggaggatgccgagccgactgatgtgaatcgcggcgtggcgggcgctcccctcctcggcgatctggacgacctcgccgggctggagctgtgtcgcgtcgtcggccagcgactcgatccgaagcttcggtccggcgagatcgagcagcacgccgaccgtcttgccggtccgagcagcggcttgacgaacgagctcgatcgagcgggcatggtctgcggtgctgccgtgtgagcagttgatccgcgcgacatccatgccagcctcgatcatcgccgtcaaggtcccgaggttcgatgaagccggaccaatactcgcaacgatcttcgtgcgccggtgctcgcgcatgcgcctcctctctcgtcgaggtcaggctacgtgccggcgctgccgagctcgacgagtccgcgcgcgacgtgctcgagaaagcgccgaatcgtcgcgtcggcgacccgatagaggagcgtctggtcgatgagcagaccggtccgtccgagcggcggtcgatagctcccctcgagccagagctgacagagctcggggccaaccttcgaaaccccgagcaggccgtcgagccgcggaaagagccacggagcttgcgcgccctcccacgtcatcggaagctggagttcgtcgtcaccgaggcgccgtgggctcgcgatccgaaacgccaccggcgtgcgcaagagtccagcccgaagaccgagcaccgcgcgcagaccggcgtcatcggccgtcacctcgctcgcgagatcaccgagccactcggcactctggcgcgacagcagcggggcagcgacctcgaacggcaacggcagctcgacgaagtcgcggacgaagcgcaccgggaccgacccgtcgtgctctcgctcctcggcctccacgctgtcctccacgaactccatgccctccgtgcgtgaaccgcccgaggggctcacccacctctcgtctctaggctacgcgcgccacgcatctaggccaaggagtacgcctcacggtgtgacactggtccctagccggtggggtcggacgaccgtgctgcggccggcggaacggatgccaggaccatcgcagcgagcgcgagaagtccaccgaccaccaccggtaggcccagggatgcatacccgaaggccagcgacgcgagcgcggcgaacagcggttcggccgcatagatcacggagatctgcacgctgtcggcgtgagcgagcgcccaggcttggaccacgaaggcgagtgcgctcgcgagcaccccatcgtagacgatggccgtcaccgcgatcggcgtgaggtgcgtcggcacgagacccgcacccacgagcggtgccgcgaccacggtcgcggccgcgatcgtcgtcatctgcagtgccgctgtcaccatcgcatcaccgggagacccgagctcctcgagcacgacgatctgagccccgaagaagccggcgcacgcgagttcgaggccgatcccgacgaacgacgcatgccctcgtggggccgagagcaccacgagggcgagggccgcgaggacgataccgacgagctgacgagcgctcggacgtcgaccgagcgccatcacgaagatcggcacaaccaccaccgacaagcccgtcagaaaccccgcgatggtcggtgacacgtagcgttgaccctcgatctgagtgaggtagccgccaaagagcgcgaggccgctcgccaggccggcaacgacgctccgtcgatcgatgcgatggccccgtgcgagcgccagcacccacagcacgagcgccgcgacgctgaagcgtccgaaggtgagctcgaccgggccgagactcccgagtgcgcgctcgttcagcggaaaggtgactccccagatcgccgtgacccccacgacggcccacgaggcacggccccttgccggactcctcacatcgtctccggtagcatggcggcccaatggccctcgagcagcacagtcctcgcctcacccgaccactcgtcctcgccgagtcggtcgcctacctcctgatcggcctcgtcctcgtcgtcatgagcgccgagacgctgtggcaactcgcgcgcgccgtgttcgtcgacgtctcgctcaacggcgacgtcaccgcccagctcgtcggcgccctgaacgacgcgctcttcgtcatcattctgctcgagctgctctcgagtgtgatcagccaccttcgcaagggaggtctgcagcttcgccccttcctcgtgatcggcatcgtgtcatccgtacggcgtatcttggtcctcggcgcgcagctctcgatctcccgaacccatggcgcgcagacccgctcgagcctcgaggagcttgccctcgacgcaggggtcgtcttgatcctgaccgcggctctgtggctcagtcgagttcgtccgcagcgccgacgggctcgacgagtacgggcttcctggcagcgcccacctcgtcgagacgcctgaccggcgtcgtccggggcgcctcggcgagctcggccggcgtcgtccgcgcgatctcgacgagccgctcgaacgcctgcgcgagcgcctcgagcgtctccggagactcggtttcggtcggctcgatcatgagcgcctcgtcgacgatgagcggaaagtagacggtcggggcgtggaacccgaactcgagcagacccttggcgatgtcggaggcacgcacgccggcctcgctgcgaaactccttggcgctcgccacgaactcgtgcatgcacggctcgtcgaaagccgcgggcaacacgggctgaaggcgctgctggagccacctggcgttcaagacggcgacttcactcatgcgacggaggccatccgggccgtggtagcgcatgaaggcccaggcacgagcgagcaccagtgcgttgccgtggaacgcgtgcacgttgccgatggacgacggtggcgtccaccactcgagctgccccgttgcgccagggcgaggcagcggaccaggcaggaacgcctcgagggcgctcgtcaccgcgacgggacccgccccaggaccaccgccgccgtgcggggtggcgaaggtcttgtggaggttggagtgcacgatgtcgaaacccatgtctccgggtcgcgcgacaccgacgatcgcgttcagattggcgccgtcgtagtaggcgagcgcgccgacctcgtgcacgagccgcaagatctcggcgacgtcacgctcgaacagccccagcgtgttcgggttggtcaacatgatgccggcgacggagtcgtcgagcacgcgtcgcaggtcgtcgagcgagaccaagcctcgcgcatcggagcgaaccgtcacggcctcgtagccggccaaggtcaccgaggccggattcgtcccgtgcgccgagtcggggatgatgatccgtcgggggtctcgccccgaagcccggtggtaggcgcccatgatcagcagaccagtgagctcaccggcggcacccgccggtggctgcagggtcgccgccgccatgccggtgatctcgcaaatcgcagcctcgagctcggcgagcagttccaaccaaccctggacggcacgctcgggtgtgtcagggtgcaccccggcgagccctgggagggccgcgacctcgtcggcgaacttcgggttgtacttcatcgtgcacgaccccaacggataggcccccaggtcgaccgagtagttgcgagaggccagtctcgtgtagtgggcgacgaggtcacgctccgatacctcagggagcgcggccggctcgcgacggagccacggaccgagctcctcgagcgacgcctccgggatcgcactgtgacgcagcgtgtcggctcggcggccccggaccgacaactcgaacgccgtcggctcggcatcacgtccgacgagcggggcggacgctgcacgaccgcctgggcgcgcacctcgggtcgacacctagcggacctcctttgcgatccgatcgacgaacgcgtcgatctcctctcgagtccgtgcctccgtcgcggtgagcacgagccaggtcggctcctcggggaccaggacaccggccagccaaccatcctcgaggagccgctcgcggaccggccgcgcctccacctcgagatcgacgacgaactcacgaacgaacggccggccgagcaccgagagtcccgcggcctcgagtcggtcagcgaggtagtgcgcggcgttgtagcacgagcgggcgagctcgaccatgccttgcttgccgcgccacgccaggtagacgcccgcccagatcgcgagcagcgtctggttcgtgcacacgttggacgtcgccctctcacgccggatatcctgctcgcgggtgcgcaacgtggtcacgaagccgcgccgaccctcgacgtcgaccgtctgaccgacgaggcggcccggcacgagccgcaccagctcgctccgggtggcaaacagcccgaggtagggcccgccgaacgagagcgggatgccgaggctctgtccctcggcgaccacgacgtcggcgccgaagctgcccggcggctcgagcaaggcgcacgcgacggggtcggcaacgaccaccaggagtgcctccatggcgtcggcgacccgacgcgcctcccgcaggtcctccacccgcccgagcgcgttcggatagccgatgacgagcgccgaagcctcggcgtcgaccgctgcgaggtcggtcgccagatcgtcacggagacccacgctgacgagctcgagtcctcgcccgcggcccaaggtggccagtgcgccccgatagcggggatgaatgccctgcgacacgacgatacggttccgcttggtggccccgaccgcgaggttgacggcctcgaccaccgcagcggcgccatcgtagagcgaggcgttggcgaggtccatgccgaagaggcgcgcaatcgaggtctggaactcgaacagcgcttggagcactccctgagagacctccggctggtacggggtgtaggccgtcacgaaggcactctggagcgcgagcgctcgcacggcactcggcacgtcgtggtcgtaggccccgccgccggcgaacaccacgaggtcgcgtcgagcgccagcgttccggcgcgagcgccgttccgcctcctcgagcacctcgacctcggccagggccgggggtagttccagcggtcgccccaagcggagcgacgcggggatcgatgcgtagagctcctcgagcgacgccaaccccacctcggccagcatgcgctcgatctgcgcctcggtgtgcggtacgaaactccccacgaccacctcctcaatgatcacgaacgcaggtcgacgaacgggacggctgcacgctcgaggtccaacgacccgcgagcacgaaccgcccggaacggccctgccgcggcctccgggtcgacgtaggcgaggccgatgccgacgcccgcgagcggcgagtacccacccgacgaaatcgagccgacggccgtcgaggcggcatcgacgaggacgtcgtgggcgcgtggaggctgtctcgtcagcgagcgaacgccgatcagaatcgggttgacacccgcggcctgctgggcgagcaacgcctcacgaccagggaagggccccttctcaaacgcgacgacccagccgaggcccgcgttcagcggcgtgaggccaggtccgagctcgttgccgtgcagcggcaggccagcctcgagccgcagcgagtcgcgcgcacccaacccgcaggcgacggcccctcgctcgagcagccgttccatcaacgccaccgcatcgtcaggggcgacctcgagctccacgcctgggccacctgtgtagcccgtgcccgcgacccgcacctcgatgtcgccgatgcggcctgtcacgatgcgattgcgcgccggcggctctgctccctcgaggagagggccgagcagggccgcagcaccaggcccctggagcgcgaggatgcatcgcgagcgagtgatgtcacgaccgccgagtgcggcggtcacgttctccgtattggccgcgttcggcatcacgtggaatcgctcgcgatcgacccaccacacgatgatgtcgtcgagcaccgatccatcgacgtcgagcaggtgcgtgtactgcgctcgctgcggaccgatcttgcgcagatcgttcgtcagcgtcgcttgaagccggtcgaacgcgtcgggtccctcgacgacgaccgtaccgagatgggagacgtcgaacactccgacgccggtgcgcaccgcgaggtgttcggcgatcgtcccgctggggtaggaaactggcatctcccaaccaccaaagagcgtgaatcgagccccaaggtcgcggtggaggtcatagagcgcggtgcgttcgggcaccccgccatgctaccgctgagcgcggacgtggcgctcagacgcccggccgagccgagacgatcggcagctcgatccgttcggcgtcttcggtcctcgagagccgcagtcgctcgcccatcgggtcgatctcgagccccacgtgggcatgatcggcgcaccacgcctggagcacctcgagcacgctcgtccccggatcctgcgcgacgatcgttgcgctcatcccgggcgtggcgaccggctcgtaggcgatcaacacggacccacccatgaccaacacgctgagcagcatcgcctcgggcacctcggcgaaggcgagccacgcctggtgcgccatgtactgctgggcccgccgacgtcggatgccctccatgaaccgccgatgccgccgccacccgatgaggaacgccgtgatcccgagcccgagcacgagcgacgggaacaccaccaacgccagcgtcgacccctgaggcacacttctagtgtacgacctcaccacgcgccgagcacgagcggccaggctcgatagcatgagcccatgcctcgctcgctgcggcgcgccgttcccactctgatcacgctcgcacgagcggcgttgttgatcccgttctggcgtctcgccgtcgacgagcaccgcacgggagccgccgccgtcgtcgccgtcaccatcggggcgaccgacttcctcgacggctacagcgctcgtcacctcgacgccgtcaccaccgtcggcaaggtgctcgatcccacgctcgaccgagtcgcactgctggtgagctggctcgtcgcactcgaggagcacctcttgccgacctggttgctgtggttgatcctgcttcgggaggtcgccgtcagcgccgtcacgctcacgtcgctcgtgcgcacgcatcgacgccaagacgtcgtcttcgtcggcaaggcgggtaccttcggcctcctcgctgccttcccgctggcgctgattgcgcgcgccacacgcctcgacatcttggccaagggagccaccctcatcgccaccgtcgccctcgcactcctcaccgttgccctgatgcgctacgccacccagctccgagacgacctcgataggctgtcgcgcgaagcaccacctgcttcgtaacgaggcacccccaccagagcgaacccgggaggcgcaccgtgcaggctgtcatcatcgccggaggcgagggaacccgccttcggcccctcacctcgaccactccgaagccgctgctcccggtcgcgaaccggcccatgatcgcccgcgtcgtcgacctcctcgtcgccaatggcattgacgacatcatcgtcaccgtggcctacctgggctcggccattcgcacctatctcggcgacggcaccgactggggagcgcgtatccgctacctccaggaggagtcgccgctcgggaccgcaggcgcggtccgcaacgccagacacctcctcgaggacaccttcatcgtgctctctggcgacgtcgtgacgaccgtggatctcgaggccgcgcgacgcttccaccacgaacggggcgccagtgcgaccatggtcctcaccaccgtccccgatcccaccgagttcggcgtcgtcgcgaccgaagacagcggagcggtcaccaggctcatcgagaagccgtcgtggggcgaggtcttcacggacacggtgaacaccggcgtctacatcctcgaaccgtccgtcctcgatcgcatccccgccaaccgtgcggtggacttctccgaggaggtgttcccgcagatcctcgacgaccgcggagcgctgtttggctacgtggccgacggctattgggccgacgtcggcaccttctcgggatttcaccagacccaccacgacgtgctcgacgggcgtgccggcatcgctccctcgggcttcgaactggctcccggcgtctacgtcggtgaccgctcgacgatcgacccctcggcactcttggaggcgccgtgcatcgtcggcaacgacgttcgcatcggccccgggtcgaggctcggcccctacaccgtggttggccacggcgtgcgggtggggtccgacgtccatcttgacggcaccatcgtcttcgaccacgcatggatcgccgacggggcacgtctcggccgcgcgatcgtcggccgcggcgtcgacatccgccgccgggtcaacgtacacgatggcgcagtgctcgccgacggcgtcctcgtcggacgcgacgcggtggtgcgagccgacattcgggtgtatccgggcaaaacggtcgatccgctcgccacggtcgccaactccatcgtctgggagagtggcgcgagtcggacggtgttcgggccgctcggcatctccggcctcgccaacgtcgacatcaacccagagatggcgacacggatcgcgatggcgctcgcatcgcagctcccccccaacggcgcagtcctcgcggcacgcgacacctcacgggccgcacgcatcatcaagcgcgcgatgatggtcgggttcaacgccgtcgggctcgacgtctgggacctcgaggcaacgaccaccccggtcctccgtcacgccgtggccgccaccgatgcggtcgccggggtacgagtcgccctcgacgccgacgatccccaagccctgaccatcgagctcctcggggccgaaggcgccgacctcgtcgcgaccgagcgacgcaaggtggagcgcgcgctcgagcgcgaggagtttcgcagggtctccgcgagcgagatcggcgatctcgtcatggtctcccacgcgaccgaccgatggaaggcagcggtgaccgccctgctcgacatcgagcggattcgggagcgcgccttcaagctggtcctcgactactcgtacggcgtcgtggcgtcgagccttccgcaagcgatcgcgtcgttccacgcggacgttctcgccacccacgcctacccctcgaccgcacgcctcatacgacttcgactggaggagcagatcgccgaactcggccgtctggttcgaggcgccaaggccgacctcggtgcgatcgtgaacgccggcggcgaacggctgctgctcaccgatgcgcgcggtcgcgtcgtcccgatcgccggtatcgccaccatcctcgccgagcacctggtcgcgaccgggaaggtccggcggctcgtggcgagcgcggccgtcgcgagttcggtcgccgacaccgctcgcgccctcggcatcgagttcgcatggtgcgggctctcgcgagctgatctcgccgccgccgtcgccgatgcaccaggaacgctcgccatcggccacagcggcctcgtgttctactccggatgcgcgagctcgtcggacgcagccgtcaccctcggactcatcttggaggccctcgccaccaccggaaccgatctcgcccatgtcatcgaccgcacgcccgccgagacgacggtggccgaggcggtacccgtcccgtacgcggtcctcggtgcgacgatgcgggggctgcgcaccttcgccgaggagcaggggccggtcgagctcgtcgcgaccgatggccttcgagcgcagttccaggaccgattctggctcctctcgcccgacccccaagaaccggtcgtgaccgtcatcgtgggtgcggccgaccccgaggtggccaaggacgatctcgcggtcctgcgcaccgctgtcgcggcgcgtcgcgacgaagcaacgcaaggtcgcaagggctcgaattccaacggcagcctgcccccctcgacctccgcgcgcgggtaacctaaggcgtcatggagttccctgacgacctgcgctacaccgcagaccacgaatggcttcgcacgatggacgacgagaccacccaggtcggcgtgaccgactacgcccaagacgcgctcggcgacgtcgtctacgtcggcctgcccgaggtcggacgatccgtgcgcgcaggagaaccgatcgcggaggtcgagtccacgaagtcggtctcggacgtcttcagcccgctcagtggcgacgtcgtcgcggtgaacgaggcgctgcgcgaggcgcctgagctcatcaaccgtgacccctacggcgaaggctggatcgtgacgatccgtcccacggggtcgacggacgagaccgctggcctcatggacgcagcgagctatcgcgacctcgtgcacaaggcgtgagcgaaggggatgtggtgagcgaggggggtgcctcctgtcccgtgtgtggcgcgccactaccggcagggtcacacttctgtccacgatgtggtgccgccatcaccgatgacgatcgaggtgacgtcaccgggacactggcgatcgacgcgatcgagcatctcgccgaggaggcgccgtcgggtccgaccacgacgacgcccgtgctgctgcttcgatcgggcccgcaggccggttcgtggttcgcactcgacagggacgtcgtgacggtgggacgccatcccgattccgatgtgttcctcaacgacgtcaccgtctctcgacgccacgccgaaattcgtcgcgagggtgacgcctacgtcctctacgacgccggatccctgaacgggacctacgtcaatcacgaacggcacgagcgtgcgccactgcatcatggtgccgaaattcagatcggtcgctttcgcttcaccttcttcgtaccggagaccgcgtgaactcctctcaacacctccgcatcgttcccgaacccgaatactcgatcaaggacgtcctcgcgctcttgcaagaggagttcccagaggtcacgatctccaagatccggttcctcgagagccagggcctcatcagtccggaacgcacgccatcgggctaccgacgcttctacgatcacgacatcgcccggctgcgccatgtcctgcggctccagaagtccacctacatgccgctgaagaagatcaaggagcacctcgacgccggcacccaaccgtccgacctcttctccgaggacgccgtcgccggccaaggcaacgccgagacgagcgccgtcacgccgaacgagtcggagcccgaggccggttcgagcgcagaggcatcacgatccgacgcccctggcctcctcgacgagcacgacgccctcgctcgtgcgggtgcgaacgcctcgacgcttcgcgcggccctggatcatgggatgatcgtcggcatcacgaagggccgtgagcgctacctcacgctcgaagaggtcgagatccttgcactgctcgccagcctcgagcgccatgggctcgaaccccgtcacctccgcttcgttcgctcgttcgccgaacgcgaagtcggcctcatcgagcaggtgctcgcaccggtgctctcgatgagccatcgtcaccccgagcgcgcgcgcaccgcgatcgccgagctcgccgagctcctcggtgccctgaccaccgcgctcacgacccgcgacctcgagcggctcgatccgcatgcgcggcgaacactctgagtccagctcgagaccttggcgagcgtccgcgcggcgctgagttcggcgctcgggcccccgcctgaagcacgcgctcactgctcccgacgctcgcctccgtccgcgttcgggtcacgcgccgcgccgtactcctcaccatcgacgacgtcaccgcctcccctccacgcgcggaaggccagggccagcgccgatccgaagacgatctcgccgatgcccacggcgaccccgaaggcgacacggacgagaccggcaagccctgcgaccacgacgccaaccgcgaccatgatgccgattcgacgcatcgcactactcctaccgttaccgttgctactcgcgccgatcagggtcgcgacgtgcggcccttgccacacggtgtcctctgcctccccgatcgcctcagtccgaaaagtcctccggccgtaggtgttcgatgaagtcgcggaactctccgaggagttcgtcctcgtcccccgaggacgtaggctcggcatcgtccaacactgcaccctcggcgtccatcaccgcctcatccacgaagatcgggctcgacgttcggagcgccagtgcgaccgcgtccgacggacgcgccgagatctcgcgctcgatcccgccttgggcgagcaccacggaggcgtagtaggttcccgcccgcagctcggtcacctcggcccggacgacctcagcgtcgagctcttcgatgacgagacgcagcagatcgtgcgtgagcggccgcggcgggtccacctgcgacagggcaaggtgaatcgcgttcgcctcgggaacaccgatgaagatcggcacgacccgatgcgggtcgcgtcgctcctggaggagcaggactggtgcgttggaccgaaggtcgactcgaacgccagcgacttcgacttccaccattgattccatgctaccaagcggccagcatggtcgccgaggcgcggccagcgcgaggcggcaggattacccgagacggttcagcgcggacagaccgaccgcactggccgccgactcgaggtgctgcgtgatccaggcgaagtcgttggccaccatcactacgccgaacacggcgaggacgcccgccgccaccagcgtcacggtccgcaggtgcttgcgcagcgcccgtgtcgcggtcaccgcgcgcgagaacgcgagtccgaacaggagaaacggcacgcccagcccgagcgagtaggccccgagcaacagcgctccctgcaggagctggccctgggtcgccgccacggcgaacaccgacgcaaggatggggccgatgcacggtgtccaaccgaacgcgaacgccatcccggcgaccggcgccgcaaagcgaccgaatcgctcgagcctcggatgccaacgcttctcggcgaacaggatcgggaatcgcccgaggaccgagagcacgaggagtacggccatggcgaggagcacgacgccgctcgcccgctcgagcaacgcatgatgacggacgagggtctgtccgagcgcggaagcggtcaagcccatggcgatgaagaccacggcgaacccgaggacgaactgggcggtgcgccccgccacccgccgggcgaccgccacccctcccgcttcgagctcgcgcgtcggtgccccggagacgaccgagagataggcgggcaccaacggcaggacgcacggtgaggcgaacgacagcacgccaccgccgaacgcgaccacgtagccgactccgagtgccacgtcatgcagtctaccgatcgccggctcgtggtggcggatcgcatatactttgctaaacacaactattttccgggaatcaccgatagcccggtgaggttgtcaacatgcaccgacaatgtgctcgtagccatcatctgaccaaggagcttgatctcagcatgacgcaaggttcgcaccgacaccgctcaggacttgcgatcgccgtcatcgccggcgcacagctcatgatcgtgctcgatctcacgatcgtcaacgtggcgttgccgacgatccaacacgctctccacttctcgccgactggcctctcgtggatcgtgaacgcctatacgttggtcttcggcgggctcctgctcctcggcgggcgctccggcgacctcttcggccgacgtcgcatgttcatggtgggggttgccctcttcgcgatcgcgagcgtgttctccggactggcgacctcgcaggcctggctgatcaccggccgtgccctgcagggcatcggcgccgcgatcgcctcaccgaccgccctcgccctgatctctgcgaccttcaccgaggcacgtgagcgcggacgggccttcgcgatctattccgcggtgtcggcgggtggagcagcgatcgggctgctcgctggcggtctgcttacccaatacgcatcatggcagtgggtcttctacgtcaacgctccgatcgccgcgctcttgctcgttgccgcgccgcgggtgctcgcagagaccgaacgtcaccacggcagcgtggacgtgcctggagccctgacgggtaccggcggcctcgcgctcgtggtctacggcctcatccatgcctccaccacctcttggtccaatgtgacgacgattgcggtcctcgctggcggggtcgttgcgctcggcgcgttcatcgtcatcgaacgtgtccgacgtgagccactcatcgacttccagatcctcgccaagcgtgaacggggcggcgctgtcgcgatgatcctgttcgtcgcggcctcgatgttctccgtcttcttcttcgtgtcccagttcatgcaagacgtcgtcggctactcgccggtgcgaaccggtctcgcgttcttgccgatgacgctcggcatcatgatcacggcccagctcgtgtcccgcaacctgcaccgcgtcggcccgaagccgttcatggtcggtgggagcgtgctcatcgccgtcgccatgggcctgctgtcccagatgcgagcctcgtggggctatctcgacctcctcggcccgctcgtcatcctcgccatcggcgccgggagctccttcgtctctctcttccccaccgcgacccacggcgtcgaaccgcgtcgcgtcggcatggcctcggccctcgtgaccgtcggacagcaggtcggtggcacgctcggcttgtccatcctcgtcaccgtcaccgtggccgcggccaagcggcatgcggcagccctcgctccgcgcctcgccagcggccacctcacaccccaggcactcacgatcctcgccgaggtgcatggctgggcggccggcttcgcggtcgcgacaggattcggcgtgatcgggctgctcatcggtttgatcgtggtcccgcaccttggaccaactgcgaccgaaggagcggcggaagggtcggcggtcgccgcgtaggccggacgcaggcgaacacgccagcgctcttggcacagtcgcatcgcaccctctacgctggagggtgcgatgcctaccgttccagcgttctcgcccatcgggctgctgaccgagtggtcgctcggaccattcgcgatcgtcgtcgtgatcgccgccggcgctctgttcgcgtggtacgtcgatgcggcgatccgcgttcgcgccaagggtcgtagctggccaggtcaccgcatcgtcacgttcggtctcggcctcctctccatcgtctacgcgctggcaggaccgatctccgtgtgggtcatgcgctacttcccggcgcacatcgtccagcacctcgtcctgatgatcgtcgccccgtcgctgctcgcgatggccgcaccggtcacgctggcgctccagacggcacgtggcaccgcccgtcgactcgtcaccggcttcatccactcccgcttcctccacgtcatcacgttccctctcgtcgtcgtcatcgcgtactacatcgtcatgtggtggttctttacgacgagcgcgatcgggttcgccatgacgcacatgtgggtgatggacctgctcaacctactgttcttcgccggaggcgtgctcttttggtggccgctcgtcggcaaggaccccatcgtgcactggcgaatgggctggggtgcgaagctcgtgtcgctcgccttcggcatccccttcgagacgttcctcggcctcaccatcgccggttcacggacctcgctcgctcccatgtacagcctgaccgactggacgaccggcggcgacgtgctgtggggcttgagcgagatgctcacgaccctcgcgatcggcgtcatcatctggaactgggtcgcctccgaggagcgccagacgcgccgtatgtccaggtcccgcgaggcggtgccactctcgagccgccaagacggcctgccgaaggagtactactgggcgcgccaggtcatcgagcgcatgcctgcaggctcacccatgtacgaagaggcgcgctccgtgctcgagcggatcgaccgcgaacgccccccggagacggctcgctgacgactcgcagcggtgtgtgcgctgagcacgccctcgtcgcatcgccggggtctcgccagtctgagccgcagcggccgcgtgatcaggtcggtgcggaaaacgtgaggaacgccgagatccaccagtgttcgaagggcgagaacacgagctgcaagacactcggaaacaggaccgcaacgagcaccacgacggcgagcagccccattcggaagcggagaaagccataccaggctgatgccggcagcacacgctcgaggatggagccaccatcgaggggcgggagtgggatgagattgaacacgccgagcagcagattgacgaggccagcctcgacgaggagctggtcgacgaggctcgatccgatcgaggacgcctgcgcggcggacgccgtctgaatgtcgtgggcgatcactgcatgcgccacgatcccgagcgcgaccgccagcacgaggttggtggcggggccgacgaggccgacgatgagggcgccgttacgaggatggcgcaagcggcgaacgtcgatcggcacaggcttcgcccacccgatcggcggtaagccggcgatgatcaagatcacgggcacgagcacggaaccgaccggatcgaggtggcgcagagggttccagctgagacgaccgctgcgcttggcagtatcgtccccgagggcaagcgccgcccagccgtgcgagagttcgtgcagcacgacggaggggatcagcaccgcgagatagagcagcgatgtcagattgatgacgccacgccacagggcgagccccaccaaggctgcgccgaccacggcgagtagccatcgctcacgagtcatcagcggctcccggcccgagcacgcggatgcgcgcgttggtagacggcatccacgtgaccctccgacaccttggtgtagagctccgtggtggcgagggatgcgtgaccaaggatctcctggaccacgcgcaggtcggccccggcctcgaccatgtggaccgcgagcgaatggcgcaggacgtggggcgagacccgatcgccgagaccgacccgcgacgcacgttgcttcagcaccagccagaccccctggcgcgtgatgggtgcgccccggaggttgacgaagagcatccgatgcttgggagcgagctgcggtcgccatcgaaccacccactgctcgagcgcatcgcgcgcaggggccgagatcgggacgaggcgttcgcgtcctcgcttgcccactacaggtacccatcgaccctgggcgatggtgtcgagcgtgaagccacagagctcgctcacccgaacgcccgatccatagagcacctcgaggatcgcacggtcacgagcgccggcgacatctgcggtcccgacggactcgatgagccgctcgacctcgtcgcgagcgagcgcacgtggcagcgcgaccgccgttccaggcgcatggatcccctccatcggatcgtccgctctcgcaccgacgcgttgggcgtaacggaacagtccccgtagcgcactcgcggcgcgctgaacgccgcgcggggagcgctcccggccggcggcgtccacccaggagcgcaacagagccgggctcgcatcgaggaggcgcgaccctctcgcctccagccaggtcgcgaccgcttcgagatcgctgcgatacgcgatggcggtcaactcggaccgatcggccgcaacgacgaggagggtgaggtactcgtcgacgaccgcctcactcgccgggtccaacgatctcgaactcctccatggccacggtcgcctccctcgcgacctgccgaccgagtccatgggccctcgccatgagcagcgccacgatgctcttcgcatcctcgaggacgcctgaggccaccagtgcgtcgaggtcgtcgagacggagcgccaccagctccatcgcgcgctcctcgaccgattgaggagcccgctcgccccgagagaggcccgtcgctccgaccacccaggttcgctcatcggtgaacccgggcgagttgtagaagctcccgagggcctccaccctcgccgcgaggagcccgcactcctccgcgagctcgcgccgagcggtgtcgagcaccgactcgcccgcgacgtcgcgcttgcctgcggggagctcgagcacatcgcggccgagggccgcacggaactggcgctgcgcgacgacacggccgttcccgccgagtgcgacgacgacgaccgcgcccgggtggcgcacgacggtacgacgctcgctggcgccgccgtccgcctggagccggagctcggtgacctcgaagaagccataggtcgcgcgaaggtcctcgccgacgatctcgatcgtcacgcccgatccttctggtggcggagcgcggcctcgacgagacccgcaaagagtgggtgcggacggttcggccgcgagaggaactccgggtgcgcctgcgtcccgatccagaaaggatggtcggggaactcgacgaactccaccagcctcccgtcggggctccgcccgctcacgaccagaccggcctcttcgagccgatggacgtagcgctggttgacctcgaagcgatggcgatggcgttcgtagaccacctcggccccgtagaggtccgcgacccgcgtcccgggcgtgaggcgcgccgcgtaggtaccgagtcgcatcgtcccgccgaggtcgatcacctcccgctggtcgtccatgagatcgatcactggatagggcgtctccgggtcgaactcgcgcgagtgcgccccgggcaagcccgcgagggagcgggccacatccaccaccatcacctgcagaccgaggcagatcccgagacagggcatccctcgttgcctcgtccaggcagcggtcgcgatcttgccttccacaccccgaggcccaaatccgcccggaatcacgacgccatcgacgtcctcgaggagttcgtcggccatcatcggcgtgacctcctcggcggagacccaccgcacgatcacgcgtgcgtccgaggcaagacccccgtgacgcagcgcctccaccaccgagaggtaggcatccgggtgatcgacgtacttgccgatcacggcgatggcgacgtcgcgcgacggcgcagcggcacgacgcaccaaggctcgccactcgtcgaggtcgggctcaccggccttgaggtgcaagatctccgtcaggtattggtcgaggccctcttcctgcaagagcagcggcacctcatagaggttgtcggtatcgagcgccgcgaccacgccgcgagccggcacgtcgcagaacatcgagatcttctggcgcacgctctcggagagcaccctgtccgagcgggcgacgatcacgtcgggctggatgccacgcgagcgcagctcggtgaccgagtgctgcgtgggcttcgtcttctcttcgccgttgggcccgagatgcgggaccaacgtgacgtgcacgaaggcgacgtcttctcgagggacctcgttgcgcagctgccggagcgcctcgagaaagggcaggatctcgatgtcaccgaccgtgccaccgatctccgtgatcacgacgtccacgtcgtcgccctcgagcgcgcgaatccgcgcacggatctcgtccgtgatgtgcgggatgacctggaccgtcttgcccaagtagtcaccgcgacgttcgcggtcgatgacggtccggtagatcgacccggtcgtcacggacgaggcccgtcgcagcgagacatcgacgaagcgctcgtagtgaccgaggtcgaggtcggtctcggcgccgtcggcggtgacgaacacctcgccatgctcgaacgggttcatcgtgcccgggtcgacgttgatgtagggatcgagcttctgcaacgtgacggcgagcccccgcgccttgagtagacgccccagtgaggcggcggtgatgcctttcccgagcgagctcgctacgccacccgtcacgaacacgtgcttggtcaccctgcctcctcgcgcggccgcctgcggggatcgcccttgagcagtctagagcatcactcccccgtcggcaggagccgacggtcccgactcgctcgatgcagattggagcagtgcccgtgcgtgctcgagggcgacgtcagcgtcggggtggcccgacagcagccgcgcgatctcgcgcacgcgcgcatcgtcgcggaccggttcgacccgcgtcctcgtgcggtcgtcgacgagctccttgtgcaccacgaagtgagtggttgcggctgcggcgatggaggcggtgtgcgtcaccacgatgacttgacgccgcgtcgcgagtcgttggaggcgcgccgccactccgagcgccgcacggccgccgagtccggtgtcgatctcgtcgagcacgatcgattctcgaccctccccgagcagttccgccatcgccagcacgatgcgcgagagctcgccacccgacgctccgcggcccagcggcgtcggctcgaggtcgggtgaggccgcgaaccagaaggccggtaccccttctgccccttcgaggcggatctcgaagcgagctcgctcgagccccagcgctccgagggcctccgtgacgtggcgacgcaggacctctgcggctgcgtctcgttcggcgcgcagcgcgctcgcggcctgctcgaggtggcgctctgcctcgaggcgttctgcctcgagctcttccatcagggcctcgctgccctcgatcagcgcgagcgctcggcgtcgctcctcacgcgcctcgatcacggcctcgagggtgggtccatagcggcgcttgaggtgggacagctgggcaagccgtgcctgggcggcctcgagcgcagccggatcggactcgagacgctcgaactgatcgcgcacctcctcagccacgtcggtcgcctcggcgaggaggctctccaggcgctccgccaaggccgggaacgcacgttgcaccgcgcgtgccgactgaccgaggcgatcggtgatgctgttcgtcccgaccaggtcgcgatggagggagaagagctctgcccgcagcgcatcggcgtctccgagccgatcgacgagctcggtgagctcgttgtcctcttcggggttggcgagctcggcgctctcgagttcggccagctcgaagccgaggcgctcgcgctcacgctcggcgtggtcatgatcgtcacgcgcgcgtcggagtgcggccgtcgcgtcggcgaggcgctccctcgcgcgatgccacgcgcggtcgtcgatgcccccgatgcgatcgaggatcgcacgctgttggtcgggttgggtcacgaacaccgcttggtgctgaccgacgacctggacggctcgcgcgacgaacgaagcgagctcgccaacggcgacgagctcgccatcaatgcgcgcacgggagcggccctcccgggtgacctcgcgctcgacgaccgcttcgtgaccgtcgacgtcgacgatggcgcggacgcgcgcccgctcgtcgctcgcacccacaaggtcgctgcgtgcccgctcgccgaggagaaggccgatcgcacccacgatgagggtcttgcccgcccctgtctctcccgtgagggcgacgagcccgccgggcagctcgagcgaggccgcctccacgacccccaagttgcgcacctcgagcaggctcagcatggcaggtcgagcacctcaaggccgaacttcgccttgagtacctcgtggaagggcggggccccgatctgggcgaggcgcacccgacgcgtcgccgcgtggacctcgaccgcttccccgggcacgagggacgaccacggaacaccatcgaccatgaccgaagccgtcgggccatcgagcagtcggatctcgacgggttcgtcgagtccgaggaccaaggaccgatcgaagagctgatgcggagcgatcggtgtgagcacgagcgcgtcgacgcgtggcgagagcacgggtcctcgcgcggagaacgcataggccgtcgagccggtgggcgtcgcgacgatgatcccatcggcggcgtagcgcagaaaggggcgacgatcgatagcgacgctcgcgcggatgaggtggcccgacgcctgacgctcgacgacgacttcgttgaagccgacggttcgctcgctcctcgaaccgacgcccgcctcgagcacgacccgctcctcgacgacgatcgacccatccacgagggctcggagcgcgggttcgagcgccgacggttcgacctcggcgagatagcccagttgaccgaggttcaccccgagcaccggcacgtcctctcgccacgccgccgccatcgcacgcagcatggtgccgtcacctcccatgctgacgaccgcatcgatcgccccacacgcgtgcgtcgggtcctcgagtatgcaggcactcccaccgagctcgctgagcaacgcccgagcctggcggaagagttcctgcgcacgcggctcctgcgggtggagcacgaacccaacgttcatccggctcagcctaaccaccaccgcttcgttcactcggggcacgcaaccacacgaactcctcgacgttgccctcggctccgggaaccgaactcggacaactcccgaggacaacgagccccatcgaacccatcgcgtcgcggactcgtccgagcgcctcgtcgcgctccggaccgagcgggatcacaccgcggtatcgactcgcgatctggcgccccacctcgaactggggtttgacgagcaccaccgcctctccgcccggcgcgagcagcgacgcaacctggtcgaggacgccgagcaccgagatgaacgacacgtccacgaccgccagcgtcggtgcttcggggaggggccacacgaacgcacggatgtcggtccgctcgtagacctcgacgcgcgggtcatgccggagcgactcggcgagctgtcctcgtccgacgtcgacacacacgacgcactcggcaccgcgctcgagcagcaccatcgtgaacccacctgtcgaggcacccacgtcgaggcagatccgccctgacgggtcgatgtcgaaggtgtcgagcgcaccctcgagcttggccgcgccgcgcggacgccacctcgaggccacgaccgagagcacgtcgctgggcgcaacgaggcgagccgccgacagagccggggcccgattgacgagcacacgcccctctgcgatcagacgcgccgcgtgcgaacgggagcgagcgagcccgccagcgacgagcgctcgatccaatcggacacgcctcaccgctccgagagcctatcgctgaggttctagcatcctcatcgtggcagccatcgatgcgctcgagacgcgcctgctcgagtatctgagcgcgccggctcgctcgtcacccgccctcgcacgggcactacggatctgtgaagatggcgctccgatcgcctacgccgcaaccttcgcctgggtcgcgtggcgcagcgcggatgatccgcccgttcgcagcgccctggtgcggaccacgcttgcgggctcggtcgcggtgctcggcgcaggggtcgtcgcacgcgcgcttccgcgctcacggcccagcctcaccctctgggcatcgcgcaggtcggcgagcgatagtcactcgttcccatccgaccatgccgcgggggcgagcgcgttcgcccttgcctcctctgggctccctcggggtgcgcgacgcgcactcgtcgccctctcggcaacgacgatcgtgagccgggtcctcctcgctcgccattggccgagcgacgtgctcgcggcactcgcgatcggcgccgccgcgtccaccgtcgccggggccctgccctcgccgatggtgaataccctcggcgagatcaccgtccggtggctcggcctgtccgctcgagcacgacggacgcccacagcatcccgaggcaggcgacaagagcaccgaccgcgtcgatgacccacgcgccgtggaagccgaccgcaccgacgagcgccccgaacccgagcggtccgacgacgctgccggcaaacgcgctggcttggacaatggccgtcgcctgtccgggatgttcaggccaccgttcgctcaccgcgaagttcaccagcccgttccagccccaaccgccggcgtagccgagcaggagccctccgagcaacagcgcacgcacaccggtcgcgagcgcggcatagcccaccacgccgacagcgagcaagacggcgaccgcccggatcggccgctgcagacgtcggtcggcgagtgcgcccatgcccaccctcgtggcgaggccggcagcgctgccggctgctgccgcataccccgcgatggcagcctggacgtggtcgtgaacgagcgatgccacgccgaacgcaccgagtgcattcgccgtccctgcaccgagcgccatcgcggcggcgacgatcagtagcgaccgcggggtgacgaagcgcgtccgcgcctcagccccctgagatccgtcgtaggaggcaaaacccttggctccgagcgcgatcgcaacagccaggatgctcgtcgcggcaaaggccgtgcgccagctcgaccggagcgccaccagcggcagtgccagtccagcgagcaaggttgcggtaggaatggccgcctgcttgatcccgaatgcccagccacgcctcccggggcgcacgacgcgcgcgagtacctcgttcacaccgggttgcaagatcccgttcgcggcccctgcgaccacgagtgcggctgcgagcaggatcggaccacgcaccgcgaaggcgatcacggcacttgccaccgcggatgcgccagcgcctgctcgcaccagccggaaggccgccgctcgatgcaagatccgcgccgccagggccgcccccacaatcccggcaacgaagaagctcgcgacgacggctccttcaaggctcggggtgaggtcgatggcgtggcgcagcaccggttcgagaccaccgatgaggaacactggcagcgtcgtcgccgtcgtggccgcgatcgagaacggcaagacgaggcccgttcggggcacaccagaactcatgagacgttcaggatttcctgagtgccccgtgagactcgaaagcatacctatgcacaccgccaccttacccgcaggccacctgcatacctatacctcgacttgcacacgacatccgaccgtgacgtgcgcgtcacgcagacgacgatgattgcgttccatacacgagaggaatagcctacgatacgcaatggccaaagagcagatcgctcctggcctgcctggccgacgccaccgaggctcgccagcatgacacgagtgtgggaggaagtggggaacccatgaagaagatcacagcacgccaccgcctcatcgcgggacttggcaccaccgctgccgcagccatgctgctcgcggcgtgtggctcctcgtcgagctcgacctcgtcctcaagcacgaccaaggtctcgggcggtacggcctacttcgccgaggccgccggcgcaaacccgaactacatcttccccttgaccgggggcccgtacttcagcgtcgacaacctcgcccagttccagatcctgatgtaccgaccgctctacttcttcggggtcggctcgacgccagagatcaactaccagctctccatcggcaacgcgcccgtctactccaacaacgacaccaccgtcacgatcaccctgaagcactacatgtggtcagacggcgagccggtgacctcgcgcgacgtcatcttctggatgaacctgctcaaggcgaacaaggccaactgggccgcctacgtgcctggcgccttccctgacaacgtcgcgtcgtactcggctccgaatgcatcgaccgtcgtcttccacctcaccggcaaggtcaacccgacgtggttcacctacaacgaactgagccagatcacgccgctccccatcgcctgggaccgcacctcgctcagccagccggcacccagcccgtcggccgccaacttgcccgatacgacgacctcgggggccaaggcggtctacaccttcttgaactctcaggccacgaacgccaacgcctgggcctcgagcccgatctggtcggtggtggacggcccgtggaagctgaagagctcgtcgacgaccgggcgcatggtgttcgtgccgaacccgtcctacaccgggccggtcaagccgtcgctgtcggagttcgtggagctgcccttcacctcagacaccgctgagttcaacacgctgcgcgccggcaacggggcgatcacctatggttacgtgccgacggtggacctcagccaggtgccttacctgaagagcatcggctatcgcatcgagccctggatcgacttcggcttcaactacttcgtcgagaacttcaacaacccgacctacggaccgctgttcaagcagacgtacttccgtcaggccttccagcacctcgtcgaccagccgcagtggatctcgaccttcctgaagggctacggcgtaccgagctactcgccggtgccgctcgcgccggcgaatcccttcgcggacgccacctcgaagaccaacccgttcccctactcgatctcggcagcgaagtcgctcctcaccagccacggctggaagatggtgaacggcgtcatgacgtgcgagagcccgggcacggccgccaccgactgcggtgcaggcatcgcgaagggcttcacgctcacgctgaacctgcagtacgcctcgggtaccacgttcatcacccaggagatggacgcgctccagtcggcagcagcgagcgcgggcatcaagatcaacctctcgcaggcacccttcaacacggtcatccacaacgccactcagtgctccggttcgagctgcacctggcagatggagaactggggtggcggctgggagtactccccggacaactacccgaccggcggtgagatcttcggcaccggtgctgggtcgaacttcggcaactggaacgatccgaccaccaactcgctgatcgccgagacccacacctcgtcgaatgcgcaggcggcgctcgatgcctaccaggactacatggccaaggtcctgccggtggtctatcagcccgccgccgattacgccatctccgcgatctcgaacaagctccagggggtcactcaaaacccgtacctgaacttgacgcccgagacgtggtacttcgtcaagtagcgatcctcagggctccgagccccgcttagcgggggctcggagcccattcgcctgacggaccacgcacgatgggggctccgcaatcgaggccgagcaggcccggcgcccccgcgaacgatccgacatggcccgctcctacgatcgatcgccagtactagttccacgaggagtccatgaccggctacatcatccgcaggctcgtccagtctgtcatcgtcgccatcggcgttttgctcatcatgttcatcctgcagagcctcctgcctgatcccgcgcgagccatcctcggggtcaaggcgacgccggtacagatcgcggccttcaacagggccaacgacctcaacaagcccttctacgtgcagttcgcgcactacctcgtcgatgtcgtgtggcatcacaacctcggcaccgcctatcagctcaacgagtccgtcggctccatcatcgctcgcgacgccccgaagtcactcgtgctcgtcggcgttgccctcgccatcgccgtgatcatcgcggtaccgatcggcgtctaccaggcggtccgtcgcaacacggtcggcgaccaggcggtcaccgcggtgtccttcctcctctactcccttcccaccttcttcctcggccagctgctcattctcttcctcgccgaagacttccacctcttccctgccgaggcgccccaaggggtcacgctgggccagatcctgtccgacccgattgcactcgtcctcccgatcgccaacctcgtgctcgtgaactacgccggctactcccgcttcatgcgttcctccgcgatcgaagccctcgcccaggacttcatccgcacagcgcgagccaagggtcttcccgagcgggtcgtcctcttccgccacatgctccgcaacgccctcatcccggtcgtgacgctgatcggcctttcgatcccggcgatcttcacggccggcctcatcaccgaggctctcttcaacttcccagggatcggatcggactacgtccaagcactcgtgagtcaggactatccgctcgcgctcggcatcacgttgctcgtcgcggtgctcaccgtgctcggtaacctggttgccgacattctctatgccgtcctcgatccacgagtccgttatcgctgagcacggacctaggaacggagcccaactcatgtccatcaccgacgacctcaaccccgatctcgaggctgacctcctcgctcccctccccaccgggctcgctggcgcgtcccccgaaggccccgaaggcggtgacgtctcgggtgcaggttccgcgtggcgcctcacgctccgagctttcttcgacaaccgcctttcctatgccggtcttgccatcctcatcgtgctggtactgttctccttcgtcggacccctcgtctatcactccgacctctacacagccacctacaacatcaaccttccgcccggtcccggtcaccccctcggaaccgattcgagcggacgcgacgtcctcgggcgcctcatggtcggtggccaagcctcgctcatcatcggcgtactctcggccgtcatctcgaccgtcatcggggtgatctggggtgcagtctcaggcttcttcggtggcctcatcgacaccttcttgatgcgcattgtcgacgtccttctcgccgtcccgacgatcttcatccttctgtacctcgccagtatcttccggcccacggtcctgctgctgtccatcaccatcgcgatcttgtcctggctcggcgctgccaggctcgtgcgaggggagaccttgagcctgcgctcgcgcgagttcgtgcgcgcggtccaggtcatgggcggctcacgctggcgcatcattcgccgccacatcatcccgaacaccatcagcgtcgtcgtcgtccaagccaccttccaagtcgccaacgccatcctcctgatggccaccctcggcttcttgggtttcgggctcgagcctccggcagccgactgggggtccatgctctcccaaggcgtcaactacatctacgacggttactggtggctgatctggccggccggcatccttattgtgctcgccgtcctctcgttcaacttcatcggcgatgcgctccgagacgccgtcgaggtccgcctccagcgccgctagggcgacctggctactgccgagcacgggacgatcattaccggtgtgtgacgccatcgcgtcccagacgaccatcgccattgcgttgcgatagcctctccctgagtcacgcttgaagcgagtcttcgtgggtcggagctcgagtccgcgccctcggtgcccatgaagtcgccttgtcgcgtcacaatcgcaaggaggtccccgtgcgccacatccggccgtcgcgacggcgtctcctcctccctcttcttgtgggtgcaaccggattcgccctcgctgcgtgtggaacgtccggtgcggccgagccgtcgagcgcctcaccacacggagtcgtgacgttcgcggaacaggtcggggctgctcccaactacatcttcccgttcaccgcgagccagtacttcacggtcgacaacacgtcccagttccagttcctcatgtaccggccgctgtacttcttcggcgtcgccggtcgaccggtcatcaacgctgagctctccctcgcggctcttccggtctactccaacaacgacaccaccgtcacgatcaccctgaagcactacatgtggtcagacggcgagccggtgacctcgcgcgacgtcatcttctggatgaacctgctcaaggcgaacaaggccaactgggccgcctacgtgcctggcgccttccctgacaacgtcgcgtcgtactcggctccgaatgcatcgaccgtcgtcttccacctcaccggcaaggtcaacccgacgtggttcacctacaacgaactgagccagatcacgccgctccccatcgcctgggaccgcacctcgctcagccagccggcacccagcccgtcggccgccaacttgcccgatacgacgacctcgggggccaaggcggtctacaccttcttgaactctcaggccacgaacgccaacgcctgggcctcgagcccgatctggtcggtggtggacggcccgtggaagctgaagagctcgtcgacgaccgggcgcatggtgttcgtgccgaacccgtcctacaccgggccggtcaagccgtcgctgtcggagttcgtggagctgcccttcacctcagacaccgctgagttcaacacgctgcgcgccggcaacggggcgatcacctacggttacgtgccgagcacagccctcagtcaactgggcgtggtgcgctcgatcggctaccgcatcgagccttgggtggagttcggcttcaactacttcgtcgagaacttcaacaacccgacctacggaccactgttcaagcagacctacttccgtcaagccttccagcatctcgtcgaccagccgcagtggatctcgaccttcctgaagggctacggcgtgccgagctactcgccggtgccgctcgcgccagcgaatccgtatgccgacgcagcatcgagacacaacctctacccttattcgatctcggcagcgaagtcgctcctcaccagccacgggtggacgatggtgaacggcgtcatgacgtgcgagcgcccgggcacggccgccaccgactgcggtgcaggcatcgcgaagggcttcacgctcacgctgagcctgcagtacgcctcgggtaccacgtccatcacccaggagatggacgcactccagtcggcagcagccagcgcgggtatcaagatcaacctctcccaggcgccgttcaatacggtgttcgccaacgccgccccgtgctcaggttcgagctgtacctggcagatcgagaactggggcgcgggctgggagtactcgccggacgactacccgaccggtggtgagctctacacaaccggagccggctccaacgtcgagggctggaacgatccgacgacgaacaggctcatcgccgcaactcacacctcgtcgaatccgcaggcagcgctcgatgcctaccagaactacatggcgagggtcctccccgtcgtctaccagcctctcgccgactaccaggtatcggcgatcgcgaacgaccttcacggcgtgagccagaatgccttcttgaacctgacgcccgaggcgtggcgccttggctgagctgggcgacgctgctcgcggacccctctcgccaaggacccgctgagcgcaatcctccagagccccgcgggtggccggatagcctggaggccactgtgacccaaccagaccctacgccagccatgccccgagcccagcgacgtcgagtatcgaagcgacttcggcgccgacgccgcctcgtcatctccctcgccaccgttctcgcgctcatcgtgctgatcggcgcgggcagttacctctacatccgctatcgcttcggccagatcggacacgtgtcggtcggcgggctcacggcgcagagctccggtcccgagaacatcctgctcgtcgggaacaattcacggtgcacgttgacgaagtactcatcgttctactcgaagggctcacagcacttcggcacctgcagcgaggttggtggtggtcgcagtgacgtgacgatggtcctacacgtcgatccagcgacgcaccgcgcctacctgctgtccatcccgcgagatctctggctgcccatgccgaacggcaacggactcgaactccgtgtcgacgatgcgctcaactccgccgagcgcccctatctccacctgcccttcggaccgaccttgctcgtcaagacgatcgagcaagacctcggcattcccatcaaccactacgtggagttgaacttctacaccttcgagcaagtcgtcaacacgctcggcggcgtcacactcgacttcccgaccaagctcgtcgaccactactccggcctcaacatcacgacgacgggctgccagcacctcaccggcacgcaagccctcgcgctcgttcgagcacgacacctgtactactacaacccctccaccgggacctgggactacgacggcacgggtgacctcggacgcatcgtgcgaacccacatcttccttcgagccctggccagtcaggtgaagagctcggcactctcgaacccgatcacggccaacgcgctcctcggctccctgctgccggcgctcaaggtcgacccgtcgttctccctctcggacatggtgagcctcgcgcttgccttccgacacgtcaaccctggctcgatcccgagcgcgacgttgcccgtgatcatcccctcccagagcacgttcaccgaccctgcgaacccgtccaactatcaggcgccgggctccatcgtcatgccgtgggcccagagcgacctatcggtcattcgccagttcctcggctctgaggcccccaacctcaacgccattcgtccagcctccgtcacggtcgcggtacgcgacgcaagtggtgttggcaacggtagccagctcgtcgctggactctcccagcttgggtttccaacgaccaacctcggtaccgcaacctacgccggcaccgactccgagaccgtcgtcgcctacaagcccggcatgctcgcccaaggcgagcgcgtgctcgccagcctgtctggccaggcagtccttgccgagggctcggcaaatcagcccgccgacgtggtcatcaccgctggatcgacgatcgccaccaccgcaacctcggcccagaccgcagccctgacgacaacctcggcaccgaccgccacgctcaccgccacctcgacgaccacaccaccggtgggaacgctcgtgacctcgacgcagagcctccagcaactcgcctcgtcgaacctgtggcaggccaacgcgagtgggtccgagttctggtgggatccacgtctgtgccccgcccacgcctagtctcgcaggggcgcgcctagtctcacagcgagatgcccgagaccccctcactccacatcgtcgaagtcgctccccgcgacgggctccaaaacgaggcgaccccggtcgtcacccgagacaagctcgaactcatcgaggcatgcgtcgccgccggtgtcgaccgtatcgaggtcgcaagcttcgcacatccctccctcgtaccgcagatggccgacgccgaagcggtgatcgagcagctctcagaggctgccctcgcccgcgcgatcgcgctcgtcctgaaccaacgcggtctcgagcgtgcactgcgtacccgcattcgagagatcaacgtggtcgtcgctgcctccgaaggcttcgccagggccaaccagcgcgccacgcgcaccgagctccttgcgacagcacgcaacgtcctcgccgatgctcgcgccgccgatctgcgtcgttccctcaccatctccgtcgcgttcggatgtcccttcgatggggaggtcgatccccacgaggtcgtacgcatcgtcgagacgattcgagaggccgacccagcgtgcgagatcgccctcggtgacacgatcggcgccgccgcgccgggagacgttgctcgaatgctcgagctgctcgcggacctcgtcgcaccgaacgagctgcgcctgcatttccacaacacccgcaacgctgggatcgccaacgcctgggaggccatgcgcctcggagtccggaccttcgatgcctccatgggaggcatcggcggttgccccttcgcgccacgcgcaaccgggaacatcgccaccgaggacctcgtgtggatggcgacgcgctctggctaccgaaccaacgtcgacctggagcgcgccatcaccatcgccccgctgacgacgcgcctgctcggccacgaggttgcgtcgatggtggcccgagccggcacattccccgccggcacctcctcgcagccgaacccgtccctctagcgcggcgctgctgcctcgcgaggtcgcaccgacagggggaagtggcacgccgcgtggtggacgcctccgaagtcgcgcatcgggggctcctcggtgcggcagatgtcctgcgcataggcgcagcgcgtgtggaaccgacacccaggtggaggggtcatcgccgacgggagttccccacgcaccagcgagcgctccttcgtacgctcgacctccggatccggctcgggaacggcctcgagcagcatgtgcgtataagggtgcttcgcgctctcgaagatgtcgtcgcccgagccaacctcgaccagcttgccgagatacatcacgccgatccgatcagccagatagcgcaccaccgacaggtcgtgcgagatcacgatgtaggtcaggttgtgctgagcctgcagatccttcatcaggttcagcacctgcgatcggatcgacacgtcgagcgctgacaccggctcgtccgcgacgatcagtcgcggcgacaacgcgagcgcccgcgcaaggccgatgcgctggcgctggcctccggagaactcatggggatagcgctccatggccgcaggggccagaccgacctcctggagcaggctcgcgatccgctcaacacgctcggccttggtgccgatcttgtggatgtcgaggggttcttcgaggatctccttgacgcgcatccgcggatcgagcgatgcgaagggatcttggaacatgagctgcagctcgcgccgcacctcgcgtacgtaaccacgctcgttgacgatggagcggcctgcgaaccggatgtcgcccgccgcgggctgctcgagccccacgaccatctgaccggtcgtggacttcccacacccggactcgccgacgagcccaaaggtctctccttcgtagacggtgaacgacacgtcgctcaccgccttcaccgtgccgatcttgcgctgcaccaccgcgcccttggtgacggggtactccttcgacacgtggtcgaactcgagcagcaccggccggtccgtgacggtgcgctgtccggtgcgacgctccaggctgatcgggacacgctccggtgctccaaccggatagaagcaggcaaacggatggagatagccctccggggtcgtgtacggcggcttctcgacgcggcagcgctcctgtgcgtagtgacaccgcggcgcgaaacggcatcccacgagatcgcccgtgaggtcgggcgggattcccgggatcgagtacaggcgctcgggtgcatcgcccgtcagcggtggaatggatgcgaggagcgcctcggtgtagggatggtaggtggaggcgaacagctcggcggcgtcagcatgctcgacgatctctccggcgtacatgacgatgacgtcgtcggcgcgacctgcgatcacgcccatgtcgtgcgtgataaggagcatcgccatgccgagcttcgccttgaggtcctcgagcagttcgaggatctgggcctggatggtgacgtccaaggcggtcgtcggctcgtcgaggatcacgagcttcggatcacagctcagcgcgatggcgatcatcaccctctggcgcagtccgcccgacagctggtgagggtaggattcgagccgctcgcgcggattgggcataccgacgagcgagaggacctcgagcgctcgctcgatggccttgtccttcgagtagccaaggtgccgacgaacgacgtcagtgatctggtcaccgatggtcatgcaggggttcaacgacgtcatcgggtcctggaacacgaccccgatcttgccgccccgcacgtcctggagctccctccgcgacagcccggcgaggttgacgccgtcgaagaggatctcgcccccggcgatgtagcctccctggggcagcaagccgaggatcgacatccccatcatcgtcttgcccgacccggactcgccaacgatgccgagcgtcttgccctgctcgagcgagaagctcacaccatcgaccgcacgcacctcgcccttgcggagcctgatgcgcgtcctcaggtcacgaacctcgaggagtgccatcgcgttcctccatgctccccacgccacctacacggtggctgcatagagcgccatgctacccgcgtcggcgcgggtccggtggcgcagcagcccgtgaatcgaggtgctagcatttcagctccgcggggtgtccccgcagagcttgtcggagtggcggaataggtagacgcgctaggttgagggcctagtgaccgcaaggtcgtgggggttcaagtcccccctccgacaccaagtcccccaccgacgcagctgagatctcgcgccggtcgatcgtgcaacgcgtggcgccctcgcacggaccaaggtgggcctcgatgcccagcacctgacgagacccagcgaaacgccaggtcaccacccctgagcggctccaggaccgccacgagttgctcgacgctcgcctagctcgcacgcggcgagcccttctctcggcgtcgctcgactcttgtccgcatggaggctcgccaccgaaggtgggccatcgctctcacccgacgtcgagcgcgcctctccagacaatcgccgaggtctcggcaaccctggagcgcctggacatcgagccctcgaccgctcgccgcatgcgctatctcgacacctccgcgcgtctccgccagctcggggcgcgggccgcccttcggatacccagccgctcggcgcgaagtgcccccacggaaggggaccttggtaccagactgaggcccgtctcgccgagtacggttggccacggaggtggagacatgctgctctcaacccacgccgcgcaggtggtcgccgagactcgacccacgccgaggctcgtgctctgggagacgactcaggcgtgtccgttggcctgcgtgcactgtcgcgccaacgccatcagcacgcccgatcccgacgagctcacgaccgccgaggggttcgccctcatcgacgatctcgcagctgttgccggcccacgtccggtcatcgtcttcaccggcggcgatcccctgagccgacccgatctcctcgacctgatcgcccacgccgcagctcgaggtctccacgtcgccgtctcgcccgccgtgagcgagcgcatcacgcctgccacgctgaccgcactctacgacgccggggcgcgcgcgatctcgatctccctcgacggactcggcaggaaccacgacgcaactcgccgcgttcccggtcacgcgctgcgcaccctcgaagcgctcaccatggcacgctcggtcggtcttcgtgtgcaggtcaataccacggtcatgcgcaccaccgtcaatgacctccccgcggtcgccgaggccatgctcgcgcgcaacatcacaacctgggaggtcttcttcctcgtgccgaccggccgcgcgagcaccgagctcgccctcaccgcccacgagcacgaggacgtcgcgcgcttcctctacgaaaccaccggctacggcttcatcgtccgcacggtcgaaggaccgttctaccgccgtgtcgccgacgccattgcaaccagcaacgacgcagccctcgcccccatcggcgagctcggcgagcggctgatcgccgagctccatcgccgcctcggcgatcctggccctcgtcgccgtccgtcaccgcacccggtgcgcgacggtgatggcgtcatcttcgtctcacgtaccggcgaggtctacgcctcaggctttctccccgttcgactcggatccgtccgcgagcgcagcctcctcgacatctacgcctcggacccgttgctcgacgccatccgccaggccgcactccccggccgctgtggccagtgcgactgggccaaggcctgcggcggctcccgtgctcgcgcctgggcgatcaccggcgatccgctcgccgacgaccccgcgtgcgcgctcgtgagcgcctgaggccccgaggcaggtcggtaccagtccggagccagcggctcgcgactgcccgtgggctcgcgcacgcctcagtcgacccgcaggccgccgctcggcgcgtcacaaaaccgatcgtgcacccagggcgagcgcagctctcaccggccccaccaccgaacagaactgcagcttccggctcgggctacgcggactgcgtggatccctcaagtccgcgctctcgccgccacgccgccgcgacggctgcgatggcctcgagcgcgtcgtagtgctggactgcgtcggcagtcgcgaccgcgccgagcggctccccgaggaacagacggcgcaccggcacctccagcttcttgccgttcaacgtcttcgggatcgccggcacagggacgatgcgatcgggcacgtgtcggggcgacagctcccgccgcagcgtggcacgcagccgatcgtcgagtccgtcgacgtctccggcgtgcacgaacacgatcagttccccgggtgtgtcgagcgatgaggtgtcgacgacgagcgcctcgacgacaccgtcgacaccttccgcgacgcgatagaactccgccgtccccatgcggaccccgccccggttcagcgtcgcgtcggagcgaccatggataatggccgaccgatcgtcgaagaaggtcacccagtcaccgtggcgccagatccccgggtagcgatcgaagtaggccgcacgcagccgctcgccgtcgtcgtcgccccagaacgcaaccggcatcgagggcaagggctggcgaatgacgagttcgcccatgaccccgatcacctcacgtccctcgtcgtcgaaggccgccgcatccaccccgagcgcgggtgcgctgatacgtccttcgagcgtcgggctcaccggcgacgaaccgaggaacgcggtgcacacgtccgtgccccccgatcccgacacgagctgcacgttccccggcacgtgctcgtagacccaacgaaaccccgcagcggtgagtggtgcgccggtcgaggccacgacccgcaaggagtcgagcgtggcttcgtcgcgaggtcgaacaccggcgacctcgcaagcacgcagatagggcgccgacacaccgaagtacgtgatgcggacctcgtcgacgagccgccagagacggccaggatccggatgctgcggagccccgtcgtaaaggacgatcgtgctccccacgagcagaccgcccatgaggtagttccacatcatccacccggtcgtcgtgaaccagaagaaccgagaaccctcgccgatgccggagttcaacgcgagcaccttcttgtgctcgaggacgatgccaccgtgggcctgcacgatcgccttcgggataccggtcgtgccggacgagtagaggatccacagagggtcgttgaagccaacgacgaccggggcgacggggtcattggcttcgagcgcatcgaaggccacgaccggcacctctgtcgctggtggctccccgtcgcagagcacgacggtggtcaccgacggcagcgactcgagcacctcctcgacgacggcccgtcgatcgagctggcgtccctgccacagtgacgacgtcacgcagacgaggatcgtcggttcgacctgacggaaccgatccacgatcgcccgcgggccaaagtccggagagcagcatgtccagaccgcacccaccgtggctgtggcgtgcagggcgatcgccgcctccagtcggttcggcaggatcgccgcgacgcgatcgcccaccccgacaccgtgagcgacgagccagcttgcgacgcgatcgacctcggcccagaacgaggaggctcgaagcgtccgtacctcgccgtcatcgcgaacctcgacgatctcggcagggtcgacgaagcgagcacgcgcctccgcgctgtagttgagccgtccctccggaaagaatcgtgcgctcggcatggcaccaaccagatcgaccgagccaagatcaccctcgagaccgcacacggcggcgacgtcgcgccagaacgccccgagatcggccaggctggccgtgtgcagagcgccgtaggtcgcaagcggcgatccgtggcgagcctccaggcgtgcccgcacggcaccgatcggaccatcccatgcgtcggccggcggcgaccacagcactcgtgcctcatcggccatcgcctacctccccggcctcctcgagggccgccgccgcccgctcgagcgctcgttgcgctctggccagcgctcgttgtcgagcccgttcctccgcagggtcctcgacgtcgagcaagcgcgcgacgaccagctcgtccaagcggtcggcgacggcgcgcagcgcctcgagcacctccccgacaccctcgtccacgtctccctcccgatcgctcgcagactaggtgacgacgatgagctgcccctcggtgaaacgctggcggagcaccttcttgtcgaacttgccgaccgaggtcttcggaatctcgtccacgaacgcgaaccgttccggcagccaccacttcgcaactcggctcgcgaggaacgctcgcagctcgtcggtcgtcaccgtcgcgccctcgcgcagcaccacgagcgcgagcgggcgctccacccacttctcgtcggggatgccgataacggcggcctcggcgacggcaggatgcgccatgagctggttctcgagctcgatggagctgatccactccccgcccgacttgatgacgtccttggtgcgatcggagatgcgcaggtagccctcggggtcgatggttcccatgtcccccgtgcgcagccatccgtcgtggaagcgctccgcatcgtcgaggtgatagtaaccagccgtgatccacgggccacgcacctcgatctcgccgagcgcgaccccgtcacgcgggagagcggtaccgtcctcgccgaccacacgaagttccacgccgggcacgggtttgcccgcggtcgcgaagtagtccgccaagcgatcgcggggcgtccccgcgggcggcaaggcgagcgtgcagatcggcgaggtctcggtcataccccatccagagatgagcgccacgccgtaacgctccaggtaggcctcgatgagcgcccgcggcgtcgcggatcctccagaggtgatcgatcgaaagctcgacagatctgccggatggtcctcgaggtagcgcaacaactcgttccagatcgtgggcacgccggaggccatcgtcgggcggaaccgctcgatcatctcgacgagcggcgcgggctggaggaagcgcgtcggcatgaccatgtccgcgccactgacccagcacgtgtagggtgcgccccacgccgccgcgtggaacatcggcacgatgatgatcgcggtgtccgcggccgggtggaggaggtccatggcgcgccgtccgtagagcggtcgtgacatctccgcatggaggtagatggaccggtgcgagtagacgacgcccttcggattgccggtggtgcccgaggtgtagcacatcatcgcggcggcggtctcgtcgagctccggccacggatagggatcgggcggctgggcctcgagcaacgcctcgtagtcgtggacggcgaggtcggggcgagcccgcttgatggcctcgagcacccccggatcgagcacaggtccgacgatcacgagatggcgaacgctggtggcctccgggagcaccgcctggagcatgccgagcacgaggttgtccgcgatgatcacgaggtcctcggcgtcggccaccacgaagcgcagctgatcggggaagagacgcaggttgagcgtgtggacgacggcccccatggacgggaccgcgaagtaggcctcgaggtgcgggtgatggttgaacgagaacgtcgcgacacgatcgccgacacccaccccgagaccggcgagggcgtgcgcgagacggtgcgtacgggccgcgacctcgccgaacgtgaacgatgccacccagccagggccgaggtaggtgtggacgtgcgcatcagggaactcggtcgcgccgtactcgaacatctgacgtacgccgagcgtcccatgctgcatggtcgagttcaccagcacctcctttgtcaccgaccatgctgccacaacccctcgaccatcgccacgcaacgcagggaccttcgtcccttggcgccgcgaacacgctcgctagactcccacgcgatggatcgagtggtggtggtcggcgccgggatcgccggcatgacgatcgccgtcgagcttgcgcgccgtggcgctcgggtccaggtgatcgccgatccctcgcgatcgccgacgacgcccgtcgcagcgggcatgctcgccccggccgccgagaccgacttcggcgaggacctgctcgtacggctcgagcaggacgcgcgcaccgcgtgggaagctcttgccgcaacgttggagcgcaacggcgacaccgacgtgctcttcgaggtccgtgggtccctggtcgcggcccagaccccaggtgacctcgatcaccttcggcgcatggtcgatctccagcgtcgcttcggcatgaccgcatccctcctcggcgcgcgtgacttggtcgacctcgagcctgcgctctcgagccacctcgctgggggcgcgctgctccccgacgacgcccaagtcgacaaccgccgagcgctcgcggcctacgacacctgggcagccaagctcggtatcgagcgcatcgaagccgcggttcgtgcggtgcatcccgacgccgtcgagcttgccgacacctcacgcctccaagccgacacggtcgtcgttgcagccggatcgtggctccgcgacctcgtcgaggtcgcactccagccggttcgcggcgtcaccattcggggcacgctccccgttggcctcgccccccgtcactgtctccgaggagagctccgcggccgcagggtttacatcgtcccacgcgcgtcacacgagatcgtcatcggggccacatcggacgaagcgcccctcaccgaccgcgacccccgagctcgcgatctgctcgatctcctcgacgacgcgcgcacgctcgcaccggccatgggcgagctcgcggtcaccgacgtgtcggtcggctttcgccccgcgacgcccgacaacctcccgatcgtggggcgcggagacgacggcgtctgggtccacggcggccactaccgtcacggcatcctcctcgcgccgttcacggcgactctgcttgcggacgccatcgtcggcgatggtgtcgatccgaggctcgcagccctctccccgactcggctcaggtcgcgcgcatgaccaccctcgtcatcaacggttccactcgaacggtcgaggcgaccaccctcgcagaactcgctcgcgagctcgagctcccgagccgtggcgtcgccatcgcacgcaacgaggagatcgcgccgcgcagcacctgggatgcggtcgcccttcgtgacggcgaccgcatcgaactcgtcaccgccgtacaaggaggagcgtcgtgacggtcaccatcggacggctcacgctcgcctcgcccctcatcctcggcaccggtggcgcacgtcgcctcgacgatatcgaggccgcagtcgtcgcatcaggcgccagcgtggccaccgtcgcgatccgccgctaccagccgggggcgagctcggtctacgacgtgctcgcccgccatcacgtcaccccactccccaacaccgccggggcgcactcggcgcacgaggccatcgtgctcgccgagctcgcacgcgaagccctgggtgtcgactgggtcaagctcgaagtcgtgatcgacgaccggaccttgctccccgacccgttggagctggtacgagccacggaggcgctgagcacgcggggcttcgacgtgctggcctacacgaacgacgacccggccacggcacgactcgtcgaacgcgccggcgcggtcgcggtcatgccgctcgcgagtccgatcggatccggtcttggcatccagaaccctcgcaacctcgaggccatcgtggccgacgctggtgtccccgtcgtcgtcgacgccggcatcggggctccctccgacgccgcgctcgcgctcgagctgggcgccgatgctgtcctcgtagcctcggcgatcatgcgcgccgaggaccctgcggtgatggcacgagccatcgcgctcgcagtcgaagcgggcgcactcgccaggcgggccggacgcataccggctcaacccctcgcggtcgcgtcctcgcccgtcgagggcctgcccaacgtctcgctctagagcgcgtcggccacgttcgcacaaaggagaccgtgatgacccctacccccgccgtggcactcaccatcgctggctccgactctggcggcggagccgggatccaagccgacctcgtgacctttgccgcgttcgaggtccacgggacgagcgccattaccgccgtcaccgcacagaacaccgtcggcgtctccgcggtcgtcaccatcgaccccgacgtcatcgaggcgcaagtccgatccgtgaccgacgacttcatggtgcgtgcaacgaagaccggcatgctcgccaccgcgccgatcgtcgagcgcgtcgccgcgctcgctgcctccggtatcctcggtcctctcgtcgtcgaccccgtgatggtctcgacgaccggcgcgaccctgctcgatgctgacgccgtgcaggctgtgcgtgacgccctcctcccgagtgccgcgctcgtcacacccaaccgtgccgaagcggaactgctcacgggcatagccatcacgagcatcgaggcccagcgtgctgctgcgcagcggctggtcgaactcggcgctcgcgccgcgctcgtcaagggcggccacctcgacggacccgatgcgatcgacatcttgttcgacggccgcaacgtcgtggaactgcgcgcaccacgagtatggacgcgcaacgaccacggcaccggctgcacgctctcggctgcgatctgcgcgtgcctcgcgcgcgggctcacgctcccccgcgccgtcgaggaggcgaaggcctacgtgactcgcggtctcgccgacggcgccgactggggcctcggaactggacgcgggcctttcagccatttcgccaagggccgcccagcggtcgtggcctgagaccactcacccgtaccactcacgccacggagctcgcaatcgactacgataacggagcattgctgccgctcaccgtgagaggtcgcgctcagtcatcaggagcgtccatggaacccaacgtcgccacctctggggcaccgcacgagcggaccgcaaccgcggtggtgcgtcggagcatcgccggcccgcctgatcgcgaactcgttgcggcgctggcggcgctcgcagacgcgatcgaggccatcgactcttccaccaacccggcgctcgtcgacgccgcgacccgcatcggtgctcgcctcgactacctcggtcatcggccgagcaccctcgtggccctcctcgccgcactggcggagagccttggtcgtcacaccacggccgacaccgcggtgatgcgagccctcgcgatcgcgacggatgccctcttcgcacgccgggagcgcgaactcgttcgtctctccatgctcgcaacccgcgatcccctgacggggctcccgaatcgtcgagcgttcgcagacgccctccagcgatcgtgggcacgcgcgaagcgtacgggtgagcgcgtcaccgtcatcgccctcgacctcgacgacttcaagcacgtcaacgacacgtacggacaccgccgtggggatgaggtcatggccgagttggcccaccgcctcgccaaggccgtccgcgccaccgacgtggtcgctcgcaccggcggggacgagttcggcctcgtcctcgaccccacgggtgaggaggccgcggtcgaaccggtgctggcacgcctcgagcgcgagctccagcgcccactcgcaaccctcgacggtggccgtctcctcgcctcggcgggcatcgcctcgagcgatgctctcaccatggaggccgatgcgctcctcgacgctgccgaccaggccctctacgtcgccaagcatgctcgcccggtcgagaacgaggtgctgcgcatctcctactggcaacgaacgggcacacccacgacagggcacaggctcgcccccccacacccctccgaaggcatctcggtcgtgtatcaacccatcatcgatctcgccacagggcggaccgttcgcgccgaagcgctcgcccggaccgacgcctcgtcggccgtgcactccgtggagtcgctgctccaggccgcgacgcgagccgagcacgcacgcttgcatcgccacatcgtggcactcgtcctcggtgacctcgccgccctgggacccgatgcacgggtcagcgtcaacgtggacgcgggcgtcctcgacgatcaggtgctcacgaccacgctgctccacggactcgaccagctcgcacctgggcaactgcgcatcgagatcaccgagcgcgacatcttgctcactgctcatggagacgtcgttcggcgcctccgcgagcacggtgcgaccatctcgctcgacgacttcgggaccggctttgcgagtctgtcgcgcctgctcaccatccccgtggacgagatcaagctcgaccgcagcgtcgccgctgatcggcagatgggatcggtggcgagcgccgtgctcgcgatcgcggtggcactcggacgcgctctcgacatcgacctcgtcgtcgagggtgccgacagcatcgagcgtgccgcgcagttccgcgcgatcggcgtgccgctcgcgcagggattcgcgatcggcgagccgaccgcgtcgctccgccaggcactcgacaccaccatcgatctcgacacgctcgatcgatccctcgtctcgcgggacgtcgccgatgcgcgggcgagcatgtgggagcaggcgatcgcatgcttgctcaccgccgagcccgatggcgacctcaccacctgtgtcatcgccgccgacctcgacgagcccagacggcgagcacacctggagcaccaccgcatcatcgcagagatcctgggccgcgcgggcgtcatcgacctgcgccgcggtgccgaacgcgtcccatcgccatcgtcagcgcggcgaggaccctcgtagcaccctaggagtgtgcgcgaggacggctgacgctctcgccgaccgtcgccgcccggttccgcagcgcctcagctcgtggtgggggtcgcgcgccgagcgagcgcgacggtcctcggagccacgaacccgatcacagcctcaccagcctcgctgaccgcaagcagcgcccgtgcaagatcggagcgcacctcgaccgtctcggttgcgacgacgtctgccaccacgcgcgaggcccccacccacgcttcgtcaaggtcggcgcgaagccgcgccggcgcctcgaggtcggcgaccaagcgctcgagctctgcgcgaaacaccgaggcggccgacgtgagtgcatcgcgattgggcaccaccatctctgcgacacgagccccatcgctccgcgctacgcgggttgcgtcccggagcgaccccgaaccgagccaccaggctgctgggtgtccgctgtcagcgaccagcacgcgacccatcgcagcggcgaggaggtggggcagatgagacaccacggccagcgtctcgtcgtgcgccgtggcatcgagtgcgaccaccgcacccgcgcccgcgtcgccgaagacgaactcgagcgcggtcgcgacatcgtcgtcggactcgctcccatgaaggacgaaggcccacgacgcaccgtcccagatcgatggatccgccgatgcggcgccatggccctctcgtccggccatgggatggacgctgagatggcgtaggccagccggtgcagcgtcgacgacggggcgcttcaccgaggcgacgtcgagcaccagacctcgcgccccccgctctccgagcgcgcagagcacatccccgaccaccggtgtcggcgtcgcgacgaccacgatctcggctgccgagacggcgtcccagccgaccgtcgccgaggtgcgttcgcgaacccaagcgaccgcctcgggatcctcgtcgatcaccgcgagtgggccacggcgaccgagccggagggcgagggaggcaccgatgtggccgagccccacgatcccaacgctcggacgcccgaactcagccatcgtgcgcgagaccatcggacggcggtgtcggcctcggcacgacgacctctggtccctgccagcggggataggaaccgagcagccgcacacgatggccgagccgggccagttcgccaagcgcatgctcgagcccagggtcagccgcatgaccccgtgtcccgatcaggaagtagtgctcgtcgccaagcccgaggggtcgcgagacgatcgaggtcagattcacgcccgctgcggcgagcacgctcgtgatctcggcgagcacaccgacgacatcggcgcgtggcacgacgacgagacgcgagcgatcgtcgccagtgggcgccgggagttcgtggccgatcagcacgtaacgggtgcgaacctccggaatgctcgtcacggagtcctcgagcgcgatcagctcagcctggtagccaacctccggcggggccagcgcaacaagcccaggacctgcgagcgcgacctcctgacaggcgtgacgcgtcgagagcgcctcgcgcacctccgccccggtcgcagcgatccacccagccgccaacgcaaggatggcaggatgggagatgacgacgtgggccgacgcccccgcgtcagcaccgaaggcccagatgggctcggccagcaccgcctcgccgaccacgagcacgcgtgcatcgacgagccgatcgagggtcgcggcgagttcgccctcgaggacggtctcgaccggtacgacgccaagcagtcccggggtcgcctcgacggtcgagacgacctcgtcgagcgagatcatcgggagagggtcggcgtccgcgagtccgaagagcccgagcgaacgatggctcgagctcccgagcggctcggcaaacgccaccatgcggcctgggcccatccaacctccttggttggttcagcctacctggcaccacggcgccaccttggttaggcgaccgcttcgtcctggggggcaccatggcgccgcacgagcgcgagcagtccttcgaccagttcggcgacgagcgccgacgcggtcggatcgaccaagcgccccgacgcatcgaagcgccgttcggcctcgttgatgaagacctccgggcgcgcgagcacgaccgagttggttccgtggaggacctgacgcaggtgcgcctgcgcgcgaaccgtgccgaagaggcctggagcgacaccgaggacggcaaccggctttccgatcagcgcaccccgaccgaacgggcgcgacaaccagtcgatcgcattcttgatcaccggcgtgtaggagtggttgtactcgggggtcgcgatgatgactccatcagcctctccgaccgcggcgcgaagccgtgccgcgctggcgggcaggtcacgttcgagttcctcggcgtagaacggcacctgatcgagacgatcgaacacctcgtaggccacgccctccggcaacacgtcacggatggattcgagggccctggtgttccacgatccccgacgaaagcttcccgacaacccaacgagctgcatcactgcctcccctcatatggtggtcgccgccgatcgagcacgcctgcaccggcgctctcagcacgagctcaccgcgattgcttgcacgtgcaatcagtctagccgcagatgctcgctacgctctccccatggcacgcaccgtccgcctcgagggatccgtcgctgaagtcgtccgaacctgcctggtctacttcgtcgcgaccgcgccgagcgaccctcgcggccacgtgaactgctcgccgcgagcgaacgacggcacgttgatcctcgacggccccgatcggcttcgcatcgtcgacctcgtcggttccggggcggagacgatcgcacacctgcgcgacaacggccgcatcacggtgatgatcgcctcgttcgacaagcgacccctcgtcgtccgcatctacgggcgggggcgggcccgctcaccgctcgacttccccgagctcgcctccacgctggtcggcgtgcgtgctgtgctcgacatcgcgatcgaggaggtgcggacctcctgcggctacggcgtgccgatcgccgaggggctgcggccccgcccgcaacttggcacctggctcgaagcgaagggtcccgagggcctcgccgactacgtcgcccgccacaatcgctggagcctcgacggcctcgcgagcatcgacggcacctggccgagtgaggcaccgagctcgtagcccccgagcaagccgctcgcccgcgcagccatcaccgtcgctcgatcgagcatccacccagacccatgacccggaccatcgagcgcgaccagcccgttcaaccaggctccgaccccagctgccagtgaaggccggtgcgcgagcaccctggcaccagccgcgaccgcccgatctgcgagccgaggattccagagggcagctcgatggaggagtgctgcgccagcgaggaacggcgccatctgggcctcggcccaacgaccgtaggccggtcctcctcccagcggtccccttgcaccgagagccgcggctgcctgggccccagaagcgagcgccgcccagatcccttcgccttggagtgggttcacgaaacccgcggcgtcacccaccaagagcacacgaccgcgccacggcgccaccccgatcccacccatccgcaaccagccaccgagcacaggagcgtcggccacatcgacgagtccgatccgaccgaggtagtcatcgagcaaggggcgcagccctcgcaggcgtgctcgctctcccccaaccgcgatgcccacgcctacgttcgcgatgccatcggcacctcgaaaggcccatccgtagctcgcgaacccactcgcctgcgcaagcaggtcgactcggtcggcatcgagcgtcgacgacgcaacgtagcgacgcagtgcaaagccccacagcgcccgtgtcggtgacgccgcccccaccgaccgcgcgactgtcgacagcgccccgtcggcaccgacgacggcgtcggcgtcgagcacgccgtcgtcgaggtggacccgcacaccgtcagctccttggacgagaccacgaacccggccgacgatggcacgggcccctgccgcgacggccgcgtcccgcagccatgcatcgaagagccgcctcgtcaccatccgaccctcgccggggtgcgcgagacctggggatgccggcaagtgcaggcgcgcaccctcgacccagacgtccaggtcgccgatccggggccactcgggctctggcgtgagccctacggcggccaaggtcgcgagcgcctgaggaccgaccacgtcaccacatgccttgtcacgagggaaggtgctgcgatccacgagcgtcacacgccagccggcgagcgcgagctgtcgcgcggcgatcgaccccgcaggaccggcaccgacgacgacgcacgacgggagaggactcatgggtccaggctacgagggccccctacgagaacgacacttggagcagtcgaacctggaggcgagccccaccgggaccgggcgtgggatctttgatcccgacctcccagtaggacccatcggacccggccttcgacgcgatgatcgtggtcgccgtcgacgacgcgctcgccgactcgacgtgccatccctcgtcgggcagtgccgcgacgaagaagttgcgaatctcggatggcgtcaacgccgaacgcaaccagacccacgcgtcgaactcggtcccgtagggattggcattatgacggcccgtgatcgttgcgtcggcggggatcaagatggtgcgctcgatgttggcggggatcacgttgccaggatcgagcccttgccacgccccgagtgacgtcgtcgctgagtatggaatcggcgaggaggcctcctctccgccaccagacggaatcgccgcgagcgagccgatcgccgcgacgaggatcgcagcgataccgacgccccagccgagaaccttcttcgaacgaggtgcgagcgccatggtgttaccagtctcgcacgagcgcgcgccgaagcggtagttcgagggcgccgacacagtaacctgatctgtcgcggcggcgtggccgagaggtgaggcagaggcctgcaaagccttgtacagcggttcgagtccgctcgccgcctccacaatcgggcgtggggcagatcgcggcacgcatgtcggatcatacgcgatcgccatggtcgccccacgctccacgaggcgtcgcaggtgcgagaggacgcattggtcacgctctctccggtcggacctgcggcccgcgtcaccggtcgccatcgatccgcgcgagtccgacgcacgatgacaacgccagcgccgcaacgtggctcaccgacgaccgaccacgacgtgtcagggcaaacgccccgccacgcccacgaccttcgtccatcgttgcgacgcaaccacgctgtacacttgagtgggtgatcgagatcgcgtcgacaatgagcgatcccgacgcctcgtgaaggaggtcgacgtgcaggatcgcatcttccaggttcggggcatgacgtgcgaccactgcgtacgcgccgtgcgaagcgaagtcgctggcgtcgccggcgtcgtcgacgtcgacgtcgatcttgccaccggcatcctccgcgtccgaagtgacgcgcccatcgacccagatgccgtactcgcggcggtcagggaggctggctacgacggtgtcgccacagactgacgccccttccgggcctcacgaggaggtcgctctgcgggtcagcggtatgacctgcacctcatgcgcgctgcgcatcgagcgctcgctcgacaaactgcccaccgtcgacgcggacgtgaacttcgcaaccggcaaggccgaggtccgcttcgatcccgccgtcgtcgatctcgccgaaatccttcgtgccgtgcgtcgcagcggctacgacgccaccgtcgccctctcgagcgacgcctcgcctcgcttccactggtgggcgatcgccctcgcggcgctcgtggcagccggagccatggtcgcgccgccgacacagctcgcacgcgatgtcgagttggtggcgaccctcgtcgtcctcgcaacggcaggtcgcccgttcttcgtcgcggcctggaacgccgctcgacaccgcagcgtcacgatggacaccctggttgcgctcggcgctggcgtcgcaatgacggcgagcgccatcgtcaccgtcgcgggcctccagcacgagccgacctacttcgacgctgcagccatgatcgtcgccttcatcgggatcggcaagctgctcgaggaacgttggacgcgtcgcgcgcgagcaggtctcgacgctctcgaagagctcagccgtcgaaccctcgcgcgcatcgacgacgacgggagcctgcacgaagttcccctcggcgagctcgaggcacacgaccgggtgctcgttcgcccgggcgacatcgtcccggcagacgcgcgagtcctcgacggggatgcggccgtcgatggcgctcttcgcaccggacgtcgcgatctgcggcgcgtcggccccggtgacgaggtcctcggcggtgacgcggtcgtcggctcgtcactcacgatcgaactcgatgcacctgcccgactcggcctcgtggtcgagctggctcgtctcgtcgaggtggctcagcaccgccgggcacgtctcgcgacgctcgccgatcgcgtctcggcccgcttcgtcccggccgtgattgcggtcgccgtggtcgtcgcgttcgttcgtctcgccatcggcgcaccggtcgccatcgcactgagtagcgccatcgccgtggtcgtcgtcgcctgtccgtgcgccatgggtctcgcgaccccgatcgccttcctcgtcgcgagcacgcgcgcggccgcgcgaggaatcgtgctcgaacaccccgatgccctcgagcatgccacctccatcgatacggtcgtgctggaccgaaccggcacgatcaccgaggccgatctcgttgcccactggcccgagcgcgtcgctctgtccgagcgacgcctcgtcgcggcactcgctgcgcgctcacgccatccggtctctcgagcactcagtcgagtcgagggcgacccggcgaacgccagcggcgacggcaacgaccccgagccggtggtcgagcacgttgtggagacgccaggcgtcggtgtcacgggacgggtcgatggacacgagatcgccatcggctctcccgcctctgtcggtgcgaccggcgtggaccctgccgcgagcgagcgagcagtgttcgtccgcatcgacgaccaatcgcctatcgtcatcgaactcgccgaacgcacgcgcgagggcaccgcagcaacggtggcggcactgcaccgccttggcgcgagggtcatcctcgccaccggtgacagccgcccaaccctcgcggacgaggcgcgtgagttcggcattgacgacgtcgccatcggcctcgatcccacggccaaggtcgcgctcgtcacgaagctgcgcgctgacggtcaccacgtggccatggtcggcgatggcaccaacgacgccgccgccctcgcaaccagcgatctcggcatcgcactcggtggtggcacgcatctcgctcaggccaacgcggacgccgtcctcctcggcgacgatatcgccatggtgccgaccgtgctcgatctcgcgcggcgcaccgtacggacgattcgccagaacctcggatgggcactcggctacaacgtcatcgccatcccggccgccgctgcgggtctgctgtcgccgatggtcgccgccgcgctgatggcgatgagttccctcgtggtggtgggcaatgccttgcgtctcgacgtacgcgagtcggcgggcgcatcgggaacgactgaggtccgctagagtggggccccatcgggccgttggcgcagctggtagcgcacttgcatgacgcgcaaggggtcagaggttcgagtcctctacggcccaccatatcgccgttttcgaacgcatggtcaagagcaggtcgaaggctcctgtgcaggtagcttcgacgtcgtgtccatcgtgcacgtggagctcgtccaagatgctcacgtcccaccgatggtgtacattcactcactggcactccctggccgccctcggcctactaccgcaggctcctcctcggcaagcggctcaagcacgggaggagtgctcgtgggccgaagcgtctgcgaggtctccttcgtgtcgtcgtggccctcctgtgtggcaccgagctctgccatggactcctgcaacaggtcgtgccactcggcaacggcccacccctcgtgctggccgagcacgacagcggtgacaggcggaggatgacggcgtcgtttccgaagaccccgacgacgtggtgcgccgcttgatctcgtggttcaaccgctctgagcgggttcgtcgaccagatcgttcgccagtggcgctctgggaagtgcgtgaaggtgtgagacctcctccttggcctcggcgagcgtggtagcgaccacggggagcgtgggggcaagggagtcgatgacctggtcgcactgggtacgtagcgctgccgggtacggctcgagcgacgatcgtacggatcgtgaggccaggaccatctccttgagctccccttcttcgatgcgagcgagcacgtcgcgcacgttgcacgcagtagctgtgccagctcgccccgacgacgcacctcgcgatggcttggtgaacccccgctctggcatcggagatgacgaggcgcacaccactgagacctcaagatccctgagctccctcgagaacctctcggtctgcccatccccgacgcacgaccccaaggacctcgtgcgtctcacgtggcatgcacgcccgtcgtgaccacgacggcacgggagatgacctggtgggcaaggcggccgttcgcgtcggtggcatcggcgacgagggagcagaaggcagagatggtccagcctgcggctacgaaaccccgccagctcctcgtctgaggttgcgatgatgcgagagacctcgctctctgtgacccccgttccaccgagggccgcgaccaggtcatcgactttgcggtgctgacgccctgagacgtaggcctccagaacctcgcacgtagagagcacgatcgacgcaggcggcgacgctcgcagatgctcgggacacgctcccctggcggagctgtgatggaagttctgacacgacgtctcctccggtgcccgggttcgcatgcgggcgcggaacgaagacggtctgccatatgggttaccactacctgtgggggtggactcggtctttcccgcgaacccggtggcaacgccgatgtcgatcccacgctcccttggcaccgggccgtcgaaccgagacctgaggcaagggcgccgcgaccttcggcgcgactaccgaccggtagacgcggatggcggcgtgctcaccctcggagaagccctgctccagggtgcgggccggggtcatgatccccgacgcgacggagcacgagtcggacgtccggaaccgtcgatttccccgagacccagccacgcgacgcgaacccacacgtcagtgaggttcgaacacgagtgactacggctcaccaggagaagtgtaccgaatgtggtacacgtcccgcatgagcaagatcgtccccattcgcgagcttcgcagtgagctcagccaggtcatcgaccaggttgccgacctgcgcgagcatgtcatcgtcactcgccatggtcggcccgcggccgttctcgtcccagtggatgagtacgaggccctggaggagacggctgagatcctctcggacaccgagacgatggccgcgatcgacgaggggcgacgtgaagtagagcgtggggagaccctgacgctcgacgagctccgccaagaactgcagtcgcgccgtagaggatgagtcgggtcgagctcgcccggcgcgcccgcaaggagatcatcgacctcgactggccactgtccgacgcagtggtcgaggctctcgggctgctcaagcgcgagcccgaggcaggtcgcctccttcggggacggcttcggggactgtggtcacttcgagtcggtacgtatcggatcatctaccagctcgacaatgatgagcgcgtcgtgcgcgtgctcgctgtccgccaccggtctatcgcttccacgaccgatccgcgctgacagtcagttcctggggagcgacccgatccgttctcggagatcgtcgaagttcgaatgcgagtgcctacggcccaccgcatgtcgacgtcgtcgtcaaacgtcgacacagactcgtcatggagatccaaggactctcgggagcccgcgtctcatctcgccgctttgcacgtgaacccgtcgaacgcgaccgccccttgcagcctgctcgaatgatcgcacccgagacgagccgcgatcgcgcagcaagtcgcggagcgttgaggccgcagctgtccgccttcgcttcgccagacagtgctatcgaccctcgtcgtgggaagtacccccgctgcccggttgcggagcgatcctggcgtagacgctcctgggcacctcggtcatgtcccgcacctgttcggcgttcacgccagaggcgattggcgcctccagcccgaccgcgcgacggccgatcacagcagcacggccggtgagccgtggcacgtggcgatctgatcgccatcagatgagacgcgcgcatcgagcccgagccatgctcggccgggttcacggccccaccactctctgccagtccgtcggccgggccaggacgccaccgtctcccatcccggcatcgaagccctacgtacgagacacggcatgcgctccagcttctgcgccactgcgaggccagcgactcatcggatcacacagccgctggcccgcccaaggtctcgacggtaggctcgtcccatggcctcgagtacgtacctccatggccaccacgagagcgtgctggccgcccatcgacggcgaaccgccgagaactcgtgcgcgtacctcctcgaccatctccaccgcggtgccacggtcctcgacgtgggatgcggcccgggcaccatcaccgtcgacctcgcacggatcgtggcaccaggcacggtcgtcgcgctcgacgccgagatcggcatgctccaagcaacggcggcgctcgccgcagagcgtcagctggacaacgtgaccgtggtcctcgctgacgcgatggccttgccctggcccgacgccaccttcgacatcgtccatctccaccaagtgctccagcacgtccccgatccacgcgcgctcctgcgagagtgtcgacgcgtgtgccgaccaggaggcatcgtcgcggcccgagacgccgactacgcgggcttcctctggagtccgctcgatccggacctcgaccggtggcagacgctctacgagcaggtagcccgtgccttggggggcgagccggacgccgggcgttacctgctcgaatgggccagcgacgcgggctttcgcgaggtcatcgcatcggcaagcacatgggtgttcgcaacctccgccgaacgggcctggtggggagagtcctgggcgagacgggccctgcagtcgggttttgcgacgacggctctcgccacgcaactcgcccatcgcgacgagctcgacgccatcagccgggcctggttgcgctgggcacacgcgcccactgggtggctcctcgtgcctcacggcgaaatcctcgcgcggcggtgagctcgacgatgagctcgacgcggtgtgcgacgaacgcccttggcggcatcgcgtcgaccggcccccgagaggaagtccacccgtaccctcggcctgacgtcctcgcgtgagcgctcgcaagtcctgtggggaaccacacgagcgcgtcgagagtccgagccctggccgaggccgtgcggctgcgctgttcgcaagtatgtacgccgatcagatcactgcggcgtacgtccctccgcgggcctggctgcgaccacgtcgtagtctccgcgaatgacgaagaacgagccgcggatggtgcctgccaaccgcgaacgctgcctcgcaaacttgaagcgctcctcgagctcgcccggaacgggaactccgtcggccagtttgaagccgaccgcgcgcttgccacctggcgcgagcgtgtagaggacgttgacggccacgccgttgtcgtagaacacgtgcgtccagtcgatgccgtccacgacgaagtgagcgacctccaagggcgtcgcctggatctcgagatcgcgctcgtgccgcaggaggcgtgccacccactcgacgatctctggcgcttcgtcggccgactcgacctcgaacgcgtgaccgtagtgggtcgagaagtaacgcgcctcgttcgcccgcaagccagcaagcgcctccgcatacggcgacgcctcgagtccgtccgtactcacagcgtgaaagtcgacgatccgacccattgcgacctccgtcctcatcgaggctgtccgaccgccgttcgaccgggagcagccagcaagcgccatcgactccgcgtgccactcgagacgaccatcgacgagggagctgcatcggcgcctcccggcgccggagccttgccccgacttcgcctcaccggcgacgagcgctcgcgcgcaccgagcagactactcccgaaccggcacacgggcctcggcgaggcgccatcgcctcgagaggcccggcgcatggacgactcgtgccctccgagagttgcacggctacacccatgctccggcaccttcgtaccgctgcggttccaccaccgctgccatgggccactcaggctgcacctcacgaggcgatcggcgtgcgagcaccagccggtccgagcgcactctcgtctgtgaccgagcgcgacgccgcgggtgctcgccagcaccgctcgcccgcgcaccaccggatcgcacagcgtcagatcgcaagaagcgcatcacgcgccaacgatcgtgccaccgaagccgtagccaaagccgctggagccgtagccgctgtagccgtagccaaagccgaatccgccgaaaccgggggcctggaacccgaatccgttaccggcaaacggggctgtcgcggcactccctgagcccaggccgctcgtcgcgtcgtactgggtggtgaccgtgacggaatcgctcgagggcgacaccgtcggagccgcgatggtcactccctgttggtcgaccatcgaaatggcctggagcgtcccgctcggcagctcagccaacggtgcaccgttcgcctcgacgtggcgcatcacggtcgtcgagacgggggcaaggttcatgatccctgcctggctggtgggtgcctcggtgatccactcggccgaggtctcgacacctgaggccgccgacggcgagagcgtcacgacggtatcgaccgccggcgacgatgaccctgccacggtgagttcgagtcgccaccggtcggtcccgacgggtgtgatcgccgccatgacggtggcgccggtgggaatcgtgattgtgtcgaccgcggcgttcggtagctgctcgaagaacgccaccgtctgggcctcgcccttgggcccaggctcagtgagcgtaccgacctggatcaactggtgtgaccgcatcccgcccagcccgacccactctccgatcgcgctgttcgcagagacgtcagcctgtgtgaacgacggggccgtccagctcgcccggacacttcgctccgcgcttccgagcgcggcgagccccgaccagttctcggacgcgctcgttgcgctcacgagcgaggtcgatgccgagccggacccgctcgatgtcgaacgcggcgagttcgtcgcgaccgaccctggggccgggttcgtgacgacggtggagctcgggtgggtatcgagcccacttgatgctccggccgcgtggcccgcccacgcgaacaccgcaaccgccatcgacacaccgagggctccggcggtcatgctcctccgtacgtttcgagcagttcgcatggtacgtgatctatgcacggtgtcctacctgaccaagaaacccgcctgagaagcttctgggctacgctggcacctcacagagcgctcagcgatcgcacggggcgccctcagtgtggatgtcgcgcgcgccccacccgtccggggtgagtctcgggcaacgtgagggccatcacgacgccccagacgacgaggagcgctgcacccgcatccacggcagcgcggagcccgagcgcttgggcgaccacacccaacacgagcggaccaaccgcgtagcccccgtcacgccagagccgatagaccccgagtgcaccgccccgccagcgcgggtccgcgcgatcgccgacgatggcgatcaggttcggataagcaagtgccatcccgacgcccgtcacgatcgccgcggctaccgcagtgaacggacgatgcgcgagagcctcgaaccccagcccagcgccgatgacgatgatcccaccgacgaccggccagcgccgaccgatcgtgtcggccagaagaccggtggggatctggagaagcccccagacccacagatagacacccacgatcaggccgatcaacgccaccgaatccccctcgtgtaggagcaacagcggcacgaaggctgccatgagcgaatcagcgaacttggtcagcatgcctgcaaccgagaccaccccgagcgcccgatcccgccagctcacgagccatgcaagatggagcagcgacgggccgggtcgcgccgactcacctacgctccccccatctgccgacgcctcgacgagagcatgccctctcgtctcgctcgcaggccacacgctcgccatgcctcctaccaccacgaccacgagcgcgaggatccacggcgccacactgcggccgccttcacccagcagcaatccagcaccaaggccgccaagcccgacaccgacgtagccagcagcctcgtcaattcccaccgcgagcgctcgacgagtcggtccgacgaggtcgatcttcgcggtcaccgccatggtccacgtcagagcctggttgataccgagcaccgcattcgccgcgagcacctcccaccacgcgtgcgccacgaggatgccaacggcatagggaacgccgaagagccaaccgatgcgcaggatggtccgccgcccatggtgatccgacagatgacctgcgacgaggttcccgatcgccttcgtgacgccgaacgggacgaggaagctcactgtcagcagcaccgaccgcacgccgaagacggccgacgcaagaggaggcagcgccactcgttccacgccgatggtcgcgccaaccatgacggtgatgaacgtgtacacgccaaactgccgccaattggccccgagcccgagtctcggagtagcagaaccgcccatgcgcctcattcctacattcaaaccaatgtaagaatgagactagccctcggccacctccgttgagcccgactcgaccgctcgaccgtccacgagccacccgaggaagccgtcctcgagccgtcgcgcctcgatcccacggtctcgcagccaccgcaccgcgatggatgcgtacgcacaccacggaccacggcagtagacgatcacctcggaaccgggtgcgagccgcgtcggcacctctcggagcgcgacgagtggggccggcacggctcctggcagatgcgccgcacgccactcctcctccggccgtacatccagcacgaccaacgacccgtcagccatgcgatcgatgacgtcggctgcacgcagacctgcgagctcctcaggtccgagatacgcagccgcgagcgcctcgacgtcgcgatcgagctgtgcgctcacacgtgtcagctgcaaccacagctcggcgacctcgcgtgaacgcaggcggtagtacacgcgtgcgccctcgcgccgagtcgcgacgagatgagcgatcgccaggcgacgcaggtggtgcgaggcactctgcacgctctggtgcgtctcgcgagcgacctcttccacactgcgctcgccctgggccagcaggtcgatgatctcaaggcgccgcccggatcccagcgccgtcgcaacctcggcggcccggtcgaagagcgcaaccttgacagcatggtcgctctcgagaggggcgtcgctcacgtcgctccaggtccgctcgtggcactgcgccactcgtaccccacgcccggcaccgaccgcaacgcgccctgggccgggccgagcttggcgcgtatgcgcgataccaccacccgcaggtgatgggggtcgtcatagccgggaccccagattgtctcgagcgccatgcgatgggtcaccacacgtccttcgtgctcaacaaggtagcgcacgagatcgaactcgcgtctcgacagcgacaccggaccacgctcgtcgtcgacgacgagacgccgcgcagcgtcgagcgtcagtcgatcactgatgcgctgcctggtcgcaacgacgtgacccgacccctcgaggcgccgctcgagtgcacgcagacgagcttggagctcgagaatgccgaagggcttcgtgacgtagtcatctgcaccgttgtcgagcgcagcgaccttgatgcgctcgtcatgggcggcggagagcacgagaacaccgccgcgatggaactcgcgaagccgcgcgacgagtgccaccccatccatgtccggaagaccgaggtcgacgaggatgacctccggcggatccgcaaccgctcgctggagaccttcgatgcctcgaagtgccgactggacctcgtagccggctgcgtgcagcccaatcgcgagcacgcgcgcaagggcagggtcgtcgtcgatgatcaggatcgaactcacaccaacctcggcaacacgacgcgcacactggtagcgtccggttcggattcgaactcgacgcgtccaccgtgcgcttcgacaaagctgcgtgcgatggcgagcccgaggcccgtgcgacccgagacgcccgaggcgtggaaccagtcgaacaagcctctcgggtcgacatcgccactcataggggcgtggtcgacgacctcaatgagcgcatcgccactttgctccagaactcgcacctccacgacatcgccgaggggtccgtgccgaaccgcgttgtccacgaggttccagacgacctcgcgcagcagggaggcgtccccgagtaccttcaccggcccgtcggcgagcacgcaaacctcagacccgaacccacgtacctcgaccgctcgaaccgcatcgtggaccacctccccaagttcgcacaccacccgccggacccgccgcacgcctgcctcgagtcgactcacgtccagcagatcttcgaccagcgtgctcgctcgccggcactgtgcgagcgccgtctcgaggagctcgtcgtggtcgctcggcgcgatagccgccccgaaggcagccaccgtgctcacggccgtttcgatgctcgcgagcggtgtcaagagatcgtgcgacaccgtccgaaggagtgacagacgccagccgtcgacctgctcgagcgtggcgaggcgtacttcggcctggcgaagccggtcgcgctcgagcgccgccgagagctggtgtgcgacgacctcgagcgcaccgacggtcgcctcgtcgaggcgtggaccccacacaaccagggttccctcgggcccacccaacgtgctcacgatggaaccgcgggcctcgaacccacgctcgcgcagcacgatcgagccccgacccgttgcatccgaggagaaggctcgttgcacacgagcagcgtgctcggcattcgaacccgaccagatcagctcccctgcgccatcggctcgaacgagagccgcgccacctggaccgttgacgcgagccagcgcctcgacggccgcacccacgaggccggccgcgttctgcgcaccgaggagacgctcaggaaggtcggcgagcgcgccgaggatgcgagcctgacggagcgcccgatcgcggcttcgccggaaccgctcatccagcgtgatcgcgattgcgcccaccaccacgtagataccgagggggatccaattgacgccgcgacccaccgcgagggttccatagggagggatgaagaacacgtcgtaggcgatgaacccggcggcgaccgcggcgacacccgcgaccgccccaccgatcgcgacgctcgccactaccgggaccaccagcaccaacgccaccgtcgctggcggcacgaccgcacgcaccggaacgagcgcgacgacacccagtgcgaccgtcacgacaccaacggccgcgcccggatagcgcagcatccggcggctcgtgctgaggagtgacatgcgtctacgatcctaccgatggatgcgatcgacacggaggacgccgaccagcttgtcgccacgcccgaagtcgaacccgtcggccgcttccgtatctacctcggtgccatgcctggcgtgggcaagacgtgcgccatgctcgacgaaggcttccgacggttccaccggggcgcggacgtcgtggttggctttgtggagacccacggccgtgactacaccgcctcgctcgttcgagacctccccgtccttgcccgacgacgtgggacctaccgcgggcgcccggcagaggagttcgatctcgaggccgccctcgcgcgcaaacccgaggtcatcctcgtcgacgagctcgctcacaccaacgtgcccggactcggcgcccacgccaaacgctacgaggatgtcgcgacgctcctcgaagccggtatctccgtcatcaccacactgaacgtccagcacatcgagagcgtcgccgccctcgtcgaggacctcctcggcgtgcccgttcgcgagcgcgtccccgatgcggtggttcgagccgccgatcagatcgagctcatcgattcctcgccacaagcgctcaggcgccgcctcctccatggccacgtctacccgcccgatcgcatcgagtgggcactcgagcactacttcaccacccgcaacctcaccgtgctccgagagctcgccctgcgcttcgtcgccgactcgcaggtcccgaccccaacactcgcggtcgcatcccgggctcgttggcaggcgatcctcgagaccaaggagcgctacctcgccggcgtcacgctctccgcggcgtcgccacgcgtgctgcgacgcgcagcccgcatggcgctccgcagccacgctgacctctatgcgctgttcgtacaccccgacgagtacgatcccacgcgcgatgcgcctcgcctcgacgcgctccgcacgctcgccgccgacctcggcgcgatcctcatcgaacgtgacggctccgacatcgcgacgctcctcgtcgacgaggcccgcgctcgccaagtcacccagatcgtggtcggcgcctcgaggcgccggcgcatcgacgagatcctccacggctccgtgctgaaccgactgctgcgactcgccggaccggtcgggatcgacgtccacgtcatcggcgttcgcgactacgacccgagtccggatgagttcaacggctgatcgccgccttgcgctcgagacgcgcgagcgccatgttgagcgcaaggacatccaccacccgctcaccaaggaacccgaactctggaccagtcgccgtcagagcaaccaagcggcgcagctcgctggccggaactccggtcgcgcggtgcaccatgggcacctgcgccagtgcactcgcgaccgagatctgcggatcgaccccgctgcccgaggtggtgacgagctcctccgtcggcaccaccccttctgcccgccagtacgcaacgagccgtcgcgtcgcactgaccaaggcggccgagcgcggaccgaggttcgtgccgccggtggccatgggatcgtcgccatcgggacgcccatggaaccagcgcgcaccccgccaggtctggccgacgagcgtcgagccgtcgggtgtcaatgacccctcggcctggcgaggaaagaccgtctgggcgatcgcgacctcgatgagcgggtacgcgagaccacacagcacgaggaagaccaccgcggcgcgcaccgagcgcaggagcgtccggatcatgagaacgccctcgtcgcggcgagcacaaggtcgatcagcttgatgccgatgaagggcacgatcacgcctccgatcccatagatgaacacgttgcgccgaatgatcgacctcgccgacgacggtcgaaagcgcacccctcgcagggccagcggaatgagcgccacgatgacgagcgcgttgaagatcacggcagacaggatcgcactctccggcgagtgtaggtgcatgatgttgaggaccgagagacccggataggccgtgacgaagagcgccggaatgatcgcgaagtacttggccagatcgttcgcgatcgagaaggtcgtcagcgcaccgcgggtgatgaggatctgcttgcccacctcgacgatgtcgatgagcttggtcgggctcgagtcgaggtcgatcatgttggcggcctccttcgcagccaccgtgccggagttcatcgcgacgcccacgtcggcttgtgccagggccggggcgtcgttggtcccgtcacccgtcatggcgacgagcttgccgtccgcctgttcctcgcggatgagctcaagtttgcgctcgggtgtggcctcggccaagaaatcatccacacccgcctcggccgcgatcgccgaggcggtgagcggattgtcacccgtgatcatcaccgtacggatacccatcgcgcgcagctgttcgaagcgctcacgaatcccggccttgaccacgtcgcgcaactcgatcagcccgagcacgcgatcgccagctgcgacggcgagcggcgttgctccctcgcgcgcgatcgacgccgacagctcatcgagttcgactgggatcacgccaccctgttgacggacccattccttgaccgcctcggtcgcacccttgcgtatcgagccctcgtcggtgtcgacgcccgacatgcgcgtggtcgccgtgaacggcacgaaccgcagcgacgccgggtcgacgggatcacgaagaccgtaggcgtccttggcgagcttgacgatggagcgaccctccggggtctcgtcggcgagtgacgccaggcgccctgcggcagcgacgtcgccatcggccacaccgccgatcccgatgaaccgtgacgccatgcgattgccaaaggtgatggttccggtcttgtcgagcagcagcgtcgagacatcgccagcggcctctacggcacgacccgacatcgcgagcacgttgcgctggaccatccggtccatgccagcgatcccgatcgccgacaggagagcgccgatggtggtcgggatcaagcacacgagcagcgccacgagatcgacgatcgggatgccgacgtgcgcatagtgggcatagggctcgaggacgaccacgaccggcacgaagatcaccgtgagggcgacgagcaagatcgagagcgctacctcgttgggcgttcgtcgtcgatcggcaccctcgacgagggcaatcatgcgatcgaggaagctctccccagcacccgcggtgacccgaacgacgatgcggtctgagagcacgcgtgtgccaccggtgacggacgatcggtcaccacccgcttctcgaatgacgggtgcagactcgccggtgatggccgactcatccaccgaggcgacaccctcggtgatctcgccatcggcagggatgacgtcaccagcctcgcagaccacgagttggcccgcgacgagctgcgtcgccggcacccgctcctcggttccgtcgtcacgcagacgacgagcttcggtctgcgtacgggtgcggcgcagggcgtctgcttgcgccttgccccgcccctccgccatcgcctcggcgaagttggcgaagagcacggtgaaggcgagccacaccgtcaccagccacgagaacagcgatggatgcacgatggaggcgatcgccgtcacgatggtgccgaggtagacgacgaacatgacgggattgcgcacttgcacacggggatcgagcttcgtcagcgacccccgcagggcgacgcgtagaatcgtgcggtcggtcagcgagcgcgaactggcgaccccacgtacgggcgtggcggatggacgagtgggtgcggtcatgcgaagaacctcccatgggcgacggcctcggcgatcggaccgagcgacagagctgggaagaagttgagggcaccgacgaggatgatgacgccgatcaacagccccgcgaacatcggcgtcgctgtgtcgaacgtgccggcggtggcaggcaccggttccttggcggcgaggcttccggcgagtgccaggaccggcaccatgacaccgaagcgacccagcagcatgacgatcccaccgacgatgttgtagaaatcggtgttcgacgagagcccggcgaacgccgatccgttgttgttgccttgggacagcatggcgtagaacacctccgagaagccgtgcggccccgcgttcaagatcgcggcgcgcgcgctcgggagcgcgatcgcaaccccggtagcaacgagcaccgtgatcggcatgaccaacacacccaccgaggcccagatgatctccgtgcgctgaatcttcttccccagatactccggtgtgcgcccgaccatgagccccgcaatgaacacggtgacgatcgcgaagatcaacatggtgtagagaccgctccccacccctccaggtgtgatgtccccgaaagccatgccggccatcatggcgaggccgccgatgggggtataggagtccatcgaggagttgaccgatcctgtcgacgtctgcgtcgagacgatgttgtagagcgtggagttgtcgatgccaaagcgcgactccttcccgacgaggttgccacggctggccagcgccccggcagcatgctggatcgcggggttcggctggtgttcggcaacgagcgcgaccgcgagggtcacgccaaagatgatccccatcgcagcgaggaccgcaaccccatcgcggacgctcgccaccatgcggccgaaggtgtaggtcagggccaccgggatggcgaggatgaggtagatcgagaggacattcgtgaggcccgtcggattctcgaaggggtcagcaccgttggcgttgaagtagccgccgccgttggtgccgagctgcttgatcacctcctgagaggcaaccgggccacgggggatgacctggtggaccccgttcagggcgtcgacgacgtgcacggggccacccagcgtctcgagagcaccctgccacacgaagaccaccgccatcaccagcgagatcggtagcaagatccacaacacgccgcggacggtatcgacccagaagttgccgatggtggcgcgcccccgccgagcgataccgcgcacgagcgcgatcgcgacggcgatcccgacggcagccgaaacgaagttctgcaccgcgagggccgccatctgcgagaagtacgacatcgtggtctcgccggcgtagttctgccagttcgtattggtcacgaacgagaccgcagtgttgaaggcgagagcaggcggcacgccaacgaggtgctgcgggtcgagtggcaagtgcgcttgggagacgatgatcaggtaggtgacgacgatcgagacaccggagaagacgaggagggagcgcgcatagcgttgccacgactgctcctcgctcgcgctcacgccgacgagcgcgagcacgggccgctcgagtcgaaccaagaggctgtagcggccctcgtacaccccggccatgtacgcgccgagcacgcgccaggtcaccgccaaggccacggcgagcacgatgagctcggtcgcgaacgtcatggacgacacaccacctgttgcatgagtccagcctcgcgccgcgacacgcggagccgacacacaaccggcgatctgtgacgctcctgagacgcgcgaccgcccctgccgtgacaccgccgtgacggcgtgatggtggccccgacctgtagccttgtccccatggttgatcgctcaccgcgaacccgactgcgtcgcttcggcatcgcttcggtcggcgcactgatggtcgagctcgccttcggcctcgcaaccaacgcactcgtgcacatccctgtgcacgacccctggggcggagcgcacccaggctgggtgctctacgtccacgccgcgatcggcttcgcgctcctcgtgaacggcgcgatggtcgtcaacaccgccatcgactccggcgtcccccacgccctcggtgccgcagtcgtcggcgtgctctcgatcatcgccgcaatcggcgccggcatcgccttcgtcaacaccggtgcccagcaccagatcctctctgtggcgatggcgctcgcgttcgtcgttgcgctcgcggcctacatcgccctctggcaagctgcccgacggacccgcgtcgcctagtcgctgacctccgacccgggcatcgggacgtccaaggcgcgcgggaggatcctcccaaggaccggcacctggacgacggcgagcccgacggcgagcccgagcacgccgaggatccaggtgaatagcggcgcgagcgcaatgacggttgcagcgagtggcgatgcgaggaccgcggtcgtcgaccagagcgaccctgagagcgcgttcgcccgagctcgctcctcgtcgctcgccaaggcgttgacgagggcgggcgcgaccggcgagtagagcgtctcgccgacggcaaacacacccatcgccacgatgagacagagcgctgcgaagccgcgatcggcgcgacctgccagcgcaaccgcagcgatcgcccagctcgctgcccatgcgatggtcgccgcgagcagctgtcgtgaacggcgccaccgcctcgtggcacgactgacggggacctggagcaccacgatgacgatcgtgttgaccgtcagcgcgaatccgagaatcgccggtcgtgcaccgacttgcacgacgacgaaggccccccaccccccatcgagttcggcatagcccgcaaggaggagcccgatctcgatgagcagaaaccaacgcagcgcgacgttgctccgcaacagggcaaggtagccccctcgctgacgcgcgtgcctcgagcctgtacggggcacccgcggcgcaatccgcaccgcgacgagcaccgccgccaccgcctcgacaccagcggcgatcaaccacaagacctggtagtgcacgagctggcctcgcccgagatacaggcccccgagcgccgacgcaaggccgataccagcgttggtggcgaggaagagccgcgcgaagacgtggtcgagcgtacgtcctgcgaccagcgagccgacgatggtctgaccggccacccagaacaccgcctgcgagaggtacgacaccaacacggcgacaaaggcgatccagtgacggtcggcgacggccatcgcaccgtagccgagcgcccccgcgccgatcgcgatcgtgagggccgatccgagccgcagtcgatgccccagcagaccgagcgccatcgacacggcgagtccacagatcgaaccggcggcgagcaacccaccgacctccaccagcggcacgcctcgggcaaggtgcaggtaggccacgatgtagggcatgccgagaccggagccggctgcggccagtccgttcacgacgtagagcgtgccaagcggcgcaccggcttctcgggagatcggcacgccacaaccctagggccgacgagccttggaccgaggctgtccatacgagcgaccgaagttgggtaccgactcgtccagctgcgaccagctcgcaataagatggcccccgtcacggttgacatcactgcacgctgaccaactctcgaccgccgaaggagcagccgcatggcgacatcgacacccccgacgcacggccgactcgcaccggtcttccatctcttcgacctcttcccgctctcggtctcgagcgtggggccggtcttctcggtcgccgcgaccggtggcgtcatggccgcctatgccgggtggtgggcccttcccgccatcgccctcctcgccacgccgttcgtggtggcgtccttcgtcttccgcctgctcaatcgccactttccgcacgcgggggcctcgtaccactggtccgcacgggtgctcggccgctccttctcccgctaccaagcctgggtcctcattctcgcgtacttcttgtcgatcccacccatcgcgatcccggcgggctcctataccctcgccctcatcgacccgggccacaccccttccaatctcgccctcatggccgtgaccctcggctggatcctctttgccgcgatcccgctccttgctggcgcacgcccgaccgctcagatcaccaaggtcttcatggtcatcgagatggtgtcgctggcactcatcggcatcgtcggggtcgcgcgctttggcgcgacccacgtcccgatccacttcggccggccaccgatcggtgggatgctcatcgtcgccgtcgtcgcggctacggtactcgacggctgggagatcgattcctacgcagccgaggagtcgcacaagccccgatccgaaccggggatcagcggcatcatcggcgcgttcctcgcgctcgtgttctacgcgatcctctatccgttggtctttgccgaaaccccgatgcgactgctcgcgtcgccgcgtgacgccgatccgatcgccctgtgggcacagcgggttctcccggccggcctccactggaccgtgctcattcccatcctcggctcgacggccggtggactgtggctgaccacttacatcttgacccgagccctctatgcgatgggccgcgaacgcctcgtcccgcaggcctttgcccgaaccagccgacggcgcgtccctcacgtcgccaccatcgtcgtgctggggctcgtcgtcgtggtcgtcgccgtgcagaccttcgtctcctcgctgtcgagcttcttcgccctcgtcctgtcggcggcaggattcttcctcctcgccgagttcctctccgacacggtcaccgcgatcgtcttcctcacacgtgcccatcggcgtcttggcatcgaggacgaccatcaccatccggtgctgctcgggctcgccatcgtgtcggcgctcatgatggccggattgctcgtcgccttcttcgtctatggtccgagcgcgatcggcagcgggatcgaccaggtcacggccgtgctcctcgggcttggcatcgtatttgtggtgcttacacggcgtcgaacgaccgcccccgtcgtcttcgtgccagagggcgcggacgactgaggtcacccgcggcgcacccgcaccgccttcctagggcaccacgacgagccggaccgacccgacgccctcgatgatcccctcccagtgacccggcacgagcggcaccatcggcgtcaaggtgccggcgagcacccactcaccgggctcgagggaaccaccgtggcgggctacggcaccggtcaaccacgcaaacgagcgccgcggatcgccgagcaccgcctcggacccgccccggaccacctccgtaccgtcgcgcgtggcgatcgcgaccaggcgatcgaacgggatgccgtcgcggctcgccacgcggtcgccgaggacccacaggccggctcccgcacgatcggcaatgaggcttctgccccgcaccggccaaccgacgatccgcgagtcgggaatctcgaaagcaaccgccagctcgtcgacgacgtcgtcgacttcgtcaggctcgagaatcccctggatgcgctcggccacacgcagggccacctcgacttcgagccgcggatcgacgagccgcgcgagcgacaggtcgctacctgacccgatgcggtcatgctcggcgagtggtccgaagatcggctcctcgagccccatgcgacgccgagccgcttcgtcagtgaggcccactttccaccccgaacgcacggccccatgggcgtcgcgccgtgcccacaggcgcgcttgcacctcgtaggcgtcctcgagcgacaacgttccgaggtctgactcctcgacttccgacgcctcgagcagctcggcgaccgcctcgaggcgatcgccacgagaccggacttgcgcacgctcacgctcgaccatggcacgagtgtaggtcgcctcgcgtgcagaggactcgagccgccggccctccttgggtggcccaatcgtcgaccaccggtcaggtcgcttgcgatctggacgtgctcgccgaacgtggggcttcgtcagctcgcagcaccggcacgtacgagctccgcgagcacgcggagcgcgtcgcggggaccgctctggcgaccgagtctgagcacccgacgcggcgacaggacgtaacggcccgacgggagcggctcgccaagcaagatcgaccgagccgcaacgctcgcaagcgcaccgccagcggcggctgtcgagccaagctgcacgaagcccccgagttcggtgccgacagcgttggccgatcggatcaatcggacgctcaggttccgaacaccgacgatgcgcaccagagctcgtcgctcctcggcccgtgggagcgagcccttgagcagtcggtcgagggtcttccgggacagccgcccgttgaacggcacggtcggcccgagatcgtaacgctcgacgtcgaggacggaacgttccccgaaatcgccgaccgtcatcagcgcgacctgagccgaggccgcccatcgccgaagtcgggcctttgcgaccacgtcatcgacctcctcgatgacgagatctggacgaaaggcctccagcatggcgtcggccgcctcgtcgtagccgccacgaagatgcacctgctcgatgtagggatcgacctcgctcacgaactgcgcgatgaggtcgagcttggccatgcccacgtgtcgcatcgagccgcgaatgcggttgagattcgtcagcgtcactcggtccatgtcgccgaggagcagcgcagcgccgatgccaacgcgtaccaactgttcgacgatgacgctcccgacgctcaggccgaagacggcgatacgcgcacgctcgagccgtcgttgctcgtgggcctcgatcaggtatcgattccgtgcactgcgcagtgcccgcagatcctcgacactcggatagcgcacgagctcacacgaccacgggaagtagaaccacgtgccgtagcaatccggatccccaccgacacctgcgcgcgctgtaatctctgcacgagactcggatcggcccctcgggttctcgaactcgtcgagctcctccagcaactcgccgaccgcatcgacggtcctgtggatgcagacctgctcgcgaaggtcggcgagccgacgacgatcctcctcatcgtccgcgacgaatcgggctggaggcgcccacggccgccgaccgttcacgccctcgccacacgtcgccatagtgatcagccccctcctcagcccgcacgagcacccgacgctcatgcaacctcggacgccgaggtggtgcaaccataccacggtgcactccgaccacgcaggtgcgtcgatcgatccagcagaccaagcgagcccacatggtcctggccggtccccctgaaacgaggccacccgctctgtgagaaccgcgacccgaatggacgagcgagaaggagtgtgtatgaagcgcaggaagcgccacaccccggagcagatcctccggaggctggccgagggggacgagatgctcaacacgggcgccacggtcgctgaagcgccccggatttcgtgcgcacccccgtaggtgggaccgattcggactcggccgccatagtcctcctgctcgacctcgactggcaaacgacgtcccagccgctgcatgagccttgcgcgtgtcgtagcagcgcacccggaccgaggtcacctcctcgcaatccgtgaggctcgccagaggcccgctcaaccatcgctacttggatccaccgctacaacactgtcgggctgtacccgagcctcgagtagcgactatcgatcgaggaggagctcttctgggcccgggaggagaaggccgtggcccacctgcagcccgtcgagcaagcggcgcgagtccaccgctgtcaaccttgagaggagagccaacgacagacagcgccccacggtctcgcaccgagcgcacgatcgacgaggagatccctctccagctcgtggacgcgcgtctcgcgtcggtcgtcgatctcgctcgccaccactcgtggtatccagggtcgtgcgtgtcgcgatggggaacgctctcgcgtcgacgccgacaccgcaccgcttcgacttgacatcaggtcgcacaagcgaagcgatgggacacgtatgccagcgacggccttgcgtgcggcggtcggcgttgcgtgcggcggtcggccttcgtcacacggtgcccccggcaggattcgaacctgcgcacatggtttaggaaaccactgctctctcccctgagctacgggggctgaaccggcacccactatggtagctgccgcccatcgctacgaccgagaccagcctgcacgggaatgcacgtccgaccgtcggccttggcatcggtggggagatggggaggttccatggaagacgtcgtcgctgaaccggtgatcgcgcgcctcgtacgactcacgccggccgtgcgtgcgcgcctccgcgcgatgctcccggcgagtgcggtcgacgacgtcatccaagacacgctcgcggcggccgtcgcacaccacgacgagctcgagggcacggacggacgcctgctgggttggttgctcgtcgttgctcgtcatcgcgccatcgactggctccgtcgccaccgcgggccactcgatattcgaaccctcctcgtcgacgacgccgacacaccggatccggcgagcgccgtcgtcgaccgcgtcgtcctcgaggccgcgctgtcgctcctccctcagcaccagcgcgacgtcgtcgtcgcggtctgcgtccatggcgccccgatcacacgagtcgccgacgacctcggcgtccccgcggggaccatccggtcgcgtctgcactatggacttgcggcacttcgatcgcacctggaggccaaccgtgccatcccatgacgatgggtgcacgctccgcgaggcgtacctgctccacgagctcacgcctgacgaggtcactcgcttcgaggggcacctcgcttcctgcaggtcgtgccaggaccgcctgagcgacaccgcgcagttgctcagagcgctcgcagacctcgaaccacccgacgaaccggtgaccgggtcccaggtggcgcccatggcgcacgaccctcgcccagctcgcgtcgccggccacagtcatcggcgccgtcggggggcgctcatcggattggccggcctggtcgtcggcgcgtcgctcaccttcgcgctcgagcatcccgccgagcagaccccgtccgcggccgaggtgatcacccttgccgctcccccgatccacggcacgctcgtcgtcgaccgccgtgcatggggatcatcgatcaccctgacagcaaccggcctaccgtcgacgggccaggtctcactcgtcgtccgctcgaccggtggacaggtggtggacgcagcgtggcgtgcgatcggaccccagaggatcaacgtccaggcgccgaccccattccaaccgagcgccatcgcagccacgacgctcgtggcccacggccgccacacgaccgtgctctggagctggcaccgactcggcacagaaccggggaccacctagacgcgcgcacacgacgagtgcacgtttgcaatcatgcggcctacgaacggctacactctgctatccgtatgggcaacacgcctgcccatgcaaggaggcacggatgctggtcgtcgcccgccacgctcccgcaacccgaccccggccgggcatggccgatctcgagcgctcgctcaccgaggagggactcgtcaaggcacaagcactctcggtcgagctggtccggctcgcaccgacccatctcgtctcgagcccggcacgccgctgcatcgagaccttggcgccgctcgcgaaggcactcgatctcgagatcatcaccgatgatggccttgggcccagtgcgaaggctccacagatcgccatgagcctcgcctacctcggagcgctcgacggtgtcaccgtcgtcgccacgcacgcgccccagctcgaagtcctcctcgagcagttgctcgccgatcacggcatctccgtggacgccgacgcactccatctcccaccggccggctacgtgatcgtcgatgtcgccgaaggcgtgcgtccccctcgcatcgaccgcgtccgcgcctaccgcgacgtgggaacggacccgctcctcctggtcggctagcgtagccccgtggacagagcgctcggggtcagcgagctgatcgggcgcgtcaacgacgccttgggttcgctcggcctcgtcaccgtgcgcggcgtcgtcgagtcggccaaggcctcccaacgcggtcacctgtacttcgatctgatcgacgacggcgaccgccaagcccgcgtgagcgcagccatctgggcgtcgcgccgtgccggcatcgagacggcgttgcgccgcgctggactcggctcgctcggcgacggcgcgctcgtcgtggtctcgggacggctccaggtctacgctccgcgcggctcgatgtcgctcagcatcgaccgcgtcgagatcgaggcgatgctggatgctcgcgccgcaacccgccaacgccacctacgccaactggccgccgaaggcatcgtggacgccaaccgacgcgtgccggtccccgccgtcgcgctccgcatcgcgctcgtcgcctcgcgtgatggcgtggtgcgtgaggacgtgcgacgcgcgctcgccgacacgggcttcgcgttcaccgtcaggttgtaccacaccgaggtatccacccgcgcagcgagcgtccagatccgccgcgcactcgcggccgcgatcgccgaccagcccgacctcgtcctcgtcgcccgtggcggcggttcggagggagacctcgccgccttcgacgatctcgaccttgcccgagcggtcgccacggcaccggtgccgatctgggtcgccatcggccacgccgtcgatcagccgctccttgcctacgtcgccaactgcgccttcgacgtgccacagagcgccgccaaggccctcgtcgcccgggtcgaggactttcgcgagggccttgccaccgagatcgcaaccgcgatccatcacgctcgggcacggctcgatcgcggctggctccacacgcgccagatcgcccacgccatcgaagcacactcgcaacgacgtcttgcggccgcacaccgcagcctgccgagcccgtccgtcctcgacgctcgcaccgaccagcgcctcacgaacgagcgccacacgctcccggcgacctccgtcatcgacgctcgagtccgggcgcggctcgctcgcagtcgcgcggtgctcacagcagcgcgatcggcccgcgacatcgtccgcctccgcgtacgcctcgaagtccgccagctcgtcgaccaccgccgtgagctcgccgcggcgacgtcggccatcgccaccgctcaccgcactgagcttcacgcgcggcaacgacgcctcacgcgcgccgcggcacgccggcgagcacaccacgatgccgctctcgccgccgtgcgtcggcacctcaccgccgcgtcgtaccggcgagctcgccgggatcgacgcggcctcgagttgctcgcacgccgcatcgaggggctcgcctcaccgctcgagcgcggcttcgccatgatcaccgatccgacgggcacctggcttcgccgcgcggacgccatcgcaacccacgcaatcgtgcacgcccacttcgtcgacggcgtcgccgcgctgaccccagctcgacgatctccgaccacgacgcatccccacctgaccacgcgccaaggaggacgacccaatgacgactgacccggccgatgttcgctggctcatcgacctcgacgaggacgccttcgcgcgagccatcgagcaacgctccttcgaggatcttcgcgacacggcactcgcactcaccgaactcatcgactccgacgccatcggcgtcgatgacctcgcgaccgtggtacggcgtgcgagggccatcctcgacgcgtgcgatctgcgtctgcggcgcgtggagaacgaactcgaccacgacggcaccgccgtcgaggaagcctcggccgaggtcgaggagccgttctagagctctgccgcgagcgcgtcgagggcatcggcgagtccctcgacgatgaccccgatctctgcgggctcgatgatcagcggcggagacagagcgatcgaggtcgccagcacgcgcacgatgatgccacgctcgagcgccaggcgcgcgagtcgagcgagggcgtcggggtgttcggcgagcaggtcggaacgcagctcgacggccccgagcagccctaggccaccgcgcacctcggcgaccaacgcagaggaggccagcggtcgaagccgagccagcagctcgccttcgagcaccgcccctcgtgcgaggatctgctcgtcctcgagaatgcggcagttcgcgatgcccgccgcagtgcaggtcggatgacccccgtaggtcggcccgtgccgaaagaccggggctcctggttgcttgaacggagccgccacacggcccgacaccatgaccccaccgagcgggagatagccgctcgtgacccccttggcgaaggtgatcagatccggctcgacgccgagacgctcgatcccgaaccaggtgccgagtcgaccgaacccgcagatcacggagtcgacgatgaggagcacaccgtgtcgccggcaggtcgctcctagcgcctcgaagtagccgggaggcggtggatagacgccgccagcaccgatgacgggctcggcgatgaccgcggcgacccgctcagggccattggcgacgatggcggcctcgacggcctcgacgtcgtcccacggcacctgcacggtggtcgggatgagctcgccaaagcccgtccggttggcagggatgcccccaagagaggtgccaaagccccaggttccgtggtagccgttcgttcgcgagatgagcacggtgcgctccggctggccgacgagcgagaagtaacggcgagcgagcttcacggccgtctcgacggcgtcaccgccacccgacacgaagaacacctccgactcgggcatcggcgagcgagccgacaagaactcggcgagctcctcggccgggcgattggagaacgtgccgaacgtggagtagccggcaagctcacgcgcctgcgcagcgatcgcatccgcgatctccgcccttccgtggccgacgttggcgtaccacagcgccgcggtcgcatcgaggtagcgccgtcccgtgtcgtcgtagacccagatgccctcgccccgcacgaacaccaccggattcgtgtcgctctcgtagagctgaccaaacggatgccaaaaccgtcccatgcgtccctcctcggacgcgagcctacgggacgtggcgaacggtgccgtcctgtcgccgcacgacgacctccgaacggtcgcggccccgctgcttggccagatagagcgcgacgtcggcggctgcgagcagcgcccgaagatccggcgcgtccgtctcagccgactccgccaacgcgacgcccaccgaggcactcgcctcgacaccgacctcggcgcgaacgctcgaggcgatcgatgctcggatcgcctcgccaagctggcgagcccactcgagttcgacatcggtcacgagcgccacgaactcctcgcctccccagcgcgcgaccaagtcgcgcgctcgcaggcacgaacgcagggcctccgccgaggcgcggagggcaaggtcaccggcgaggtggccgtactcgtcgttgagggccttgaagtggtcgagatcgacgaagaccaccgcgaccgcacggccctcgacctgagcgtcatggagcgcctctgcgccggacgcctcgaaggttcgacggttggcgagcgcggtcagggcatccgtctccgcgtagcggcgcaactcctcagttgcgcgaacctgcccgacagcgatcgcggcctggtcggcgaagaactcgagtgcctggatctggccgaggtccggatagcgaccgtccaccgggttgtcgaccgagatcactccgaggagccgctcgtcctcgagaagtgggatcgacagcgtatcctcgggctgccaggcgtcgtcgtcggcgacgtgctcggctaccgggaccgacatgcggcgagcgaggtcggggtgcagcggataggcgcgatgccggaacaggtacgaccgagagatgcgcatctgcggcgccatgaccgcggcgaacagcgagagtgggatgggaccctcggtatgcaggcgctccgcctcgacgggatcgacgccactcgtcaccgcgaggacaagcgaatcgccttcgcgcaggtagatcgcggccctcgcgaagccacctgccgtcgtgacggcatccgcggcggtctggagcacctcgaggagcgccgtgcgccgctggacgtctcccgaggccgcgaggagccctgcgagtcgagctcgctcggcctcgaggatgcggacctgggccgagacgcgcgaacgcagatgctcctggacgagggcgagcccgaccagctgtgcgagcacgtccaggtacccgacttcctcggcgtcgagacctccgaggctcaccggctggtcgaggaacaagatggcgcccacctcttgctcccacgactccacgagttcaaaggtgagcgttgccgggttccacccctcgacgagcgactccgtctcgcggatggccgccttggcgagcagctcgtcgagcaacgggtggtctccgtcgacgacgtggaggctaccgatgcgccgcgccaccgcaacgaggcgatcgagatcggagcgtgcgagcgcgatctcccggagctcccgagccgaggtcaaccgacccgcgacgtgggtcacacggaagtacccatcgccctcgagactcgcgagcccagcactggcgaacgacgtcaacggagcaatggctgcacacagcgcgcgatcgaggaccgtgtcggtcgtcgggcgggcgagaacctcacccgcgatggcggcaagttcggcgaagcgccgcgcggtcatggcctctcctccgcctcccctcatcggcactatcggacgctggatcggcgatctcaagtcacacgggcagcctcgcccacgccgcgctcagcaccgtggagcgcgtgtcgcgcctacggctgcccgaacgcgaccggcgtacccgaccacccgatcgggtcgacggcgaccggccgaccgggttccgtggcttcgaccaccgacccgccgccgacgtagatggcgacgtggtcgataccggacgaccccaacgtatcgtagaagacaagatcaccggggaccagctgcccgtagccgataggcgccgagtcggcggcctgcgcagcggcgtcgtgcgggagggcaaggccgagctgggcgaagacgtagctcacgagccccgaacagtcgaagtactgcacccctcctgaccactggcccgcggcgccataggagtaaccggtatccccgcgcgccgcgatggcttcggcgatcgaggccgcctgctcgagcagcgatgcggacgcaccctgagccggcggcgtcgcggcaaccgccgccgtctcggtggcgagttggacactcgcccgctgctcgaccgctcgctgctgagcggcttgggcctgagcgacgagctgggccatctggcccttcagcgacgccaacgccgactcgacggacgcctgctcgctcgcggccgccgctcgcgcagcggcggctaccgccgccgtctggctcgccgaacgcacgagtgccgcgagctgggttcgctcgacctcgagcgcgagtgccatggcccgatactgggcgacgaggcttgtctcgtcggtcgcggcgaccgacacgtccgtctggacgatcgctgcgctgttcgggctcccggcgagcaccgcccccatgcccgccaatgcgtcaccgctggtgaactgatcgagggccgcacgggcgagccgggcccgttcacgcccgagcgcctgtgtctcgctcgcgatacgcgcacgcacacccgcgagctcggcctgatcctgggcgagttgcgccgtcgccgcgtcgtagcgctccgccgcgacctggaccgcaccgtcgagggcggtgagcttcgcagcgagctgagccgcttcggactggtcggtggcgagatcgacgggacgcgcaagcggcactgcttggagcgaggccgtcacggccgcagcgatgccgaggagggccgcccgcaccagcacgcgccgcatcgcacctcccgcacccagattgcgctcaggctaccatgccactggcggccgcaccagacaggcgacggcggcccgtccgagcgatggaggtcagcgatggtgcacggcgtcgacgacacggcccagggagcaccttcgggcgcactcgccggcatcgtcgtcgcggacttctcacgggttctcgccgggccgctcgccaccatgatcctcggcgacctcggcgcgaccgtcatcaaggtcgagcaccctcgcggcgacgagacgcgcacctggcgccctcccgagcgcgacggaagggccacctactatctcagcgtcaatcgcaacaagcgtgccatcgcgctcgacctcgacgacccgaacgatcgtgccatcgcatgtcggctcgccgcccgagctgacgtgctcgtcgagaaccttcgagtcgggaccatggcccggtggggcctcgcctacgacgacctccgcgcgacgaacccgcgcctcatctacgcctcgatctcgggctatggtgacggacccggcgctcacctccccggctacgacgtcgcgatccaagcagcgagcgggttcatggacctgaccggccaaccagacgggccagccacgaaggccggcgtcgcgatcgtggacgtcgagaccggtctcaccctcaccatcggtgtcctcgctgcgctcgtcgcgcgggagcagacgggacggggccagctcgtgcggaccagcctcctccagagcgcgttgttcggcctcgtgaaccagatcggtggctacctcgcgaccgggaacgtgccacgacggctcggcaacgcccaccccagcctcgcgccctaccaaccgctcaggtgcgccgatggcctcctcgtcatcgccgtcggcaacgacgcgcagttcgagcgcctcgcgacggcgctcggcctcgacggcctcgaggatgacccgcgctttggctccaacgccgatcgcgtgcgccaccgcgacgagctcgccgagctcctcgaggcgcgactcgcgaccgagacccgcgagacctgggcgcgccgtctcgaagccgcgggcgtccccgcatcgcccatcaactcggtcgccgaagcggtgacgctcgccgagtttctcgggctctcgcctcgagtccggcttcccggcccgctcgagctcgacacgatcgcgaacccgctcgccctctccgacacaccggtcacctacgcgctcgaacctccggatctcgacgccgatcgcgactgggtgctggcgtggctcgatgcggcagaacgaaacgcctgaacgagacgccgtgccacgtggacgagccgcccatcggcaccgaatggcccgacgacctggaccgagaacggcacccggctcgttcgccacgggcccgctccgcccccgaccggcacgctgagcgccggcaggccgagggcgttccaggggatggtgagctcgttgagccgcaacgtcgaccaggcactgaggggtccgggcggcgcgaggagggtcggcacgagcgcgagcgcctcgctgtcggcgaaccaggcctcaaaggccgcccgccacgcgtggagccgagcacgtgcctcgagataggccgcaccgtcgaccgcgagcgctccctcgagccgtcgcctcacccacggatcgagccgatgcgcctggcggaggagccatccccacgtcgccgccgcctcgaagtcgaggatcgtgccgccggcacgggcgagctcaccgagatcgaccggcgccgacaccagtcgctcggcgagctcgccgagtcgcccatcgacgttgggctcgccgacacccacaccgacgagtggccagtcgcccaccagctcgtcgatcccgagcgcacgagcgccctcggacagccgatcgatgtcgggggcgatgagccccacggtgtcgagactgggcgccagcggcgccacacccgacgtcggcagaaggccgtagctcggcttcagaccgaggaccccattggccgccgctgggatccgcaccgatccgccggtgtcggtaccgagggcgagatcgacgagcccgagcccgaccccgaccgccgatccactcgacgaaccacccggcacgagcgacgcgtccaacacgttctccggggtgccatcgaacgggttgacaccgtgcgtcccgtaggcgagctccaccatgaccgtccgcgccgtcggcacccacccggccgctcgcaaccgtgcgacgacggtcgcgtcccgaagcgcaggtcccaccatggtgccaaggagccgactcccgacgcgcgtcggcacgccgacgacgtcgatgttgtccttcaccccgaggcgacgtgcgaccggagccgcttcgatcgacggggcaccgagtgcccaattcctaggagccgtcgacatctgcctcctctgtcgcgacgccagacacctgtccgatggtcgcaacctgcgtcacactgggcgccatctgccgcaggtacgtgtcgaagaacgcgatgctgacggcagcgacggcctgctcggcaggcccttcggtcgtgtagggtccgaggtggtcggccccgaggagccactcgaggtacttgggcgcctgggcgtccgcgtagatcgcctgggatgcggacggcgggttcaccgtgtcggcggagccctgcacgacgagcatcgggacggacgagccgaagaacgacccgccgaagggggagaacaccgcgcccgacagcacggcgacggcacgaacgccagggatcgcacagcaggtgttgtccgcgctcgcaaggaccacgtcgccgccgtcgctctggcccgcgagcgcgacgtcgtcggtcgcgacacggcccgcgagcacgcccgagcgcgcaagcacgtccatctcgccgatggcggccgagaggtcacccggttcgttgagcatgtccgactcgaaggcgtccgcgatcgccgcgtcgtgcaggtcgaccccgtaggtcgccagcgcccacgcagagctcagtgggaagcggggagcagcgaccacgtagcctgcgcgaacccacgcctcgatgagcggcacgtacgcactcggatcctcgtcgaagccggccgcaaacacgatgaggggatagggtccacccacgctcgcgaccggggcatcggccacgatggtactcgatgccgtccgggacggatagaagacgtccagcaggtagctgcgttccgaacacgcgtgcgtcgtcggtacgcacgtcaccctgccaggctcggtgacggtcacccgaagctcgcccaccccagcgatctgcccgctctggtgcgcagacgacgagcgcggccgcgtcgacgagggcgctggctcgtgtcgatgcgtcgtcgacgcgctcggggtcgtcgtcgctcgttccatggccgtcgccgtcacgaccgacgccgacgccacgacgacgacggcaccgaccccgacgagggcgcggcgcctagccctgagtctgcgtgaacgagacgccgttctcgacctccgcgatctgcgcgatccttcgcgcgtgacgccccccatcgaagtcggccgcgaggaacgcatcgacgatggcgagcgcgaggtcgtgaccgagcagacgcgccccgagtgcgaggacgttggcgtcgttgtgcgccctggcgaggcgagcggacagctcgttgtagcacagggctgcacgcacgccccggaccttgttcgccacgatctgctcgccctgacccgaacctccgaagacgatcccgagttcggccgcgccggtcgcgaccgcctcggcagcaggctggcagaagagcgggtagtcgacggactcctcagagtcggtgccgaagtcgaggacgtcgagtccagcctcgacgaggtggcgcttgacggcctccttcagcgcgtagccggcgtggtcggcgcccaatgcgatgatccgactcacaggtaggcccccggtgcttgctgggctccaggaggctgcggcaggccgcgaccgcgcaactgctccagctgtgcattcgaggccatgcgctgggcaaacagggtcgcttggatgccctggaacagaccttcaagccacccgagcaactgggcctgcgcgacccggagctcggcctcggacggcacaacgccctcttggaacggcaacgagaaggaccgcagctcgtcggcgaggtcgggtgagaccacctcgctcagcgcgcgcaacgactgctcgtagatctcggcgaggcgctccctggagcgctcgtcgagggtcgcctgacggacctcgtcgaggagcgcgcgcaccatcgccccgatgcggatcactcgagccggcgacatcaccgcatcggtatcggcgctaccagcgttgggctcgcccgatgctccagccgtcgtctgctcggcgtactcagaattctcagccatcagctccctccatcgaccggctacgcacgaccccgcggcagcctacctcaccggacctaggggcccaccgcgatcggcacgaggacctcggcaggggtcagtgcaccgtggcgagcgcgcatccgtagcgcgccttgatcggctgggtcatcgaagaacacgggcgcggtcgcgacgaggcagacgtcgccgaggcgttgctcgaaggtctccgggaccggccccccgaagagcccagcggcgacggcctcctcgcgtgtgaacaccttcgcgacgtcgccgtagcgagcgcggcatcgctccgccaacgccgccggatcgccagcggtgtgcaaccatcggaaacgaccctcgcccgacaccagcgagcagtcgcctcgcacgtcgcgatcgagtcgcagagcgcctccgtcgaccgccacctgaccatgatcggccgtgacgaccagcgtcacccctggcggcagccgctcgagcagcaggccgaccatcgcgtcgaccatgcgcagctcgcgccggtaggcctccccgagaccgaactcgtgcgcggtggtgtcgatcccttcgtagtaggcgtagacgaaccgctccccacgagcgagtgcctcgtcgatacgcgtcacgacctggctcaaggtcgaccaccaggccagccgcgcgccacggagatgcaccttcgtgaagcaggtgtcggcgtaggcgaacttggtcaccgcaacggggttcgccccgaggaacggggtcaccggcgcgagccgctccggtgccggcgccgggcctcgcccgttcacagtccagcgcaagacgttgagcacggatccaggcccgacgacgacgcggtagccaagcacgccgtgcaccgccggcaccacgccggtcgtgagcgacgtcagcgcggtcgcggtcgtcgtcggtgccgtcgagtgggctggcaccacccggagcgcgccgagggtcgcaagctcgtgccgatgctccatcaactggagatagccgagtccgtcgagcacgagcaggacgactcgctcgggtgaccccacgtggtcggccaaccacgcgggtgctgccggctggcccgccatgtcgagcaggccgaagatccccggcaccacaccggcgagcgacggcccgtcgtagcgtggcactatgaagccgtgatcggcctcgcgcgcgatctccatccgccctccttgggccaaggctaccgtgtgttcgccgcagcctgaaagccgaaccgccgcgttcgtcgcttcacgaccactccacggctcgcgtgtccgtgggcgctcggcccgagctcgcgctcgagccgcgaccagcatgggagctgagctccgtcctgcccgcaccccgagcgaacgacaggagtcgtcgcaccctcgaacgagccagcctcgctcgggaacgacccggccccaggcgcgctcgtggcccaaggtgggcgatcgaccgatcgccccacgacctcgcggccaggagctaggctcgagatagtgagggtctccacgcgcggtgactacgcagcccgagcattgctctcgctcgcgctccacccgagcgaccaaccgacctccgtcgccgagctcgctcgacgcaccgggctaccccagccctatctcgagcagatcctcctcacgctgaagggggcagggctcgtacgctcgaagcggggcgcaggcggcggctacacgctcggccggagcgcggaagagatcacccttgcccagatcatcgcggccgtcgacgggccgatcaccgtcggtgacttcaaggaaccccacgaagacggcgcgtgtgaccacgaaggtcagtgcgcgctgctcgaggtctgggccgaggtcggccaccacatggccgatcacctgcgcagctacacccttgccgagatggtgcgccgtgctcgtgggctccgcggcgacgtgctcggcgccgtctcggatcctcggtgatgacgaccgacggcgagagcgacgcgcgctaccccgcgcactgggagagcgacatcgtcgcagccgacggtcgcacggtccacgtgcgacccatccgtcccgatgacgcaacagccatcaggcgcctgcatgggcgctgttcacccgagaccatctactaccgcttcttcacgccgttgccggagctctcggacgccatgctccagcacttcgtggtcgtcgactacgtcgaccgcatggccttcgtcgccgaatccggcgacgaactcatcgcggtcgctcgctacgaccgcctcgcgggctcctcggatgccgaggtcgccttcctcgtcgacgacgcccaccagggccgcggtctcggcgcggcgctcctcgaactgctcgccgcctacgcgcgacagcacgggatcgggcgcttcgtcgccgagacccttccggacaacgtccgcatgctcaaggtgttccaggacgccggctatcgagtcgcacgcacctgggccgacggcaccgtgcatgtcgtcttcccgatcgatcccacgccgagctcggcggccgtgatggccgaacgggagcgccgggcggctgcccgcagtgtggccgcgctcgtcaacccgacccgcgtcgccttggtcggcgcgagccgaacgccgggcagcgtcggtgacgtgctcctcgccaacctcctctccgcgcgcttcgagggaagcctctgggtggtcaacccgaacgccgcagcggtccgcggcatcccgaccgtcccatccctgcgcgccatcggccaacccatcgacctcgccatcgtcgccgtgcgcgccgaggagctccccctcgtgctcgaggacgcccacgccgccgaggtgcgtgcgctcgtcgtggtcaccgctggcttttccgacatcggccccgaaggggccgaggaggaacgtcggctggtggcgagcgctcgacgtctcgggatgcgcgtcgtcggtcccaactccatgggggtcgcctcgcccgcgatcgggctcgccggcacgctcgcaccctttgcactcgaggccggtggcacctcggtgcacgcgcagtcaggtcccctctcgctcgccatcgtcgccaagttggcgcaggcctcgatcggcatcgcgagcttcgtgtcgtcgggcaacaaggccgatatctccggcaacgacctgctcgcgtggtgggagaccgacgagcggacccgttgcatcgtcctctacatcgaggacttcgggaaccctcgtaccttcgcgcgcgtggccaggcgggtgagcgcgacgaagccgatcctcgtcgtcaaacccgagcgcgagggtcgcagccgtgtcgagcccgaccgaccaggtgtgctcgacaccgaggtcgcgatcgatgccctcctcgagcgcaccggcgtgcttcgcactcagacgctcgaggagctgaccgaactcgttcgtctgctcgagtctcagccgctgcccgccggcgaccgagtcgccatcctcgccaatacccaggggcccgcccccttggtggccgacgccgtcttgcgggccggcctcgatctcgctcccctcgagcccgccaccgtcgagcgcctcggcaccctcggccgcgccgcggctcgcaaccccctcgagctcgggcccggcgtcgtgccggccgactgggaacgtgctctcgaactgctcctcctcgacgccacggtcgacgccgtcatcatcagcttcatccccaccgtggtcggcgcgcccggcgatcctcgactcctcgccaacccactcccgggaggcacgctccgcggcgcaccggcccagagcctcgcgcgcgcggccgagattgccgacgccgtgacgaaggtcgccacccagcgcggacgcgatcgaccgaagcccgtcgtcgcgaacttcctcgcgctcccgggtgtaccagaacgcctcggcgccggtccccgcaccatcccctcgttcgactttcccgagtcagcggccagggccctcggccacgcggcccgctacgcccgatggcgggcgagggccaacggaacgccgctcgagctggtgcccctggctggcgactgggcgcgcgatcccctcgacgaatccgccgacgaggaccgcgagctcgacgccgaggccgtcgcgggcctcctcgactggctggggatccctcgacgcgccccatcgggcggccgccgcgaggaactcgagggtcgagcggtgcacctgcgcctcgagctgatccacctggagcgctacggcccattcctgcgagcgggcctcgctggtgacgccttccgacgcatcggggcctcggtggccgtcgcactgccccacaccgaccgtgacgtgatcgacttcctcgaggcgatcccgggcgcggacctcgtcgtcgggtcggggccgtatccgagcgacgacctcgtcgcgatcgtccaccgcctcgtgacgcttgctgaacgccgctatgacgtggcggccctcacgctcgagcccgtcgtcggcacggcaaggggctggtgggctcgcagtggtcgctgtgtcgtccgaccactgcgcctcgaacccgcgatgatcacgcgaagccttcgcgcgcccggatccccctcacccgcctgagcctcgtcgcaccggcgcgagctcgggtggcgagccgtcgagtggtgacaaaccctcactttgcggcgagcctgcgccctcacaggagggcgtcgatggcccccacgagcatcgggtcctgtggctcgacagtggggcgaaaccgctcgatccgctctccgtcgcgcgagacgaggaacttctcgaagttccactgcacgtcacccgccacgccatcaccatcggggacctcgcagaggctcgcgtagaggcgatggcgcccctcgccgttgacctcgatcttcgcaaacatcgggaagtcgaccccgtaggtggtccggcagaacgtctcgatctcctctgcggtcccgggctcttggccgaggaactgattgcacggaaagccgagcacgacgaaaccatcgtctcgccgtgcatggtagagctcgacgagcccctcgtactgcggcgtgagaccgcagcgcgacgcgacgttcacgacgagcagcaccttgccccgataggcggagagttcctccttcgtgccgtccagccgctccatcaccaaatcgtacgggaacatcgaacccctcctcgcgtctaccgcgttaggtcaaggcctccgtgggcgaagttcttcccattccccagatctcgcccggcgtgctcaggacaggttgagggccgcgtacttgacgttcaggtactcgtggatcccttcgaacccaccctcacggccgaaccccgagcgcttgactccgccgaacggggctgccgcgttggagacgaggccctggttgacgcccaccatcccggtctcgagggcctcgatggtgcggactgcccgggagagcgactcggtgaagatgtagccgacgaggccgtaggtggtgtcgttggcaaggcggatggcctcgtcgtcgtcgtcgaagcgatagaccggtgcgactggaccgaagatctcctctcggaacacgcgagccgtcggaggcacgtctcgaagcaccgtgggcgagaagaagtaccctcggtccccgcgccgctcgcctccggtgaccagtgaggcacccgcagcaacggcatcttcgacgagccccgagaccttcgccaacgcgtcagcgtcgatcagggggccgacggacgcatcgggctccgtaccgcgcgcgaccttgagcgacgccagagccgtcgcgaggcgctcggagaaggtgtccgccagggactcatggacgaggatccggttcgccgacgtgcacgcctccccgccgttgcgcatcttcgcgaagaccgcgcccgcaactgccttgtcgagatcggcgtcttcgaacacgatcagcggtgcgttcccacccagctccatggacaagcgcaagagccctgacgacgccttgcgcatcagcaggctcccgacctccgtcgagcccgtgaacgacagcttgcgcagaccagggtgtccgatgatcgcgtccgagatcgggccggggtgcgaagtcgtgacgacgttcagaaccccaggcggcagaccgacgcgctcgaagatcgacgcaagggcgagcgtacacagcggggtctgctccgccggcttcacgatgaccgtgcacccagccgcgagcgccggggcgatcttgcgtgttcccatggcgagcggaaagttccacggggtgatcaggtagctcggtccgaccggctggcgtgtggtgagcacccgtgtcgtggcgtcgggggagacgtagaagtcgccgtgcacgcgcaccgcctcttcggagaaccaccgcaggaactctgccgcgtaggcgacttcaccccgagactctgcgaccggcttccccatctcgagggtcatcagcagcgcgaggtcatcctgggcagccatgaccgcctcgaaggctcgccgcaggatctcggcccgctcccggggagcgctgtgggcccacgcctcttggtgcgcgacagcagcgtcgacagcctggcgagcgtcgtcgaccgtagcgtcggcgacggaggcgatgacctcaccggtcgcgggatcctcgacgtcgaagcgacccccgtcagcggcctcgcgccacgcgccgtcgacgtagagtcccgtcggcaccgtccgaacgaccgctcgctctcgctcctccacgtcagcctcctcctgtcggatcgcagcaccctgcagcgaccgtagcctaccaagctcctcgcaacggtatccatcgcggaccgcgccgcgtcagctcgattccgcactgccctaggctcaggccatgcacgcatcggagcagtacctgcgcgagctcgtcgagctcgaccccattctcgcgaccgagctcggcctcgacaccgatcgtctccccgacttctcgcccgacggcaacgacgagcgagcgctgctcgctcgtcgcgcacttgcctggctcgccgacgaatccgatccggaccccatcgccgccgacctcatgcgcgagcgactctcgagtcagctcgcactctacgacgccggcgagcacgagcgggcggtgaacgtcatcgcctcacctcagcacgccatcaaggaggcgttcgacctgatgcgcatcgagggtcccgacgacgccgaacgggttgtccgccgccttcgagccgtcccgagcgccctcgccggctaccgcgcgaccttggagcgaggtcgagccaacggccgtctggcgcagcgacgacaggtgctcgccgctgccctgctcgccgaacagaccgcggatgcctacttcgctggcgtcgagcgtcgtgtcctccaggcaacgcagcaaaccgaagccgaccaacggctggcgggcgcgatcgaggccgcgcgctctgcctacggcgagctcgcgagctacctcaaggatgcctacgccccgagcgccatcgaccaagacggcgtcggcagggagcggtgggccctgtggtgccgccacgcgaacggtcgagatgtcgatccggaggaggcggtcgcgtgggcggccgacgaactcgccgcgctcggcgccgagatcgagaccgaggccaggcggctcggcctcgaacccgggcctggtctgctgacggcgctcgatcaggacccctcacggcagatcgtcggtgtcgacgccttcctcgcgtggaaccaggctcgcatcgacgaggccatcgagatcgtcgactcccgagccgtcacgatccccgccgcgatccgtcgatgcgaggcgctcgaggctcctcccggcggtgctgcggccatgtactacacgccaccctcggaagacctcgcgcgcccgggacgcacctggtatccgacccatggcaagacccgcttctcactgtggaacgagctgaccaccgtctaccacgagtccgtccccggccaccacctccaactcggcatcgcgacctggcgtggcgcagcgctcgatcccttccaacgaacgctgggctcgatctcgggtcacgtcgagggctgggcgctctatgccgagcgactggccgacgaactcgggctcttccccgacccggcgtttcggatcggctatctcctctcgcagcgcttccgtacgctgcgcatcctcatcgacatcgggctgcacaccggcatcggtgcgcagcgacgctcggccgagcccctcaccccagagcgcgccatcgacgacctcgtccagatcgcaggtctggagcgtccgttcgctgcaagcgaagtcgatcgctacctcggctggccggcacaggcgaccagctacaagcttggcgaacgagcctggcgagacgcgcgcgagcgcgctcgcgcgcgtggggtcagcgatcgccgcttccacgagtcgctcctcggcctcgggttcatcagcctcgaccagctcgcgaccgtcgcggccacgctggcaccgtaggggtagcgccgtcgtcgtgcgccaccccaacgacggccttagccctgcttgggtggacgggtcgcgctgcgcaccaacgcccgaagggcgagcaccaccacggcgacgatcgccacgacgaccgcaaggctgatgatggcgtgcacaatggtcagcaagaagcccaagaccagcacgcccacgacgacgaccgcgacacctatgaggacacgtccaagcatcggaccacctccacggtcaaccctagaccacgatgctgagcgaagtccgaatccgcgctcgagaaccgccgcacatctcgagtacctagctgacgatgtccttcgacagaaagctcgacacagcagccgtaccccacacgaccaaccacgccgcctgctccgcaaggtccttgaggatgggcgtcaggtaggccggcgagcggaacaagttgatgaacgagccccagtacgtcgagagcaagatgggtcgcacgacggcgagctgcgggacggcgccgatgacctccgcagcgatcacgatggccaacgtgatcgcggtcgccgtgagcgacgacgaggtcgccgtcgagatggcgacgccgacggccaccactccgaccagcgacgctcccacgacgagcgcgctgaggagcacgtcgccgacgccggacgcgacgccgacggcggtcccggacagcgtcacgagccgcccgtgcggaaacaagacgaagcccacgacgagcccgacgaccgcgacggtgagcgccgcgacgatggcgaacaccagtgcggcaacccccttggcgacgacgacccgcgagcgagaccccccggacaggagcaggtagcggagcgatccgttggcggcatcacccgccaccgcatctcccgcgacgatggcgacagccagcgggagcaccagggtccccatggtggcgagcgcggcagccggcaagaagacggcgttctgggtgatgaccgagaagaacggcggaccgccgccgttgcgaggaccacccgcgaccttgaccacgataccgagcacgatcggcaagaccgagagcaacacgaggatgaccaggttgcgaggacggcgaaacacccggccgagctcgtcaacgaacatcgaagccctcccccacctctgcgaggaagagatcctcgagactcggcagcaccggggtaacctcctcgagttcgataccgcgctccaccgccgaggcgatgagtgctggcatcgccgagcgcggcgcgacgacctggaccgcgaccccatccgcagacgccgtcgccccagggagggcgagcaagcgctcgagcggccgaccgcgcaggcgccaggtcggctcgtcgatctctcgcagctcactgaccggcccctggcgaacgacgcggccctgcgacatgaaggccacgtgactacagagcagttccgcctcggcgagcagatgggtcgagaggaacacggtgcgaccctcgtcgcgaagggcagcgagcagccggcgcacctcgcgcatgcccgcggggtcaaggccgttggtcggttcgtcgaggaccaagagctccgcatcggtcatgatggcttgggcgatgccgagacgttgtcgcatgccgagcgagaaccgagcaacgcgtcgatccgccacggccccgagccccacccgttcgagcgcggcttcgatcagccgctggcgcgcgcccgacgcgacgcctctcgcggccaagagccgggcgagattgtcgcgagcgctcaggtacgggacgtagcccggaccttcgaccagcgcgccgacccgtgcgcgcacggaggcgagtcgcggaaccgtcgcaccgagcacctgcgcgcgaccggcatcgaggaagatgagtccgagcagcgcgcggatcgtcgtggtcttccccgatccgttcggaccgaggaagccgaagatgctccctgctgggacctcgaggtcgacccggtcaaggacacgggtgcggccgaaagacttctcgagcccctcggcactgatgacgatgctcacccaccgatcacgacggtggcgtcgctctcgaggatcgcaggggtgacggcgccgacgaggacttgtccgctcggcaactggagggcgttgacgagcgcggtctggagcagcatggcgtgcgctccatcagcgagcgtgactggctgctccagggtgcgaagcgtcgagccgaacgacgaggaccccgcagacgtcgaggtaggcgcgccgagcgctcccttcggcaacaccgcgacgcgatcccagcccgacccaagcgtcgtcgcaccggccacgttcactgcacaggttccgggcgcataccccgtccagccggacgcggtcggcgtcaccgacgaactctgcagaggaaccatgcagcccgtcggcgagagcgccacggactcctgacgcaccgtggcaccggctggcggcgtgaacgtgaacgtggacgcaggcagcgagccgaaggagatctgggtgaactgccacgagagatccgtggtgccatcggcaccctgaatcgccataccgagcacttggtcattggctgcgtcaacccagaagctcacccgcccgatggtcgagccggcctgcgtcggctggatcacgagggtatagacaggctgaccagcgacgtaagtgttgtggccgaggcgcacggtcgaatcggtgccaagtgccgcaacgatcgtgtccgccgccgtggtggggtcgaacgtcgactgtgcggccgaggacatcgacgatggcgccgagccagaggccacgagatgcatcgcctgctcacctgatgagttccacaaccacaccccggtgcggctcgcgtagaggtcccgctcgctctgggcgttgagcacctcgacccgcagaccttcgcccacaccgcgccacagccgcacgctggccgttccttcagggattgccacggcgttcgtcgacgacgagccctggacgcccgagagcaaggacgccgccggacccaacaggttggacgtgatctggagggtgcccgagaacgactggggtcgagccccgagcaccgccgcgaccaactcctgcggtgacaccggcgtcaacgactcggtctgcgcactcgccagcgagggcgtcagtgcggccgcggccaccgcgaccagcgcggctccgacgggaatgccaacgcgtaccccacgacgtcgcacaccatgcgccatggctcctcctctacgtcctctacgcttgcccgtcctcaacgtccgacggcgctcgatcgacggcactcgattcggtgcctgaatcccacgctagtcctccactcagagcgccgtcaccgccgatgtgtcgggatctcaggcaaccataggcctcctacaaggacaccctcgagcgcgtctcaccccatcctcagctgcgacgacacactcgaccttgtgcgtacggaccgtcgcggtggcccctgaaggacgatggatgctcccaaccatcgggccacggcgcagctgcatcgcgccctcgcgctcacacgcagacggtgcacgagcggctggacccagagcgcgtgcgtccgtcgcctcgcacacgccctcgtggccgatcgagcggagcacgctcgagcgtggcggcatcgaccacgggggctgcgaacaggaagggagcgcaccgtcgtggtcgcagcatgctgcccaccgaaccaacgcgaacgccgtcacatcggcgaaccacggaacgtgtccgagggttctgacgcgagcggtcgcgccggcggaagcgggtgtcagcagggaaacaatcccgacgcccgacgtgttatactgtggcagcgccacctcgtgccctcgtcaagttcgacccgtgtccacgccgatcccgaagacgacgaaccgaaacccgactagatcgagtgggcagccagagcatggcgagagcctcggggggctgtgcgagcgcagtggctctcgtggcaggtcgggacacgactcctggtcgctacacggagcacggcgcccagcgtagttcggcgcgtcgatgaggggcagcagcgataccgttcatgagagagggcacgatggcgacgaagagtgatagcgcgctgaagcagagttcgcgtaagcgacgctcggtccaggcggaggtcgactctgcgctccaggcggcgggccttggagcggactcgatccgcctcttcctcgacgatctcgccaagcaccccttgccgtcggcggctgaacaagtcgaactcgccaagcgcgtgcgcgagggcgacgaggacgccaaggccgagatggtcgccgccaacctgcggctcgtcgtccactgggcgcgccgctaccaagatcgtggcgtcgaactggccgacctcatccaggagggtacgttcggcctcatccgggctgtcgagaagttcgactggcgacgcgggttcaagttctcgacgtatgccacgtggtgggtccgccagtcgctccagcgtgcggtccacaaccatggtcaggcgatccgcctccccatggaggcagcagagcgttcccgtcgcgtcgacaacgtcacccgtgagctcgcggctgacctcggccgtgcgccgaccgaagaggagatcgcgatggccgcgaacctctccgcgagtcagctcgccgacgtgcgtcacgcggctcgcgtcgtcgcgagtctcgatcaggcggtgggcccagagggcgagacgagccttggcgatctcgtggtcgcccaggacacctcgttcgaggaagaggtcgacgaatccatctcgcgggaaatgctgcgtcgcgccgtcgaagagctcgacgaactcgagcgccaggtcgtcaccctgcgtttcggtctccaaggagatcggcctgcttccctcgaggcgaccgcgcgcatcctcgggatcggaccgcgacgggctcgtcgcctcgaagcgagtgcgcttgcaaagctcgctgagaatccgcggctgaggacctcggcggcctagaacatcggcggcagagcacctcggcggccaagaacctcggcgggctcgggccacggcccacgcacacttccagcgtccccgacggccaccgttgggcctccgggcattgagctgcaggcgcactgcgacaggctggggcgccatcagcgactcgccagccaggcaccgcaccagatatcagaagccgaaggcgacatcgctcggcgagcagccggccacactcccgcccgaggggctcgtcaacgcccctcgtcgacgcggagaatcgcctccgtgcgggcgcgcgccgcgagctcgccgaggtcctccgggagctccgcggtcacctccacgcgtccaggacgcgttggatgctcgaacgcgagcgcggtcgcgtggaggaacggacgttcgagcccgccgtaggggacgccatagacctcgtcgccaacgatcggatgcccgatggcgctgaggtgcacacggatctggtgggtcctcccggtctccagcgtgagctcgacgagcgacgtatccggaccatgccagaccaccctcagctgcgttcgagcgtcacgaccgccgctcaccaccgcgacacgggacagatcgcgcagatcgcgaccgagcggcgcctcgatgcgtgcagcttgcggcggtacgcccacgacgagtgcacggtagcgacgctccacctcgtggtcgtggaccgcccgccgcaacgactcgtaggcgcccgcgctgagggcgatgaccatgaggccactcgtgccgcgatcgagtcgatgcacgagcccacgacgcaacggatcgccgggaagggcacggagcgacggccaccgttcgagtgcccaatccgcgacgctcggacgcacatcgcggaggtgggtgcgatggacgatcagaccagccggcttgtcgatcaccgccacgtcgtcgtcctcgtagcagaccaccggtgcgccctccggagccggcggagcggcaggatccggccaggtggcctcgaggagctcgccggcccgcaggcgcctcgaacgtcgctgctcgacacggccgtcgaccaggaccccgccatcgtccacgagctgctgggcgaacgcccgctcgatcccgccggcgatcgcgaccgcccgatcgagacgctcgccagcgagcgacgctccgatcgtgaggcgcagctcacccacgatgcccgcgcacctcggacagagcgagcacgaccaccccgaccgtgatggcggcgtcagcgaggttgaacaccggccacagcgggagctggatccagtcgatgacggcgccgtggtgatgacgcaccacgcgatcagccagattcgagatcgctccaccgaccacgagagacgcggcgatctgcgaggcgacaaagcgccgcgtcaggccccacgcaccgatcgcgacggcgaccacggtcgcgacgacgccggcgaccacggggtgacctacgcccagcgagaatgcgacgcccgtgttcaagacctcgacgagatggatcggcccgatgctcaccggatgcgttgcgaagtggtcctcggcgatcgtcttcgtgacctggtcggcgatgacgacggcacccgcgacgcaggtggtcaggaggatgcggcccctcaacgacggcgcgtcagccccccctccttgcaccgcacgcacaagcgcgcgtacgggagcgcgcgcagccgcgccctggcgatcggctcgtggcagacctcacaggcaccgtaggtaccggcatcgatcttggccaatgcatcggcgacctcactgagcgctgcgcgagcgctggcagcaagggcgaggtcgcgctctcggtcgatcgcggccgtaccaccctcgccagactcctcgtcgaactgcacctcgagaggcccgttcgtctgcacgagctgatcggcctccgccttgagctgcgaagcctgctgctcgagatgggcccgctcgacgaggagcaggttgcgctgctcctcgatgaacgtcccttcgtcgagcgcgtcgagctcgtcctcgtccaatgcgaggtacgcctcggcacgctcgtcgttcggaatagttcgctcagccatgaagtcctcactcctcgctacggtgccggccccgggcacgcacgagctgctcaatgatagctggcctccccgtcggcatcgacgccgacgaagaagcgcggcccagctcagcgctaggctggcgccatggacgaggcacctgagccatatcccgcgcaacctgcgacccttgacctcccagcactcgagcacgacgtgctcgcctcgtgggagcgcgaaggcaccttcgccgcgtccatcgagcgccgtcgcgccgagggggcgccagccttcgtgttctacgacggcccaccgttcgcgaacggcctgccacactacggccacctgctgaccggcttcgtcaaggacgcggtaccgcgctaccagacgatgcgaggcaagctcgtcgagcgtcgcttcggttgggattgccatggcctgcctgccgagatggcggtcgagaaggaactcggcctcaccagccgtgaggacatcgagcgcgtcggcgtgggtgtcttcaacgaccactgccgagccctcgtcgaccacacctcggatgagtgggaccgctacgtcacgcgccaagcgcggtgggtcgacttcgaacacgcctatcgcaccatggacctgccgttcatggagtccgtgatgtgggccttcaagcgtctctacgaccgcggactgatctacgagcactaccgcgtgctcccctactgctgggagtgcgagacgccgctgtcgaacttcgagacgcgccaggacgacgcctatcgcccgcgtatcgaccccgcggtcaccgtggccttcgccgtcgagggcgacccgagactcgcaggcacgctcgagggcccactctgggcccttgcgtggaccaccaccccgtggaccctgccatcgaacctggccctggccgtcaaccccgccgagacctacgtcctcgttcgctcccaagccagcgatcaagacgccggacgcacttacgtcctcgcggaagcgaggctcggggcctatgcggaccgatttcccgatgccgaggtcctcgcgcgcgtggcgggccgcgacctcgtcggccgtcgcttcgcgcccctgttcccgttcttcgccgacacgccgggcgcgttcgtcatcctcggcgccgacttcgtcaccctcgacgaaggtaccggcatcgtccagctggcccctggcttcggcgaggaggaccagcaggtctgtgaggcgaacgggatcccggtcgtggtcccggtcgacgaccgtggccgctacacggccgaggtcgagccatgggcaggggtccaggtcttcgaggccaacccggcgatcatcgaggtcctccgcgaccaaggagcgctcatcacccaggaggactacgagcactcctacccgcactgctggcgtaccgagacgccgctcatctaccgtgccatgagctcatggttcgtcgccgtcacggcgctcaaggaccgcctcctcgccgagaacgagagtatcgactgggtaccggcccacgtgaagcacggcgcttttggcaagtggctcgagggtgcgcgggactggtccatcacccgaaaccgctactggggtgctccgatcccggtgtggcgcagcgacgaccccgcctacccgcgtatcgacgtctacggctcactcgatgaactcgagcgtgacttcggcgttcggcccagcgatctccaccgaccggcgatcgacgagctggtgcgcccgaaccccgacgatccgaccgggcggtccatgatgcgacgcgtccccgacgtcctcgactgctggttcgaatcgggatcgatgcccttcgcccagctgcactatccgttcgagaacaaggagcgcttcgaggccaacttcccagcggacttcatcgtcgagtacgtcggccagacgcgagggtggttctacaccctccacgtcctcgccgtcgccctcttcgaccgaccgccgtttcgccactgcatcgcgcacggcatcgtccttggcaacgacggacgcaagctgtcgaagcgactgcgcaactacccggacccttgggaggtgttcgaggagatcggcgcagacgccatgcgttggttcctcctctcgtcgccgatcctgcgcggccaggagatgctgctcgagcgcagcgccatggtggacacggtgcgccgggtcatcaatccgctctggaacaccttcaacttcctcgtcctctacgctcgcgccgatcaccttcgcggccagcgcgtccacagcgcgacccacgtactcgatcgttacctgctcgccgcgacccacgatctcgtcgtcgaggtgaccgacgccatggatcacttcgaactctcgcgtgcgacgacggcggtcgagcgtcacctcgatcgcctcacgaactggtacgtccggcgcagccgctcgcgcttctggtcgcggcgcgacgacaccaccgaagatgccaagcgcgaagcctacgacaccctccataccgcgctcgaaacccttgcgctcgtcacggcgccactgctccccatgctgagcgagcacatctatcgcacgctcacgaacgaggcctcggtccacctcgccgattggcccaacgccgaggccctcccgagcgacccgacgctcgttgcccagatggaacgcgtgcgcgaggtctgctcactcgcacactcgattcgcaaggcagcagggctgcgtgctcgcctccccctccgtcgtctcaccgtcgtcctcgcagatcccttcgatctcgagccctacgtcgagctcatccgggacgaggtcaacgtcaaggaggtcgtggtcgagcccgccgccgaacacccagtgacgtggcagctctcggtcaacccgcgcgtcctcggaccacgcctcggggcacgggtccaagacgtgatccgcgctgcgcgcgaaggtcgcttcgacatcagcggcgaccgcgtgacgtgcgacggcgtcgagctcgcgcccgacgagttcaccctgaccctcgccaccgacgaccccaaacgggtgcgttccttcgccgaccgccgcggcctcgtgatccttgagaccacggtcgacgacgaactcgagcgcgagggccttgcgcgcgatctcatccgtctcgtccagcagcatcgcaaggatcacggctacgagatcgtcgaccgcatccgcctcgcgatcgccctcgaccgcacgggccgggtccagggtgcgcttgcccagcacgccaacgaggtgctcggcgagtgcctcgcgaccgaactcatcctcgacgacgcagcggcactggatcttcccgaccgctcgcaggtgacgatcggcggcgagcaggtgacgatcgcgaccgaaccagtccgcgctctgacggagcccgacggccagcgctagcgacgcagaggggcccctcgcgccagggagtgcactcgatcggactcttcgagcgccactgatcaacgacgagtgtgtcgcccaccccgcgagcgaacccagagcgaccacgtccacgcgaggccgccccggcgggcagcgacgatcctcgctgcccgccagcgacaccaccatcagtccgcgaccggactcgctcgcagctcggccgcgctcgcgaacgcgtcatgcgtctcggcgctgtcgcgccccgacgccaccgcccacgcgtagaacaccaaccccaccacgatgtccgcaacgatgtcgtagggataatggatcaagcccttgtggtggtcgaagggagctccgaagcgagccgcaccgaagcaggcaagtgcgagcatggcgagcaggtacaccacgagccacgctccatgacgccagtcggcggccgtgatcttggcaacgggagctccgagcgcggccgcaacgacgtagacagccgcaccccccaagatccccacgacgagcttccagtcgacgctccagcccgaccagtagatgatgagcgtcccgccgatgaacgcgagcggcgcgaggatcttgtcgcccgagagccggaagggtcggtgcgcatcggggtggaagcgacggaacaccgagagcgacaccggacccatgacgtaggtgaacgccgtcgccgacgagatcaccccgaccagactctgccagctcgggaacggcagcaagaagacgatcgagaacacgaccgtgatccccatggcccacaccggcacgccgaagcgctccgagatcccggtgaacacccgtccgaggtaacgattccgagcagacccaagcacgacacgcccacccgacgagaggtagacgagtccggttcctgacggagagaggacggcgtctgcgtagagaacggccgcaagccaaccgaggccgatcacggtcgcaacctgcgcgaacggcgatgtgtagctgaggcctgcccagcccttggcgagggcggcgtgcggtacggcggcgatgaagaccacctggaccagcgtgtagatgagggcacccaggaggatggcgctgatgatggcgcgcgggacgtcgcgctgcgggttgcgagcctccccggcgagatcgaccgcctgacggaaacccagcagcgagaagacgatcccgccggacgcgaccgcgatgaacacgccggcgctgccgtagggcaagaagccgtgcgtggccggggccgtgtagttgctccagtccttggcgacgaacaagatcgcgaggatggtgagcgtcggggtcacgaacttgaggaacgtcacgaccgagttgatcttcgcgaacaccttgaccccgtagatgttgatcgcgaagaacacgaccagcaagatcgcctccacgacaaagtcgaggccagtgttgttggcgaacgctcggatgtagtgctctgcgtactggacgaccgcctcggcctcgatggcaggaacggccgcgtatccgaggaaggcgccccaactcatgatgaacccgaccagtgacccgtgggtgaagtgcgggaaccgcgtgatgccacccgcctcgggcaacatacccgacagctctgcgtagaccagcgcgatgaagatcacgatcaccgccgcgatcagccacgccaccaccgccgcagggcctgcgtagttggcagcgtacagcacgccgaagagccaaccggatccgatgatcgccccgagaccggcgaacgtcaggtcgatgtaggacatctcccgtcgtaaccggccccgccctccactgtggtcgctcgccatgcacaacctcccccgtgcgatcggcaaccttcggatctcgctccgaaggccgtacgcggacctgcccacgtacgccgcgaacgctagcagccgcgatgccgatgcgggatacggaatgcaacgaattcacgaaccagcaacggcccgatcgtgtcaccgtgtcctcgccgcccagcgagctatcgcgtcgacgctgcgtgttccgcgcaccgctggatcgggagcaggtgactccacccccgcctgaaggcggggacttcgggtgcgctgttcacgcacctgtggctcctaccgcaggaggaaccttggcggaaacgcctgccgccgtgcggcggcgactcgggccagaagccctgcccgcgctgtccaccgtgcgccccacggcaataccaccaccaacgagggcgatggcccgatcaaggatgttccgtgcggccaccgcgtccgcatgtgcggtatgaccacactgcacgcatgcgaacgatctcccgcaccctggcctgctcgctgggtctcggaccccgcatgcaggacaggtctggctcgtgcctgccggtggcaccgccacgagcagggagccgtacttcgggcacttgtagtccagttgccgacgccgctcgccaggagctatgtccaagatggaccggttgagtccggctttctgacggactctggtgccgggagcctcgaccgtgcccctggccgagctcgtcatgtgcttcacccgcaagtcctcgatggcgacgaggctgtggttcttggccaagtcgctcgtgagcttgtgggtgaagtcctggcgtctccgggcttggcgagcccggagacgtgcgatctcacggatcgtccgacggagtcggttcgagtaccggcctccgttgtgacgcttcgcgtaggtgagctggcgagccttacgccgttccaggccacggagccgacgctcttcgcctggggtgagcgtcgggggcatgatcctcggggcagactcgccagcgacgtaggcggcgcaggcaataccgaagtccacgcccaccgtgggtccgtcgttcacgggcgcgcggtgggtcgtggcgaggacggtgaagttcacctgccacacgccaccgagcagcggaacgtggccgaggcaagctcaccatcgagtgagcgcgagcgtcggaaccggacccaccccagcttggggaggcgcacttcggaccattttcggttgaggtggcggatctggagatcggaggccgagggccggaagcggagttggccgcgcctctcgaaggctggcttacgggcgcgtccttgccaccagttctggtgtgcccgatccacgtcacgaagtgcttgttggagaaggtgtgccggtggctcggccacccactcgacgcacgagcgcagttcagccagctcgtgacattgttcgcggtacgtcacctgcgccctcgctcttgaccacgccagttgccgatgctcgatggcgaggttgtgaatggcacggcgagtatgtgcccaggtggtcattctggctgcctggtgcgggctcggggagagccggtagctccgaccgacgtactcgcccacgtcaccaacgctcgtcagcgtcatacctgcaaggaggggctgttcgaggtagtgccctacgtcgagtaacagcgccgaccagcatgagagcgccgcttacctcccgcctcgaggcgggagtccgcgcggcgcgttgtggtcgccgtcactgcctcggcgatggactcggtccgaggcgagcggtcgctcgagcggcgagctgacggtggcgcgacctcgcggccctggacccccgggtgagggcaccgacgcgtcactcgagacggccgctggatgcctcgacgggtgcatcgagaccgaggtgcacgtatgcccggggcgttggcattcggcccctcggcgtgcgcacgatgaggccacgctggatgaggaacggctcgtagacctcctcgagcgtgcccgcgttctcccgcaccgcaacggcgagcgtcgaaagtccgacgggacgcccagggaactggacgcacagcacccgcaagatctcgaggtccacgcgatcgaggccgaggacgtcgacgccgaagaggtccaaggcctcgagcgcgagctcacggtcgatcgcaccgtcgccgcgcacctcggcgtagtcccggacccgacgcagcagccgattcgcaagcctcggcgtgccccgcgatcgacgagcgatctcgagcgccgcgtccggctcgatcggcaccgagagggtgcgcgccgcacgttcgaccaccgcaacgagctcgtcgtcaccgtagtagtcgagccgatagtggtagccaaagcgatcgcgcagcggcgccgagatgagcccgacgcgtgtcgtcgcgccgaccagcgtgaagcgcggcacgtcgagtcgcaccgagcgagcacccggccccttgccgagcacgagatcgacccggaaatcctccatggcgccatagagcagctcctcgacggcccgggggagtcggtggatctcgtcgatgaagagcacttcaccaccgtggaggtcggcgagcaacgaggcgagatcaccgatccgctggagcgcggggcccgaggtcacgcgcacaccggtgccgagctcgcgcgcgatgatgaaggccaacgaggtcttgccgagcccgggagggccggcgaacagcaggtgatcgggcgtctcaccccgaccacgtgcggcctcgagcagcacctccaactgtgccttgagctcccgttggccgatgaagtcggcgagacgctccggccgaaggctctgctcgagcgcccgttcgagcggatcgagcgcgatggcgtccgatccggctgcgcggcgtcctccggcccactcgcgacgcggactcatcgagccagctccttgagcgcccagcgcacctgggcctcgaagtcaaggtcgccggggcaccgccgcacgacggcgtcgatctcgcctggccggaatccgagttcgccgagcgcagcccgcagcgcggacacctcctggctcatgggcactcccgtcacgggcgcgaggcgcttcgcggtcggcgcaagctcgaggacgacccgcttggccgtcttcggtccgacgccggcgatcgcggtgagccgcccgaggtcctccgtggcgatggcggtccagagctcgtcaccctcgatcccgccgaggatgccgagtgcgagctgcgggccgaccccactcaccccgatgagcgcatcgaacgcctctcgctccgcctggctcgcgaagccgtagagggcaatggcgtccgcccgcacgatcgtgcgtatccagagctcgcactcatcatcgcggcggagcagcgtcgcccacggagcagtcacgtgcacttcatagccgacgccagcgacatcgatcacgaccggtgagcgcccggcgctcgccacgcggccgtggagccacccgatcatcgctcccaccgccgctgcgcgagccgcgtataggcgatcgccatggcgtcggcgacatcgggcggctgcggcggctcgtcgagaccgaggagccgcacgacggtccgctgaacctgctccttggccgccgacccgccgctggtcgccgcgttcttgaccgtgttcggggagatgtcgtaggccaccaccccacgccgccagagcgcgagacgaacgaccccgacgacctcggacaccgggagcgccgaggagacgttgcgcgtgaaggcaagacgctcgatcgccgcctccgtcggatcgaaatcgtcgagcacgctctcgaacccctcggcgatctcgtgcaaccgactggcacggcatgcccgtgccgccgtcgtcacgagacccgcgcccacgagacgtagggtatctccggtcgcctcgatcaccgcataccccaggcgtgcgagacccggatcgacgccgaggatgcgtagcctcgcctcaggcaccgacggcctcgcgaaccgcctcgagcagctcatcggagggacggaacgtgagtccagcccgcgcgatgtgcaggtagatcacccgctggtcgcgatcgagcacgaagacgctccgccgatagaagccgagcggaccgagcacgccataggaccgggccacctcacgatcggtgtcggcgagcagcggaaaggcgatcccacgtcgctggacgaagctctcgtgtgaatcgagaccttgcggcgagatcccccacatcacggcaccgagcgcgcgaaagtcatcgatggaggctgagtaggcgcgcagctgggccgagcacaccggcgagaagtcctcggggtagaacgcgagcacgaccggcgtcccgcgttgcgctcgcaggtcgtagcgctgtccaccggtgccggggagcacgaacggcggcgcttcgtccccgagcctcacctggctcactcggccacgaactcctcgaggagcgactcgggcatgtcgaagttcgccgtgacttcttggacgtcgtcgaggtcctcgagcgcctcgacgagcctgaggacccgacgggcctcctgggggtcctcgaccgggacggtggtctgcgggaccaactccacctcggcgctctccaccgcgaacccagcggcttcgagcgcatcacggacggcaccgagatccgacgccgcgacggtcacgagccacgcatcgccgtcgtcggtgaggtcttctgcccccgcggcgagtgccgcttggaacaactcgtcctcgtcagcgtcgcgcgagagacgaatctgtccgagacgctggaactgccacgacacggcaccgggctctgcgagcgagccgccgttgcgcgagaaggctgcccggacgtcggcaccggttcggttgcggttgtccgtcaggcacgacacgatgatcgccacaccacctggggcgtaaccctcatagttgacctgctcgtagcgagcaccttcaagctcaccagtgccgcgcttgatggcgcgctcgatcgtcgcctggggtaccgaggcgtctcgcgccttctgcaccatggtacgcagcgtcgcgttcgccgaggtgtcgcctcctccttcacgggcagccacctcgatctggcgaattagcttggcgaacagcttgccgcgcgccttgtcgacggcgcccttcttgtgcttgatcgtcgcccacttggagtggccggacatggtcctccttgctacccatacgtgcccgtcaccgggcaagcagagcttactcgtgccgcacgaggtgtcttgagatgtcctcgcggcgtgcgccaccccgcgcgaaggcgaggacatggagccgtgcatcaccgagcaactcagggtggaacgaggtcgccacgacgttcccctgtcgcacgacgaccggcacggttcgctcggatccatcggcgaactggtaggccacctgggcgaccacgtccaccgaggatcccacacgcgtcacgacgggcgcacgaatgaacacggcccgcatcgggccgccgtcgacacccacgacggtgagatccgcctcgaaggagcgcacctggcgcccgaacccgttccgtcgcacgtcaacgtcgagcaccccgaacgaccattggtcggggcgccctccctcgatgccacgagcaagcaagatgagtcccgcgcaggtgcccagcgctggcatgccctcggcgagcgccgccgccaacggctcacgcaacgcggccgcctcgatcagcaaggcctgcgtcgtcgactcgcccccgggcaacacgatcccgtcgacagcggcgaggtcggcgagacccttgacggggcgagctgcgaggcccgcagcggcgagagctgcgaggtgcgcgtctgcgtcgccttggagcgcgagcaccccgatcatcggctcaccaaccgcgctcggcgagtcgctcgtcgatctgatcgagaccgaggccgaccatcggctcaccgaggttgcgcgacaccgcgagcaccacgtcgggctcgttgtagtgcgtggtcgcctccacgatggcacgtgcccgcttggcgggatcaccgctcttgaagatgcccgagcccacgaagttcgcctcggcgccgagctgcatcgtgagcgccgcgtcggctggggtcgcaatacctcccgcgcagaacagcggcacagggagcttgcctccgagcgcatggacctcagcgacgagttcgtagggagcgccgagtcgcttggcccatccaaagagctcctccgggcgcgcctgggcgatggctcgcaggtcccgcgtgatggagcgcaggtgtcggaccgcctccacgacgttgccggtacccgcctcacccttcgaccggatcatcgccgcaccctcagcgatacgacgcagcgcctccccgaggttggtcgcgccacagacgaacgggacctcgaaggcccacttgtcgacgtggaactcctcatcggctggcgtgagcacctcactctcgtcgatgtagtcgacctcgagagcctcgagcagctgagcctcggcaaagtgcccgatgcgaaccttggccatcaccgggatagtcacggcgtccttgatctgctcgatcagggcggggtcgctcatgcgtgcgacgccgccatcacgacggatatccgcaggaacgcgctcgagcgccatgaccgcgaccgcacccgcatcctcggcgatcttcgcctgctccgcgttgaccacgtccatgatgacgccgcccttgagcatctcggcgagtccccgcttgactcgtgccgtgccgacttcgtactgggtcatggctcctcccttcgaacctggccgctccttgtgtaccagagtctaggagggccgtgtaccacacactcgctcagacgtcgatcggtcgacgtcgggtcgcccacggctcgtcctcgatggcgtctgcgcgcgccaggagttcgtcagcgttcatccccgtcgccgcccatgcccaccacacgagcccggccgtctcgcccgtcggctcctccgcgaggcggcgcaagagccgtgcgacgaccggagggtaccgagtaactgcacacgcgaccaggtcgagctcccacgcgagcgcgctcatccacgggcggcgccgaccgccaccgaggatccgatcgatccccatcgcgagcgacaacggcccgagcaatccaagcctccacgcggcgagcgtgcggaccactagcgcctcgagttcgaacgacgacgcgagccgtaccgccccggcggtcagcacgacgagcggctccccgcgacggccacggaccaaggctgcgttcacggcgtcgccctcgatcaccgcaacctcggtggctccgagcccgagcagcggctcgaccccctcgacgatcgaggcgagccgcgcctcgtcggatcggctgagcgcggctcgcctccctcggggcttccggggcaccatggcgacgaccaacaccacagcggccacgatgatgacggccaccaccccaccgagggcagcggccatggcggtgagccctaggagcgctcccacgacgcccaccacgacaccggcaccgatcgcaaccgcggcaagacgcgcgagagcccccgtgagcaccactcgacgccgcaacggccgccgcacaccccacagctcgataccacccgtgttcacgtcaccgacccctctcgactgacccgctcgacgagctcgaggtagcgacgagcaatcgagccgatgtcatgggcgtgtgcgcgctcgtagcctcgtgcgacgagcacacgccgacgatcgcgatctcccactatcgagcgtattgcgccggcgagcgccgatggatcgtttggctcgacgagcacccctgcatcggcgacgaccggccggtagccctcgattgcactcgcgaccaccaccgctccccgcgccatcgcctcgaggagcaccacaccgaacgactcgccgccaagcgacggcgcgacgaggacctcggcctcccggtaggcacgatcgagcgtcgcgtcgtcgacgcggccccgccacgtcaaccaccccggccagcgctcggcagctcgacggacgagcggggcgagcgggccgtcgccaacgatcacgaccgacgacaccgagtccaccagcatcggcagggccgcgagcaagacccgaatccccttgcgctcctcgaggcgcccgacgaacgcgacggagccgggcctgcgtgcctgatcatccggcaccgcttcgggcacgctgagcccgttcgggatgatctcgatcgggccgggggcccatgcgcgagcaaccatcgctgccgatggcgagaccgccgtcgcgacgcgtattccccgcgcccccacgcgaccaacacctgcgagcagagccctgccaaccccacgcggcatccctgcgcggtgcccggtcgcgatgacagggatgctcgcccgacgggcgagggcgatggtcatcggtccgaccaggggcacgagcggctcgtggaggtgcacgaccgtcgcgcctcgcatcgctcgcgacagcgaccggaccatgcgcagatcccagccgatcggggcacgggacccgttggcagggacccgaaccgaccggccgagaccgccctgcccaggtccgaccagatccaccgacacccccagctgcgagagggcgcgcgtgagcgccgcggcttggcgctgcacgcctccgggaacgtcgaggtcgtaggggcacacctcgaggactctcacgaggtccgcctcacgtcgtcacagtgcgagcatcggcgaccaggttgtgccattgactcggtgcggcctggatctggcgctcgagtgcgcgcaccacccgtcgatgaagctcctcgatgcgagcctctcgtgacccctgcgtcggcggcatgatcggcgcccagatccgaatcaggtgcctccgtcccggcagctggtagcacgccgccgggtagaccggcgctcccgacaacaccgacagcaccgccggcccggctgccaccgagaccttccgaccgaacagttccccgggacgacccgaaccggtgacgtcgcgatcgaccacgagcgcgacgcgcccaccttcccgtagggtgcgcaacagagcccgagttgcctggacgccggtggggacgacgcggatgccgagcgcatcacgcagtcgatcgaagaagctcgtcaccgacgcctcgggaagtcgctcggccaccgccgtgacgggtgcgccggcggccgacgcccacaccccggcgacgtcccagttgccgacgtgcgccagggcaacgatgcagccttcaccgcgcccgaccgcctccaggaatgcctcgtggcccgtcacctcgacgccgtcgagcagacgcgccatcgcgtgaggggctcggagcgtgtcgacgtagtagcgcgcataggacacataggcccgaagcgtccaggcgatcgcccgcggatcgctcatcgggcgtctccgcgccaagcactggtgctcccaggcgatacgccgccgcgatccggtcagcacaaaggcgatcgccccaccgacccaccagacgatcggatcgagtcgccacggcagccgtcgcaccaacgcagaggcgatctcgaaccgtcgagctcgcagaccagcgcgcagcgaccttgcggtccgcaccgcctaacgcgcgtcgcggcgccgccgacgccgagcagtggtcacttcccgcgacccgagcaaaccgctcagacgcgtccgcagccgcgcccgccgccgccgattctcgcgtcgcagcgcgacgaggcgctcatgggcacggagccgatctggctggcccgaagccgagcgccagatcctgacgaagcgctgtgcagccgtccaggtcgacccgaggagcagcacccacaccgcgatggggagcagcgcccacacggcgatgccgaggaggaggacgaccgagcgctcagcgcgctcgaagacgccacccttggcctggaaaccgagcgactccgccttggcgcgctggtacgagatgagcgacgccgcgagagcagcgccgaaggccgccacgccaagaccaggctgatgctcgacgagcaccaaaccgaccccaagtcccccgaggaccgccgcgtcgctcacacgatccgagaccgagtcgaagaacgcgccgcgacgggaagcagccccactcgccttcgcaacgggaccatcgagcaagtctccgaggaagccgacgagagccagtgcaaggcctacccagcgtgcgccgaacgcgagcgcgaggccggcaccgatcgccgcgacgatccctgcgccggtgagcacgtctggtgtgatcccgagccgcgcgagctgacgaccgaccggcgcggtcgcccgatcgacttgccccctgaactctccgtccagcacctccggccactccttgcgatcgcccatccgatgtcgtcgtcgctgcaacgcatctacgctcggacaacgctacggcgtagcctaccacatcgcctccacccgcctgtgctggtcgcacggggcgtgctatggtgggccagctgcatcgacagcttgggaccgacgggaggtgccgtggacgccactgtcgcagcgagcccgcgtgctcgcatcatctgcgtcgtcggacctgcgggcgtgggcaagaccacgctcgtgcaggcgctcgccacgctccagtctccaccgacgcgcggcgacgacgatgcccgcgcactgatcgacacgtcgccggaagagcgcgcgcaccaccactccgtcgacctgggcgtcgtacgcctcgagcaccgaggccacgcgatgaccctgctcgacgtccccggtatcggtgagctcgccgctgcgcgggcacttgcactcgccgtcgccgacgcagcgctcgtcgtggtgccacccagcgacagccccagcccggagctcctgcgcatctggcgcgagctcgacgagcgccaactgccccgcttggtggtcgtcaatcgctgcgacgacagccgctgtgcgatcgacaccgtcgtccgtgccctcaacgagcgcctcgaggcccatctcgacgccgtcgagctcgtcgccatcaccgccgacggccatcaggacctcatcgacgtgctcgcggaggcgtccatcgtcggcatcggcactgacgagcacctcgaaccgctgcccgaggtcgagcgcgagttcgagcgccaggcacacgacgccttgctcgacgacatcgtggccgaggacgacgccctcctcgagcgctacctcgccggtgaggagctcgacccgaccgagctcaacgctgcactggcgatcgccatccgcgagcggcacctgacccccgttctcgccgcgtcggcgaccacgcgtctcggcctcacccatctcctcgacatgctcgatgccctggtaccagcgtcgccgacgccaacggacaccacgagcgcgctggtcatcgccacaagctccgacaactttcaaggtacgtccgcgacgctcgccatcgtccgcggcgccatccggcccgacagcgtcctgcgcgactcggcccaggaccgcacggagcgactccatcagctgctctggccgaccctgcccaagcctacgccgacgacggaggccgccgcgggtgacgtcgtgatcgcccccaaggtgggggccgcggtggggacctggctcatcgatcctgctggccacgacatccccgatccagtgcagcgcccgacaccgacctacacgctcgccgtcgaggttcccgaccagcgcgccaacgacaaggttcaagcagctgccgctcgcctcgccatggaagacccagggctgatcgtcagccgggaggcagagacccaccgcctcttgctcaccggcatgggggcgacgcacttggctctggtgatcgagcgactcggccgccgcagcggagctgcgatccagacggtcacgccacgcacgccctatcgcgaaaccattgcgggcacggtcgaggtggaagggcgccacaagaagcagaccgggggccacggccaatacggcgtcgtggtctgccgcatcggacccggacctcgtgcgagtggcgtggtgttcttcgatgagatcgtcggcggggccataccgcgaaccttcattcccgcggtcgaggcgggcattcgggaggcgtgcgagcaaggtggtccgcatgggttccccgtcgtcgacctcgaagtccacctcatcgacggcaagcaccatccggtcgactccaacgagctcagcttcaagcttgcaggggcgctcgcgctgcgcacggccctcgagcgagcagggagcgtcgtcctcgaaccgatcgcacgtgtgcacctcagcgtcccggcaagcgcacagggcgacgtgctgggctacgtgacgtcacgccggggtcgcatcatcgagtccactccggtcgggccgagcgtcgagatcgaggcagaactgcccgctgccgaactcacgcatctcgccgtggacctccacggcctgacggcgggccagggatcgttcacgagcacgcacgaccgctacgagcccgtcccaaccgcggtcctcggacgcttgctcagcgcgacatccaagtgacgccgccctacggcccgactcggcactccctccctggcaactcacggtcgacgaccacacctctgcaccccgtacacccgagaaccgtgcgttctgcggcgctcggagagagcggtatcgtgaccaccgatcctcccttgcccaaaggctgtgatcgagtcggggcacgccacggtgagctggtgcgactcggtggcggcagccggacctcggagtcgctcggcaagcatgtcgccatggccgcaggcagctggcggtggtggctcgtcgagccaccaccgggtgcgtaccactccggccgacgtcggcagactcgatgaacgcacgcacagtcagagggccagtcgtgcgcgccgcgatccgctcctttcggcaggggtccatccgctccagtgaacgacgaggtcccccgcacggctcacgttggcctttgcacgcggccttcacgacgcgcgggagcacctccgctccaacaagccgagagcgacggcggcttgcacgcgggcgatcggctccgccacgacgctcaggcctcggctctggagggctctcacgaggtcacgctgcgctccgctctcgttcggaacggcactcgcgccgtccgacacctctcggcacgttctccgcgacggcgaccacatggagctcatgtggccccaacagatcacaccacgcggatcggtgactcgacaagggacgaattacccagcgttgtcgatcacctcaatgcgattcccaaaggggtcgtcgacgtataagcgccggactcccggaaggtcttcgtcccaccgccaggaagcgcccgacgcttcgagcttcgcaacgagatcgtccagctcctccactcggagggcggggtgcgccttgcgcgccggcctgaaatcctcctccaccccaagatgcagctgcacgggcccgcacgcaaaccagcggccaccacgagctgcgagcggctctggcttcgcgaggacagtgaagccgagtacgtcgcggtagaacgcttctgcctcgggctcgcgaccggctggcatggcgagttggacatgatcaagggctacgactcggacgcccacgacgtgaatcctcccacccacgctcgactcgtgccgcgcccggcgccaagcgctcatcaccgctcgcgaccactgacgccgagaacagctggacgcctccttcccagaggcagcctcagacaccgcagtgctcgtcctgtcaggtgccaagcccagcgaggcgttgtgcatgccgggcaccgacgtcgatctccatccgtcgtgccactcgcgaccacatcccgcgaggggtcgtccccaggtccgcgcctcttccccagagacaccgtcgcggacgacgagcgtcacgacccccgcggccaccgctcactcgagcggcgcgcgcgacccacaccactgctgcgagtccagaaggccgatcagctcacggagcaactgccgtactcgggcccggcgccggcgtcactacgagctcgccggccacgcgcggcgcaaccgatcgcgcgtgtccccgagtgcctcggggaggacccgtgtctgcgcggcggtcaccatgaagttcgcgtccccgacccaccgaggaacgacatggacgtgcaggtgctcgacgatacccgcacccgatgcccgaccaagattgaggccgaggttgatgccctggggatggtaggcgctctccagcgccgccattccctcgcgcacgagctcccacatctcgccgagctcctcgtgcgagagcgcgccgaggtcgctgccgtgccgccgcgggaccaccatcaggtgccccgacgtgtacggatagaggttcagcacgcagaaggcacgcgcgcgacgagcgaccacgagatcatcggccccatcggccccgtcgccgatcgcgcacaggacgcacccgtcgaccgccggagcaccctgcgtgacgaacgcggagcgccaccccgcccagaggtagtccatcacggacgcacctccgccatggcgaccgctcgtgcgatctcgtcgatcgccgtctcgagcgcgacgccgcgggcctgcgaccgatcggggcgcgtcagcccgaccgaatgcgcagcgacgtcatcgttgcccacgaccacgatgtaggggactcgctcggtccgagcacgtcgcacccgtgccccgagcggttcgtcggccgcgaccacctgagccccgacgcccgcagcaacgagcgcagcacgaacctcctcggcccagccggccgcctcatgagccaccggcaaaatgcggaccggttcacgcacgagccacggcggcagctcaccatcgaagtgctcgatgaggatggcgaggaagcgttcgacggacccgaagagcgcccgatgaatcatgaacggacgctccatccggttgtcagcgccctggtagccgaggtcgaagcgctgcggcaactgcagatcgacctgcaccgtcgagagctgccagcgccggccgatcgcatcacgcaggtggatgtcgatcttgggcgcgtagaacgcaccctcgccctcggcgacccgataggtgagccccgaccgctccagcgcgctccgggcggccgacgtcgcgaactcccagtcctcgtcgctgcccacggacttggcgggccgcgtcgacagctcggcctcgaagtcgttcagcccaaaggcgccgagcaggcgcatcgcgaggtcgagcaccccggtgagttcgtctgccaactgatcgccgcggcagaagatgtgggcgtcgtcctgcgtgagcgagcgcacccgcgccaatccgtgcaaggtacccgaacgctcgtagcgatacaccgtggccagctcgaacagccgcagcggcagttctcggtagctacggggatgctgccggtaggcgaggatgtgcatggggcagctcatcggcttgaggaagtactcctcgtcgtcgagctccatcgccgggtacatcgactcgcggtaccagcccaggtggccagagagctcgaacaaggcgccgcgcgtgacgtgcggcgtccacaccgggacgtagccggcggcaaagtggatgcgacgggagaactcctcgagacggtaacggacccaagccccgtcgggctcgaacacggggagaccgccgccgatctcacgagggaagaagaagagccgctgctcctgaccgagccgacgatggtcgcgccgctcggcctcggcgatctgcgtcagccacgcctcgagcgcctccggggactcgaacgccgtccccgcgacgcgctggagccgtgggccgtgctcgtcgccgcgccagtacgcgccagagaccctgagcaggcggagggccgagagatggccggtagagggcacgtgtggccctcgacacaggtcgatgaagtcagcacccgtgcgatagatcgagaccgcagagcccgaagcggcatccgtctcagcctcgccagcggcgatgcggtcgaggatctcgagcttgaacggttggtcggcgagctggcgccgagcctcgtcgagctcgagctcgatgcgctcgaagggttcgtcggccgcgacgatgcgttcgacctcggcggcgatcgcggcgagatcgtcgtcgtcgagactgcgtcccccggggagctcgacgtcgtagaagaacccctcctccgtcgccggtccgacggcaaggtgcgtacccggccagaggcgcgagatggccttggcgaccacgtgcgcacccgagtgacgaagcacctggcgaccctcgggtgtcgaggcagccacaagggtcgcacccggaccggctcgatcgagatcaacgagctcgccgtcgtccgagcgcgccgcgaccggtcgagtggggtcgacgaaccggctcacagctcgaccccgagcatccgtgcggcctcgctcacaccccgacccgctcgagccgcccggtcgatggcctcgagtgcacccggggtgtcgaggtcgttgtcgagcgccgcgtcgacctcgtccacggcaccgtccccggtgccggctgcgcgccagagcccatagcgctctcgcgcctcctccaggagcccacccgtccagtcccacgacgtccggtagtgctgcgacagcaacgcgagccgtaccaccgcagcgggcacttccttgaggagctcgcggacgaacacgaggttgccgagggacttggacatcttgacgccgtcgagccgcaccatgccgacgtggacccagtggcgcacgaagggttcgccggtgatggcccgcgactgcgccgcttcacactcgtggtggggaaagatgagatccgaaccaccgccgtgaatgtccaccacggggccgagctcgcgcatggcgagcgccgagcattcgatgtgccacccgggccgacccggaccgaaccgcgactcccaggcgggctcgtcggccaaggacggctgccacaacacgaaatcgagaggatcgtgcttcctgggatcgtcgggatcgccgccacgctccctggcaagtgcgatcatggtgtcccgatcgaggtgggagatcgatccgaacgtgggctcgctcgccacggagaagtacacccatccgtcgacctcgtaggcgtgccccgagtcgacgaggtcctgtaccagggacaagatctccgcgatcgccgaggtcgcgcgtggctcgaccgccggccgtcgcaccccaagggccgtcatgtcctgatcgaactgcgcgatctccatcgcggcgaggtcgaggtagttggtcccgagctcgcgcgccttgcgcaagatgtcgtcgtcgacgtcggtgacgttgcgcacacagcgagcgcgctgccgatggcgctcgaggtgtcgtgcgagcacgtcgaaggtcacgtagaccgccgcgtggccaaggtgcgcggcatcgtagggcgtgatgccgcaggtgtagatcttgatctcctcgcccggtcggagctctaggtccacgacccgttgcgcttgtgtgtcgtagatcctcattggccgtcgtcctccctgatacccaccactcgcaggctcgacctcgcgcgatagcgcaggttcacgttcagcagcaccgcggtcatcgcctccagtgcgccggccgcggcgagcgaaccgacatagagcgctcgcagaccgtcgatgctcccgaggagctccatgacgacaccagcggagctctggaagtccgaggccaccatggtgtcggcgtgcacggggcgcccgagctccgcgagatcgcgggccggcacgtggtgcagcgccgcgaccaccatcgaccgcgggagcgtcgactggaggagctgggccaccgatccgcgaggcggtgccagcgctgcgaactccgatcccgtacgcaccaacgcattcgcgacgcacaccacggtcttggccgcaagcgcctcggcgaactccgccgcgacaggcacgacgctctcccagggcacggcgaccacgacgagatccgagcgagcggcaagctcgttaccgcccccgaccagaccatcggcgagctggggccagcgatcgccgagccgactcgccgactcttgcgcgcgctccggattgcgcgagcccagcacgaccgtgcggcctgcctcggcgagtcgagcaccgagcgcactgccgagcggcccggtcccgccgatgatgccgacatccacgaacgcccccagagtcccatcacgaggacgccgctggggcaggactcgcaggccccaagcggctaccgtaggtccgagtctacggtgaaggagatcacatgggcatcctcgagggcaagcacgtgctggtcactggcgtcctcaatacctcgtccatcgcgtaccacgtcgctcgagtcgccatcgacgagggtgcggaggtctcgctctcgagcttcgggcgcgccatgtccatcacccgacgcgtcgccgagaagctcggcatctcctccgagatcatcgagctcgacgccgccgatcccgcgagcgtcgacgcagccgcagccacgctcggcgagcgacacgaccgtctggatgcgatcgtccactcgatcggctatgcgccgccgagctgcctcgacggccccatgctcgatgccccgtgggacgacgtcgcggtcgcggttcgggtgtcggcgtactcgctcgccgagctcgctcgcgccttccgaccgatccttcgctcgggcgaccatcccgccatcgtcggcctcgacttcgacgcgacggtggcgtggcccggctacaactggatgggggtcgccaaggctgcgttcgagtcactctcgcgctatctcgcacgcgagctcggtgccgacgggattcgcgtcaatctgatctcggcgggcccggtccgcacgatcgcggcgaagtccatcgacgcgttccgctccttccaggacagctgggccacgcgcgcaccgctcggctgggatccgaacgacgccaccccggtcgcacgcagcgtcgtcgcgctctgctcagacttcttccccgccacgacgggcgagatcatccacgtcgatggcggctaccatgcgatgggtgcctgagggcaccgagatcgctgcggctcacgtggccctgggcgttccgcccgacccaaccaggaggtgcaccgatggtgcgcatcccgagcacgctcgccagctccttcgcgatcgcagcttcgcttgccgccgcgagcgcgatgtcgttcgctcagccggccggcctccgcggcggtcagagcggcaacggctggaccgtcaccgcgaccggcgcgtcatcacacacgacccccactgggccgaaccctggcctccagcccgtctactggccggtcctcgtcacgcacacgggttcgtcgctcgcgacgagctgcgtcgaggtacgcacgctcgacccgggcgcgggatcgtatccgaccgtgctccaggcggccgaggccgcatgggcgcatcttgccggcgtacctcgctgtgatgcgagcgggccgtcgccgtcggccatcgtcaccctctggaccaggaccctcgcggcgacgctgaccccgccgagcgccgctgtctggccacccagggggatcgtcggcctgcccctcgaggtcacggtcgccggagcgaccactcggacgttcaccacgcagacccctgcgggacccctcgtcatccgggcgaccggagcactcgcggcgcagctcggttcagcctcgatcaccctggcgagcggcgacgccacgctgaccccggacgtcgtcggtagcgtccgcctgctcccgatcgagacctgggacgccgtagcgaccctcgggacgaccgagctcgcgctgcccgccgtcacgatcgtcggcccagccaagctcgtctcgatcgccgcactgcacgccgagctgcgcagcctcgcctagcgaacgcagcgagcgccaaacgagccgtcaccgacagcgtgcccgcacccgaggcaccaccgacgagtggccttgtctggactcaagcgctactggtcgtcgaggtcgtcaccgtggagcgtcgaggcctccacgtgggcgacgggttccgtccccaaccggcccgcctgatagtcctcgaacgcttgacgaagctcagacctcgtgttcatgacgaacggcccgtaccacgcgatcggctcaccgatcggggtgcccgcgagcacgaggacctgggtccgtcgcctcggggctgcgagtacgaccccttcgccctcgcccatcaccgcgagatgaccagcctcgacctcgacgcggtcctcgccgatcagcgccgcgccgtcgaagacgtagagcaagcacgtgcgcacggcaggggtcggaatccgagcctccgcaccggcctcgaggatgaggtgagcgaccgtcaccggccagtaggtgtcagccggacccgagatgcccccgaggctgccggcgaccaccttgaccagcgcgccgccatccgcgctctggccgatcccgagatcaccgcctcgcacgtcctgatagcgaggggccgcccacttctgccgtctggggagattgacccagagctggaaaccgtggaagacgccaccggtcacgacgagccgctccggcgggcgctcgatgtgcaagatgccgctcccagcggtcatccactggatgtcgcccggggcgagcgcaccaccaccgccgaccgaatcggcgtgttcgaacgcaccctcgagcagataggtcaccgtctcgaagccccgatgcggatgccagggggtgcccttgggctcgccaggaccgtagtcgacccgtcccatctcgtcgaggtggatgaacggatcgagttcctcgagtggcacgccagcgaaggcccgcttcaccgggaaaccctcgccctcgaggcccgacggcgcggccgtgagccgcacgactcggcgccacggacccgtcgccctcaccagcacgtcagctcgcgtcacgttcgtcatcgggcctcctttgttgcagatgcaatcatagtcgctcgtgacggacgaggagggctcgcaccgctgcgacgtcctcggcgcggggaccgtcgcccgctcccgggacctcgagcaccacatcggcctccggcaggcgccgatcggcgacgagcgagcagagcgcctcggctccgatcgccccctcgccgatgttcgcgtgacggtcgcgccctcgaccacgctcactggccgaatcgttgcagtgccacagcgccacgggcacctgtgccgcctggagcgccgtgacgatctcctcgcgccccgcggcttcgtcgatggcccagccgacggcgaacaggtgctgggtgtcgagacacacccccacccgcttcgtccggagggccccagccagggcccccagctcggccggaccggacgccaccgaacccgtcgccgggttctccacgagaatgcgaatcgtcgacgtcgcctcgagcacgcgctcgagcccctcccggatccgctggcgcgctgcatcagggtcgtcaccaggcgcggagccggcgtggacgaccaccgactcggcgccgatgccttcggcagcgatcgcggtctggcgaagcaacgccagcgatcgatcgcgcagcttcgcgtcgacggaggcgaggttgatcagatacgacgcgtggaccacgatccgttcgacgccggctcgctgcgccgcctcgcgcaccacatcaggctcgggcgccacgccgacggaccaccgccacgatcgaggggagcccaagaagcactgcgcaacgctcgcgcctcgctctccggcgcgttcgagcatcttgagcacaccgccagcggccgacacgtgacagccgacgcgcaccgtggcgaacctcccctgttgcaagtgagccctgttgcaagtgagccctgttgcaagtgagccctgttgcgagtgagccctgttgcgaccgggccctctgtctgggtccctccgtcttgctcggcgctgctaatcctcgcgaccgaactcgggcagctcgaccgtggtcgccgaacgcggcgactcggtcgcggccggcttcgaggatgcgccctcaccgaagaggtcctccagcatcgacagaccgtcatcgcgtgtcgtctgctcggcgcccgcgcccgcctcgtggcccgttggccggtcggccgtggcagcccccgcctcgtcaggggcgacctcggcccccgtgtccttggggccgtcctcagggctgtcgacatctggctcgccagccgacccgccggaccgagccccaccggcggcctctgcggcctcggcagcgagaccggccgcgtccttggccagcagggacccatcggccaccaggtcgtcgacgacggagcgagcgtgacgggcgagttcgcgcaagctgccctcgatcctgcccccctccgcctggagtcgctcgatcacgccggcgaggcttgcggcgagccgatcgctccgcgcacgcacctccgcggcctcacgctcgaaccgcgaccggaactcctcctccagtgccgcagctcgcgccttggcctcgtcgacgacacgggccgcctgggtcgccgcctcgcgccggagggcctcggcctcggcctcggcgtcgcgccgcaacgtctgcgccgtctcctgcgcgagtcgtagcgttcgaccgatcacgctgtccggatcgaggtccacctccacgccagcggcagactcctgggaacgctgctcgtcggcgagggcaaggcgtgcctcgagttcgcgaatccggcgtcgcgcgtcggcgagttctcgctcgagcacctcgacgccctcggccacgcgctcgaggaacgcatcgacgtcatcttggtgatagccgcgcatgcgttcgcgaaactcgacctcgcgaatcgcacgcggattgacgacatgctcgtccatagcgactcctgtttcgtacggctgcgggcgtctcgggccagagcgcggcggttaccgagcgatgatcgggatcaacaggagctggatgaccaagatcacgatgagcggagagagatcgagccgcacccctccgccaccgatggcgggcatcacacgcctgatcggcccgagcaccggctcggtaagccgcccaagaatgatgcggatctcatggagcgtaccgccgggattcgttaccgggaaccagctcagcacgaccgagagcacgatgatgatctcatagagctccagcaggtcgatgagcagtcccctaactcccatgctgtagtccggcccctctctgaacggtccgctgtcgcatccggaacatgtcctcgtccgcaacctcgatgcgcgctggcgacaggaggtagacgctggaggagatctccttcaacttgccaccaagagcataggcaagccccgcggtgaagtcgatgatccgacgccgaagctccttatcgactccttcgaggttgatgatgaccggctgatctgccttcatgcgatcaccgatctcctggacgtcggcgaacttcgtcggcatgacgagatggatcttcgcccgctcgggctgagcactcaacgtccgcaacaccggttgggtgcgttcctcgtgctcccccgcatcctcgccctgacccatcagcacctgcaccttcggtgttcccacggtactcaccggctccgtgcgcagccgccggtccgactcgacgacgtccctgtcgaaccctccagagatggttccttccatctcctcatcctcctcaaccacgcccaaccaggcaagcgcgcggcggaacccgctcatggaacctccactccctccgacgcgctcaggttagcacgtgaaccggggcgagggccgagcaaagcggtccccaatcgcaggattgtcgcaccctctgtggttgcccagcgccaatcagcgctcatgccaaacgagcgctcagggagctccaactcgtccgcaagggccacgagcgaacggaagaacgtccgcaccggtgcttcctcacccggcaacgcgacacccatcacgccgacgacacgcagaccaagggatcgagcggcggcgaccagctccggagcgccttctcgcggcacaccactgcgagtcgccggagcgtctggcggtgccacctgtacgaagacctcgccgtcgaagccgagggcggcgagacgttccgcttcgaccactctcgagagcgtctcgaccacgctcgcagcaccactcacctgcttgatctggcgacgctgcaagtgaccgatgaagtgccaccggacgtcgagatcgcggagcgcggcggccttctccgcgagctctgacgcgtagttctctccgagctcccgattacccgcctccacggcggcgcgcaccgtttcgaccggatgggtcttcgtcacgcagacgatgcgaggcggccggaccggagcgagcgtggccacctcggcctcgatggcgcgacgccgctcgcgaagctgctcgacgaggttcatcgacccggcccgacgaggagcgcttggcgcgcagacgtgcgatcccgccgccaggagtaccaccgctcctcgtggatggtacaggcctcgagatcgacgatctctccgacaccgacacgcccaagctggtcgcggatcgccgccgtgagatcgagcgtcggacctcgaaagtactgggggccaagggtggtctcgacctcgctgcgagcgggcccgacgaactcgtagcagcatgcccgggcgtgcgccccgatcaccgcgacccggacatcgccgccgagcccctccgctgccctctcgacgatccggccgaccacgcccggccaaccggcatggaccaccgcggcgtcgccgttgcgtgcggcgaggaccaccgggacgcagtcagccgatcgcacgcccgcaacgagctgatcgccgactcgccggatgatcccgtccgcgtcgacgccccgacccacctcttgcgcctcgacgaccgccgtgccgtggacctggtggacccacgcacacggcagctcccagccgaacgcactcgctcgtggccacagctccgcggcatccccgtcgccacgctcggtctggaccactcgcagacgcccatcgagcagactcagctcgatcacggtcgtctacctcagaaagaaaggaacgtccccgtcgtcgtcgtcgggatccggctccggctcggccacgacctcacgccgcggagtgaacgtgagcggtggcagctcggcgtcgtccacggcgacgcgacgcgtcgcgtcgctctccgaccaggtgttgaacccggccgcgatcaccgtcaccttgacctgatcttcgagggcgtcgtcgatgaccgacccgaagatgatgttggcctcgtccgaggcggcagcctgcacgatctgggccgccttcgtcacttcgtgcagcccgagatcttgcccgcctgcgatgttcatgaggatgcccttcgccccgtcgatcgaggtctcgagcagcggtgagttcatcgcctggcgcgctgcggtctcggcgcggccatcgccgcttgcctggccgatgcccatgatcgcggtacccgccgagcgcatgatggtccgcacgtcggcgaaatcggtgttgatcacaccgggagtcgtgatgagatcggtgatgccacgcacccccgacagcaagatgtcatcggccatgcgaaaggcctgcacgagcgaggtcttctcgttcgcgatcgtcaggagacgatcgttcggtatcacgatcagcgtgtcgacgtactcacgcagccgactgatcccatcctcggcctgctgggcacggcgacgaccctcgaacccgaagggtcgcgtgacgaccccgatggtgagcgcaccgagcccgcgagcgatctccgcgacaaccggcgcgccgccggtccccgtcccgccgccctcgccagcggtaatgaagaccatgtcggcccccttgagggcctcctcgatctcctcgcggtgctcctcggcggcctggcgcccgacctcggggtccgaccccgcgccgagccctcgcgtcagctgtcgaccgatgtcgagccgcacatcggcgtcgctcatcagcaacgcctgcgcgtccgtgttgatggcgatgaactccacgcctcgcaggcccgactggatcatgcggttgacggcgttgccgcctccaccaccgaccccgaccaccttgatcaaggcgatgtagttcgccttcgcgtccaccacgttcctcccgccgccgttggcccctcaatcccccctacgctaccgtgcccacacggaccgcttagccggaacgcacgccaaacgtgccggagggtccaagggcgagcacgttggccccgagggccacgcccacgcctccgcttcccaccaacgcgccacagctcacgagctccccggcgaccagagcgggggccggcccgagcacgcacgaggcaccggacgccaagaccgcgacgacccggccgccagcgctcaccacgcggcgcactccaccccgaaccccgacgacgaccgcacgtgcggcgaccgggccgacatcactgccgacggggggagggcacgcaccgcccgagcacagcgcaagatgaggctcgacggacgacgccaccgccggcacggccacgacccgtcccgacgcgagcagcgcacggccctcaccgagcgcgaccacgcccgttcgggcgcgcacgcgcacgatcacaccgtccggcaacacccgtcggaccgcgaccaccgccacgatcgggcgctcctcgcccagcatggcggcgtcgaccgccggcactccgagcacgagcggcgctccggcgagccgcgcgtcgagcgtccccgcgacggcgcggtccatcgcctgcccgagcccttcgacgcgaacccaccgaacccgcatccacggaccccacacgacgctcaccgcggcgccgacgcccagggcgagggccgtgagtccgatcaggactcggcgccggatgcgcctcgatcgttcgcgtcgtgcgtcgtcgagtcggtaaatccgacgagacgcacctccgtccgcagctcgactcccacccgacgagcgacttcggcgcggacgaattccatcaacgctcgcacgtcgtcggccgagccccccggatcggcctggatgaagttcgcgtgcttcggcgacacctcggcgctgccgaggcgataccctcgaagacccgcctcgtcgatcagcttggctgcgggagcctccggcgggttcacgaagaccgaccccgcgttgtgaccgcccggctgatgtgcgcgtcgccatcgcaccacctccttgatcatcgcctcttcgtgggcacgatccccgcccgccaactcgagctcggcctcgagcaccacctcggtgggaagcagcgcactgtggcggtagccgaactcgagcgcctcgcgactgcgtcgtctgatctggccgctcgcgacgtccgcgacgaccgccgagccgagcaccgccgccatgtctccgccgtggccccccgcgttcatgcgcaccgcgccgccgacactccctgggatgccgaccgcccaggccatacccgcgcgaccgaccgcggcgagtcgtcgggccgcgacgggcaggagcacggcacctccgaggatgaccggaccgtcgctcggggcctcgatctcggcgaatccggcgccgagctcgacgagcagcccgtcgaagcctcgatcggcgaccagcatgttcgatcccgcgccgaggacgaggatcggcaccttcgccgcacgaacgagcgcagcgatcgccgcgacatcctcgacccgctcgagcacgacgccccagcgagcgctccccccgacgcgataggtcgtccgcgcacccaagggaacctcacggtgcacctcgatgccgagctcgccgccgagacggacgagatcgctcacccgagcaagtcctcgagctcgctgtcgaccatggtcacgtcaccggctcccatggtcaggaccacgtcgcccgggcgcacgacggaggcgacgaaggcagccagcgcgccacgatcggcgacccagtgggcgcgctcccccagtcgctccgccgcggctcgccagacgacctcgccgctcacccctgggatcggctcttcaccggccgcatacacgtcggtcacgacgacctcgtccgcatcaccgagcgcccgaccgagctcgacaccgagcaacttggtccgactgtagcgatgaggctggaagacgaccacgatccgaccggagcccagctgacgcgccgcctgcagggtcgccgtgatctcacccggcagatgggcgtagtcgtcgatgatccgagcgccacggagctcgcgcttgaactggaagcgccgcgcgacgcccacgtagcggcgcagcgccaacgcgacggcgtcgaagggtgccccgacgctgagtgcagccgccaccgccgcggcgccgttgcgcacgttgtgcatcccgagcacgccgagctcgatactgccgaggcgccgatgatcgaggaagcactcgaacgccgaatgggtcggcgtgaggacgggattgcgaatctgcagccgcgctgcctcggcgacaccgtaggtcagggccccctccggggcgagagccgccagccgtggatcgtcgacacagatcaccggtgcgagcgcgctgccgccgacgaacgcctcgaacgaggcgaccagcgcgtcgaagctgccgtagtggtcgaggtgatcgggctcgaggttggtcgccacggcaaggtgacggtccaccgcgaggaaggtggcgtcgctctcatcggcctcgacgacgaacaacgacccgatccccgcgtgaccggacgctcccgcctcgttgagctcggcaccgatgacccagctcggtgcgaggtctgccgcctggagcgcctgggcgatcatggccgtcgtcgtggtcttgccgtgcgtacccgagacggcgacgacctgcttgcccgccgtcagcgccgcaaggagctccgcgcgcgacagcaccggcacgcctcgggcgcgcgcagcggcgagctcgacgttggacgacggaatcgcggtcgaggcggcgacgacgtcggcgccgtcgatccagcgcgcatcgtggccgagatggacctcgaccccgatcgcctccaaccgctcgacgagcggacctcgcttgagatcggacccgctcacgacgaatccccgacccaccagcacgctcgcgagcgcgctcatgccggctcccccgatgccgaccaggtgcacccgacgaatcccctcgagcgacgtcactccagccatcgcgccacctcctcgacgagacgttcggtcgccctttcggtcacgagcgctcgagccgccgctcccatggccgtgcgcagggatggatcaacggcgagctctgcgatggctcgccccagcctctcggcaagcccagggccctcctcgacgacctcgctggcaccagcggcaacgaagtactccgcgttggcccgctggtggtcacccggtgccttcggcaacggcacgagcacgctcgcgacgcccgcgatcgcgatctcggccagcgtcgacgaacccgcgcgcgcgacgacgacgtcgcccgccgcaatggcatcaccgagccggggatcgaaaccgacgaccggctggtagctcgccatcgggtctggcacctgcggtggaacattgcgctcgccgaggaaatgccagaccacgacgtcgtcgacgagaccgcgcccgacgacctcgaccatcgcggtgttcaaggcgagcgatcccagcgagccactcgtcgcgaccaccagcaccgcgtccggcgcgatcccgagacgcgacctggcctcggctcgcggtgggagttcgcgcgtgggtggacccacgatcaccgcacgatcgcgcaccaacctcggcacccgtgcgggccacgcgaggacgagctcgctcgcgaacggcgccatcagacgattcgctcgacccagcaccgcgttctgttcgacgaggacgatccgcgcgcgccgtgcggcggcgacggcgagcgcgagcacctgtggcgccccaccgagaccgaccgcgaccgacggttgcggtgcagccaggaggcggcgaacgttctcaccgaatgcgccgagcttcggagcgcggcgcgcgcggacgatcccagcctccgcaagacgcacgcgctcgatcgcgtgtcctcgcaacgtcgcatcctcgacgggacgatcgctggtcacgagcagcacccgggcgcgggcaccgagcgcggtcgcgacctcgaggcccgcgtggagatgaccagccgtcccgccagcggcgacccacacgacgcgatcgctcatcgacgccgctccccacggtggaccgaggcgagcacgaccccgagcgcgatcgcctcgacgaccaacgacgaacccccttgcgaaacgaacggcagaggaacgccggtcacgggcaagagccccaccacggcaccgagattgaggagtgtctgcgccgccagccacaccgccacgagcaccgccaccgcatgcgcacccgacatcggcgtccgctcggcgagcgccagtaggccgaggatgatcccgccgagcgcagcgatgaccccgagcgcaccgatgacgccaaagtcttggaccacgagcgtcatgacgaagtccgtgaccgcattgggcacgtagccccagttggcgagtcccgctcccaggcccgaccccgtgacgtgggcggtggcgaaggaaccgagcgcctggacctcctggtacgacaggcttgcacgatagcgccatgggtgcagaaacgacagcaggcgcgcacgccgatacgccgacgagaaggcagcgagcgtcgcgaggcctccgcccgtgagcgcgatgggagcgagtcggcgaagcgggaccctcgcgacgaccagcgcgccggctccgatcgccgccaccaccagtgcggtgcccatgtcgggttcgatgaagatcgcaccagcggtgaccgccgtgaccacgagcaccgggccgaggacgcgctcgctgggtcgtgacgtgacgagcttggcgaggtagagcaccagcgcaagcttggcgaactccgatggctggatctggaacgggccgacggggatccatcgctcggcgcccccgacggtcgtgccgagcccagggaccatgaccgcgcccagccccgccagcgccgccgcgaggagcaccggcgaccacgcgagcactcgctcgaggccggcacggcgtacgaccacgaagctcacccatcccatcgcggtggcgatcgccacccaggcgacgtcgtggagggcggcggacaccggcgaacgcccgaccgctgcctgtgcctccacggtcgcggccagtccgacgagcgtgccggcgagcgcgagcccgcccccaaggccgacgatccagccgacggccgagccacgcccccgacggcgcccagagggccgaacacgtgcgtcgatcaccgccacgcccatcacctcccaagcgccgcaacggcgcggacgaagtcctcacctcgttcctcgaaactccggtaccaatcccacgaggtcgccgccggcgcgagcagcaccaccgtgcccggcagcgctcgctcgctcgccaccgccaccgcctcgtccatcgagttcgcctccacgatccacggcaccgcgtcgccgaggtcggccaccactcggtgggcactctcgccgatggcgaccacgccagcgatccgctccgcgacgtcgcggagccgctcgaaccccgtgcccttggttcgaccgccggcgatgagcacgacacgatcgaagctcctcaccgcagccacagcagcttccggcgtcgtggctttcgagtcgtccacgtaggtgagcccaccacgaacggccacgacctggagccgatgagcaagcccccggaactcgcgcgcgactcgacgcgcgcgttcgagctccgcgccactcgcctccgcaagcgcccaggccgccagcatgttcgcgacgtcgtgtggtgcacgacgtcccaactcctcgacccggacgagcgtgcggccgtccggcccgacgagtgcaccatgctcgacccgatagtcggcgtcacgcgccgtcgcactgaaggtccgcacctcgaccccgcgagggatcgcgatggcgtccacggcaccctctccgacgggccacacggcgacatccccgggcgcgagccgctcgatgaggcgcgccttggccgcgcgataggcctcgaacgacccgtggtagtcgagatggttcggcgtgaggttcaacacggtcgcgacggaagctcgaaacgtcggggcccagacgagctggaaggaggagacctcgaccacgagtcgacgagcgccactgtccgccaccgccgagagtggcgtgccgagattgccggccgcgacggccccgtcgccgagcatgctcgcggtgagcgtcgtcaccgtggacttcccgttggtaccggtcaccgcggtgatgggggccgcggcgagaaggtagccgagttcgagctcgccgatcaccggaccgtcgagcccgagacgttccacccgttcggtgcgaatcccgggggacacgacgaccaggtcgaagcgcgcgccaacgatggcgtccggatccacgagctcacgcccctcggagcgcgccttgtcacgcagcgctcgagcgtcgtccgccacgatgacctcggcgcccaacgatcgcagcacccgttcggccgcgagaccggacacgctcgctccgagcacgagcacacgcccgcctgccacctgggcacgcagcgcatcggcgctcatcggacccctccgagcgacaggaagtcggcatagaacacgccgatcgcgagcgccgtgcagaccccggcgatgatccagaagcgaatcaacacggtggtctccggccacccgagcagctcgaagtggtggtggatcggcgacatgcgcaagatgcgccggtgccagacgcgaaaggtgaacacctgcgccacgaccgacaacgtctcgatgacgaacagccccccgagcaagacgagcagcagatcaatgtgcaggagcagggcaaggccaccgagggcggacccaaggccgagcgacccgacgtcacccatgaagatgcgcgcaggcggcgcgttccaccagaggaaccctgcgagcgcgccggtgactgccatggcgaataccgcgagatcgagcgcatcggggacgtggtagagcccgacatggcggaacatccaatacgccatcagcgcgagcgccccgaaggcaaagatcccagaacctgccgcgagaccgtcgaggccatcggtgaggttgacggcgttcgaggaaccgacgacgacgatgaccgcgagcacgatccacccgaccgacccgagttcgagctgggccccaccgacgcgaaccaccgcgagcaccggagggactccgacccaccatcgagccaggaccgcaaacgcaagcgcgaccgcgacctggagcgagaacttccccgccttggtcaacccgagcgagcgccgattgcgcaccttcaagagatcgtcgacgaccccgatgaggctggaagcgatcgtcaggccgacgacggcgataccgccgcggctcagctggacaccgagatgggcatgcgtgaccgcccagccaagggccgtcccgaccacgatggcaatgccacccatggtcggcgtcccggctttgaccaggtgccggctcgggccgtcctcacggacctgctgacccaccccccgcgcgcgctggcgctcgatgagccacggcgttccgaccacggcgacgaccagcgacaccaaggcgctcgcaaggatggcgatcacgcgagcagccccccgtcgtcttggagcgcagcgtgcaccacgtcgatgtcgtcgaacggcgtcgcaacgccgtcgatgacctgaactcgttcgtggcccttgcccgcgaccacgagcacgtcgccgggggccatcatcgccacggcctcctcgatggccgctcggcgatcgaggacgacccgcacgccacgacgatcgcgccaccccgcgacgatctgggccgcgatggcagcaggatcctcgctgcgaggattgtcgctggtgacgatggcaacgtcagccagctgctcggcaaccgctcccatgaggggccgcttggcctgatcacgctccccgcccgcaccgaagacgacgagcaggcgcccccgcggaccgaccaggagtcgagccgcccgcaacaccgccgccagcgcgtccggagagtgcgcatagtcgacgacgaccaggcctcgcgggccgaggatgcgctgcatgcggccccgtgggctctcgacctcgccgagcacccctcggaggaggtcggggtcgaagcccacctgctcgagcacggaaaccgccagcaggatattgcggagattgtgctcaccgacgagacgcgagcgataccagcgtccgttgcgacggaaccggatccctgccgcatcgatctcgatgtccgtcacggcgctgatgctcaccggtaccaccggcacccgcaccgacgccgcgagcctcgcgccccagggatcgtcgacgttgatcacgccgatcgccgtccgttcgggctcgaacagccgtgccttcgcggcgaagtagtcctccatcgacccgtggaaatcgaggtgatcttgcgacaggttggtgaacaccccgacccgtacgtgcagcccctcgatgcgctccatcgcgatcgcgatcgaggacacctccatcgccacccagcgccgccccgagtcgcgaaactcagcgaggcggcgggcgagctcgggagcctcgggcgtcgtgaggcgactccagagcgtgccgagcacaccgaccccttccccgaggcgctcgagcagctgggacacgaccgacaccgtcgtggtcttgccgttggtgccggtcacaccgatcaccgagaccgccgacgacgggtcgccgaagatgcgatgggcaacgcggccgaccgccgtacggagcgaggcgcgtggcaccacgagttggggcacaccgaccgcgaccggctggccggcggtgagcaccgcgacagccccgcgtcgcaccgcctccgcggcgaagtcacgcccgtccacgtgacgccccggaaccgcggcgaacaggtcacctgcgcggatctcgcggtggtcgatcgcgataccggtcaccgaggtcgcccggtcaccgacgatgcgcgcgtgctctacgagggccccgagggcgtcgagcgtgacgccaacctctggacccacctcgcagactcccctcccgcacggacccggaccatggtagccctgcagcacgggggcagcgttcacccctggaccccagcccctggatgcatgtcgacgctgctcaaaagggtcgacgtgacttgcccttcgggcgtcaccccgtagcgagccagcgcagcgcgcatgatctgggagaacacaggtgccgccgtcatcccaccgtagatgggcaccggctggtcgaccatcacgatcgcactgaggaccgggtgctgggccggcaccatcccgacgaacgtcccccagtacgccccaggctggtaaccaccgcgcgcatggtagggcttctgcgaggtgccggtcttgcccgcgacgaggtagccaggtatcgccgcatcaggagccgtggcgttcgaccccgtgacgtgcgagaagagccccagcagctcggaggcgatcgccgcaggcatcacccggtgacgaggtgcggccggcgccaggtggacggtcccatcggtgcccacggtgccagcaaccagggtcgggttcacgaggacgccgccgttggcgaccgcgttgtaggaatcgaggatctcgagcggcgtgacgagctggtcctgtccgatcggggtcgagccgatcgccgtcggtgaccactcggagggaggcttcaggtaccccgcggtcgcgcccgggaacgcgagccccggatcgacaccccacccaaggcgccggaaggagtcgtagatcgccgtcgggccgagccgctcggccagttcgatcgtgcccacgttcgaactctgggcgaggatttgcgacatggagaggacctcggtggggtgcgactcggcgtcatggaacaccgagccgtcgatcaccagctggtttggaacggtctccgtcgaggtcggggtgatgatgccccgctcaagggccgcagcgaacgtcgcgatcttcgcgaccgatcccggctcgtacgcgtaggccaccgggtcgttcaaccagctctccgtcggcagggcgcggggcacgtcgacgggctgactcccgccgaccgacgacgtgcccggcagcgccggcgccgcgagcgacgccatcgcgaggatctggcccgtgtggggatccatcaccaccgccgtcgcgccgagggctcgcgtcgtctcgatctccgacgccaaggcgttctcgacgtcgctctggaggacgggatcgatggtgagctcgatggacgtccctgggcgcggcgggtgttcggcaacgaggcctccgggtaccggcgcaccctgagcggtcaccctctcgagggcccaccccggtgctccggcaagcacgcgctggtaggcgtactccaggccaaacgtaccgacaccagccggactcacacgaccgatcaccggctcggcgagatcgccgagcgggtacacaggcagcgtcgtcggtgtgacggtgatgccgggcagcgcgccgtcgagggcgagctgctcgatacgcccaccgacgctcaagagggcatcgggatcgacgacgctgtagcctccgtgcacctcgagcgcgctcgtgaccgacgccacggacagcccgagcagccgcgccagtcgctcggcctcgggcgcaacgtcgtggatctgcaacggatcggcgatgatcgcgtcgcgctcgatggaggtcgcaaacgcgacgccgttgcgtgcgaagatggcgccgcgcggtgccgacagcacgacgcgtgtctcgctctcggacgtggccagctgcccataccgcggcgccgggcccacggtcagacggacgagctgcgcggcgatggcgccgagcgccaccaccgtgacggcacccacgatgcgcacgtgcctagccacgcgcgaccgttccggccggaaggggcgccgactcgcccgttggttgaccaagcgccgtcgtcgggacgggtgctccccgtccactagcaagctcctcccacgtcgggtggacgaaaccgtgtgccgccgcgaccgccgccgcgtggctcggtgcgctcagggtgctgagctcggcgacgaggtcgagatgatgcacctcggcggcttgcagcgcgagctcggtcgcctggacggtattggcgaggcgctgtgcaacgagccgcgcggcgatcacgcccaacgcggcgaccacgaccacaccgatcacgagcacacgccatggcaccgaccgacgacgtggtgcgcgcgtcagcacacgaagctcgggggaacgtaggcccgagcgacgaggcagtgcctccgctagcgcagcgcgagccattcgtgcacctccctctcccacgctggtgcgagatctgccaccgcgagcttgcgcgcgaccctcaggcgggcactcctggcacgagggttgcgcgccacttcgtcgtcgctcggcacgacgccccgccgggggcggcgctccagtacgctcgtccagctgccagccggtgtggtgcgcggagccccgccccgctcggccacctcgaagaagcgcttcacgaggcgatcctcgagcgagtgataggtgagcaccgcgagtacgccaccgacctcaagcgcctcgaacgccgcagggagcagggccgtcagctgaccgagctcgtcgttcaccgccaggcgcagagcctggaagacgagggtggcgggatggcgcctcgtcgtacgccgcgacggtggggttgcctcgacgacgacctcggccagctgctcggtcgtcgtcggcatggcggcgaggatcgcgcgggcgtagcgacgcgcaagcggaccgacctcgcctcgacgcagcagctcggtgagcccatcctcgtcgagcgaggcaagcaatgacgccgctgacgtcggcgcctcggggtccatgcgcatgtcgagtggcccggcgaggcggaacgagaatccccgctgcgcgtggtcgagttggagcgaggagacgccgagatcggcgatgaccgcatcgatccgacgcgcgccgacgacacgtgcgaggtcgcgaaacgtcccgcggaccggctcgaaccgatcaccgaacgcttcgagtcgccgcgccgcgagatggagtgcctccggatcccggtcgaggccgatcacgagcgcagcaccggcatcgaggagtgccgccgcatggccgcccaagcccacggtgacgtcgagcacccgtcgaccctgcggttcgaccgcgcgcacgacctctgccaccatcaccgggaggtggatcggctcagccacgatcgcctccccgatagcgctcccaggtcgctggatcccacagctccacggtgccgaaggcgccgtggacgcgaacgtcgtggtcgaggttggcataggcacgatggctcggcgggagcatcagtcgtccgaggcggtcgatctcggcctcgaaggcttcggaggcccacgaacgcagtcgccgacgctcctccggatcggcccagtgctcggcgcgcacctcgccgacgaacgcgttgaagtcctcgacgcgccacacgaccaggcaggggtcctcgtactgcgaaggcgtgacgaagcactgatcgccgaactgaccacgaaagcgcacagggagcgtcaagcgtcccttggcgtcgagcgcatgcgagaaggagccgaagaaccggccggtcggctcaccgagctgccacacctccccgcgcctcctcaccgtcacccagaagggtgccactcacgccatcggcacccacggcgccccactttagcccacgacaccccaccggggcgtgtgaatcgcgtccgttggctccacgatgcgcacgagaccgtgcgagcgacccacgccacgctcgcgcgagatcaataccgaggtcggcgtcagggtgctcaaggagggcgccgagttcgcttgagacgatcgcgacgggtccgcgtgtccgacaggcctccatggctgcagtgtgagccgggagccggctcacagcgagaaccgaggtggagttagcgagccaagatcgcccggcgcaccgtcgcgacgagcggatcgagctcgataccgagctgctcgagccccagggaggccatggtgccttccggtcgatcgcgcagggcgtcgacgagttctcgctgacgatcgcgccagagcacggcaacctggaagatcgcgccgcctcgacgacgtcgctgcgcgagacccgcgaccttgttgccgccgacggcgacctctccccagccccagccagcaaagcacacctgcgtcgagagcgggactcgctcggggacctcacgcaccaccgtcacgtcggccaccccgagggctccaagggcctcggcgacggcttccccgagccagaggaacgatctgccaagatgcggatcgagacgcgggtcagacgccggcacaaacacgtggaaccacgcctgctcgccgggagccacgacgaccgcaccgccaccggatcctcgccgaacgatgtcataacccttggctacgaggctcgcagcatcgatcgcgtccacgcgcgtggtcgagcccagcacgaccgtcggcgccgtgggctcagcactgagcagccacggtgatccctcgtccgctggccaccaacggtggatgaccgaggccggagcgcgcagccgcaacgtccgccacggctgcacacgacgatccatgcggccgatcttacggcgtcctcaggcgaggcgataggcgcgcgccactcggtgcctagcatgggggcggcgtcggaccgggaggcaaggcagggctgtggaggcgtacgtgctcattcagaccgagatcggtcaggtcgcgtccgtactggccgaactgcgcaagctcccgttggtggtacgcgccgacgacgtcacgggcccgtacgacatcatcgccctcctcgagggcgagaccctcgaggacatcggacgtcacgtggtcgagggcgtgcaggtcatcgacggggtgacacggacgctcacgtgcccgctcggtcacctcagactcgacgcctaccactccgtcagaacgcagagagcgtccgagcggccccagccctgacgacgccatggcggagttcttctacccgccgcagttggaccgacgacgacgtcgcgaggacctcggcgctcgtcacggcatctgcgagggcgagcacggtctggacacggtgcgtcgccgatgccacgagacccacggtgagcgcggtctgaccggtcacgagggtgcagtaggcggcgagcaccgcccgcggcccacccaccgtacgcaagaacccgacttcgatctcgcgcgggcgaatctcgaacccggtcgcgcgcgtgcacatgccggtcgccaccggcgcagcccacgccgtcccgcccaggacttcggccgcacggcgcccgctggggccgaacgcgacgagcggcgcagcaccgaggtcgatcccgggcggacccaggacgagttcatgctcggccctcgccgtcgtgcgacggagcgccgcaagctggatcgggatcgcgatcgccgccaccaccacgaaagccgccacgccacctgcgagccaccgccgacgccgtcgcatccgtcgatcgctccaggcgcgctcgccctcgagcgctcccggagcttcgtgatcaagcgagtccacgcttccacgctagcgctcaccgacgacccaccccggggagtccatcgatgccaagagcgctgagcaggcgccgacgtctgcgccagcggcgagcggtgaccctcggtgccgtcaccgtcgcgatcgtcgcgggaaccggcgtgatcgacgcggccctcaccctcgatccatcgattcgggtcacgccccgtcacgtgagcggcgtgcgtgccccgaccgcgcccccgatcaccttcaagcacggcgtgcagtccgcgacggtgatcccggcgcttggatcagggtctctcgaagcctcgccccacgagcgacccgtcccgatcgcgagcctcgcgaagctcatgaccgccctcatcgtcgtccgccgacacccactcggctcgaccgcatccggccccactctcaccatgaccccagccgacgtgatcctcagcgacgtcgacgtcgctgaggatcagtcgactgtaccgatcaccgccggcgaacgcctgaacgagcgccagctcctcgaggccctgctcgttcgctccgccaacaacatcgccaccatcctggcgacctgggttgcgggctcagaatctgccttcgtggccacgatgaacgcaaccgcacgcacgatggggctcaccggaacacactttgccgacgcgagtggcttcaacaaggccaccgtctccactgctcgtgacgtcgccatcgtgaccgctcgcgtcgaggacaatcccacgctcgccgcgatcgccagcgagcatgccgtcacgctccctggcgctggcaccctgcccaacatcatccaagcgatcggcaccggcgacgtcgtcggcgtgaagtccggcttcaccatctggtcgggaggctgcgcctcgatcgcggtgcggacgcccacccccgtcggtgagctcaccagcgtgggtgtcgtcatcggcgaacagggctacgcctccctcgcgcgtgcggcgcggcgcgcccaggcgctcgcgaccaccgctgctgcgcgcgtcgcgagcgagcgcatcatcgacacgcgcgagctggtcggatgggcgcgggcaccgtggcgagcggcgccgattccgatcgtcgcagctcggagcgttcgcgtcctcctgtggccagcgaccgaggcctcggtgcggatcgcgctgcgaccaccagcgctgccggcgccacgcgggcgcgccgtcggcgagatcgtcgtgaccacaccgaccacaaccatcaccgttcccgcgattctcaccgcgagcctcggaacgccgtccttcggctggcggctcacccacgcgctctaaggagcgtgcgcgtcgcacaggcctcctgcggcgcgagccttgctcgctcgatcgccgacgaaaccaccccggtgtggcgtcgccaacgacacggagcgccggttcgtccggcgctccgtgtcacactgatgattcgccacgcctgcgggtgcgatcttggctcctgccgtcagcgaagcgcgccagatcctcgcgctccaccctggcgccgacgctcctcgatcgcgaccacggcaagtccgccgacaccaacgctcgcgagcgcgacaccaccccaggtgagcgcggtgatcgaggacggggcgctacggggccccgtgaccagcttcaccgcggtcggctgggtcgcgaccgtcggagctgacgacgtggccggagcggtcggcgtcgtggatccactcgtcgtcggttggggtggcgtcgagcccgcggcggtactcggcggcgcgacgaccgtcacgctatccgttgccgactgcggagcggcatcggtcgagaccaccgtcgcggtgttcgagagcaccgtgcccgcggcatcggtcgcatccacctggaccgggacgatgatcgagggcaacgattgaccgggctggagggtctgggtcgacgcaaaggcatacgtacacgtcaccgtgggtggcgtcgaggagcttgccagcgtgcagctccagccgtcgttcgcgttggcattcgtcagggccgtctgcgacacggtcacacctgcggggagcgggtcagtcacggtgaacgcgaaggaactcgaactcgatgggctgttcgacagcgtcccggccgcgaacgtcgctcccgagctcggacccggctcggcggtcgccgagctcgtcgcaacgccagcggtgatctcccatgagaaactctcaccagggttcgcgacgtggttcacgttgtcgaccttcgtgatcgagaggatcggacccgtggagaagtaggcgggatcggacccaacgagcacgaagtcgtcggctcccaatgaaagattcgggggggtcgactcgtaggtgaggttgatttggccaggactactcttcgtcgaggccgagacgatgtcgttcgtcaggctcgacggattgacgtagccgaagtcgacgacgttacctgcgctggaggagccattcacgttgcccgacgcgacccagaggttgcccgtcgtcggatcgagcgtcatggactcagcctgcgacgcaccgttcggggcgttaacgatgttgtacactgcgccctgtccgctcggcacgttgctcgtcgaactggcgttgtcgatcgggaggctgggcaggctgacgtagccgacctgcgtgtcgaactcacggacgaaccacagctcattctggccagcgtcgagctggaagtctccaagccccgacgagcccgtcggcagcgaccagctgtaggcggccgtcgtcaccggcgacgatggaatcccgctgcccaggttgtacatcgcgatatctggcgagggactcgtctcgccgacgaatgcatagacggtgccgccgatcgtatcgacagcgagcgaacccgtcagcgacgcggtgaccaccgcgctcacggtgttcgtcgtcgtatcccaagcccagacgtggctgccaccggtccagtacaccgtcggccccaccgccgcaatggcgtagtgctgggtgctggagaactgcgtccccgcgggctccggcggacagctgatgcttcccggcaccgatcccgtgctccactcgtcatagctcggcgaggtcgccgaggccgtcgcgttctgcgatgtgaacgcctggaggttcacggcaatcactggacacgcgctgacgccagtgacgcccgtcgggatcatccccgtgacgttccggtagtacagcatgttgccgacggcgaccccgtcgccgagatactgaccgcccaggccgttcagctggatcgtcccgaccaccgcatgtggcgcggctcccgacacctcgatcaggtaattcggcgagttggagtcggtgtcgacgtagtagttgccgttctgagcctgaaccgtttgctcgagatggaccaagggggagatcaccccgttgtcgacgaggacaccgaggttgaacgccaccggctgatacgcaggtgccgtcgacgccgacagggcgctcggccccatccacgcgaccgcgaccagcgctcccgcaacacccgcactcgtggtccctcgcaggatccacgtcgatcgcctcgtcacaacgcccctcctcaacgtccctcccctacctggctcgacgcagtgcagctgcgatcggcgtcagtactctagcactcactgtgtctcaattccacacgtcttgtgaactctcacggaatgcattcttcatactactcattgtggttatccgacctcgtcgacgtcgaactcctgtcgcgacgcaccgttctcggcagctcgcaatgagcccgaagaatgcctcgcaccgtccaatacggctgcaccaggcgtccatcaggatcggggcgcgacacacacgccaccgcacgcgctcccacgctggtcgaggtcaacgctccgcacgcaggtgggcccggtgggattcgaacccacgaccaagggattatgagtcccctgctctcaccgctgagctacgggcccttggttgcccacgcggccatcgacgctctctcaacccgtcagagcgcgggcgacgaccctcgctcacgccagattcgaagctccgggggagagactcgaactctcaaccgcacggttaacagccgcgtgctctgccaattgagctaccccggaaagcgacgtcagtctaggggtcacgatcacgctcgcccacctccgacgctcgttcgacgcgactccaccagccacgcgaacggtgtccgcgtgagcaggaagtcatcgaacgccgtcaacagacctaccgcgggccgccagccgacccagacgacgacgcccccgagcaccaatcccgccaacacgtcgcccgggtagtgcaccccgacgtagacccgcccgaacgcgaggaggaggcccgcgatcgtcgcgatccaggccatgaggcgatcacgcgcgagccagaggccaacgatcaccgcaccggcgacggtcgcgtgaccgctcgggaacgagtagcccccgctgcgcgcaagcagcacctcgacgtggtgcagcgtgacgtagggccggcgttcacccacgagcggtttcaggacatagtgcgcgatcacccaggcgaggacggtcccaccagcggcccagagaacccccgcaaccgcacgtggcgcctgtcgacgcgagcgagcgcgccaccacgcgaccagcagcaccacggcgagcacgccgacgccgacgaagtgcgcatactgcgccatcgcgccgtgggcccaccccgtctcacgcgcgatgcgattgacgtcgagataggcctcgtcgttgagatgctcgagctcgcccacgtcacacgcctccaccagtgttggcgatcgagcctaacgcacgcatgcgaaccggtgcgccagggccgcagccgaccctcagcaccgctcggctagtcctcgagcacacgccgcagcaccggcgcgagatccccgcggcgcaaccgtgcgatcgcgcgagcctcgatctggcgaatccgctcgcgcgcgatgccaaagtacgccgccgcatcctcgaggctgtggggctcgttgccctccagaccgaagcggaaggcgagcacctcacgttcgcgtggctcgagatgggccagtgcgcctgcgatgaccgtgcgaagatcagcgtgctcgatggtctcctcgatcggttctgcgtcgcggtcgggcacgatgtcagccagcgtcacgtcgcgctcctcgcctaccgcctgatcgagcgagagcaccgaacgcgcgtaaccctggagttcgcgcacgcgcagctcatcgatcccactcgcggcggcgagctccgccatcgatggctgccgcccaagggcttgctcgagctcgcgccgctgaacctccacacgagcaagttcggcggcgatcccccgaggcaagaccacatcgcggcgcgtccgcgtgagcgcctgcgcgatcgcctggcgaatccaccaggttgcgtacgtggagaaacgaaatcctcgccgcccgtcgtagagatcgatggcacgcaagaggccgatcgtgccctcctgcacgaggtcatcgagcgagatccccggttgcacgtagcgtcgagcgatgctcacgacgaggcccatgttgccctcgacgaagcgctccctcgccgcttggaccaccgccgcgacgtcgggcggcacgtcttcggcttcctgggcttcctggagcacgatggagagggcgacctcctcgtcgggcagcaggcgaccccgcctcccgcgcgccagcaccgcccgagcgccgtccagcgcctccggcgacaccccactcacgagccgctcccgagcgcgacgtccgaccgcgcctcgacgaggtaggcgagcagcgcaccggctgcatcgagatctcgaggttccgtacgaaggcgatgcagggtcatgatgtgatccgtccagcgacgctggcgctcctcgcgctcaggtccagagaggccggcaaggccgcgcgcctcacgctcgagttcgacacccgcctcgcgcaacacgagcaccaccagggcatcgtcgaagctcccttcggagtcgctggcagcgatgcgatggtagagctcgcggacgtcatcgccgacgccctcgagcgcggccgcgaccggcgcctctcctcgcgagccgagggctgcagcgagtgcacgataggtcgggtcgcgaaacagtgcgggtaccacgaggtccccgagcccaggatcgctggcgagggcgatgagcaccgacgccgcagggcgatcgaggcctgacgcctcgctcgtacgcagacgtcgcggtcggagggcgctcggaagccgcgccgcaagctcggcctcgcgaaatccggtccgatccgccagcatggcgatgtactcagaccgcacgagcgggtcgccgaccgaggcgagcaccgcagcgacgtcggccactgcacgcgcccgcccctccaccgatcgaagatcggcacgggcgaggactcgttcaaggcggaaccgagccaccggcacggggctcgcgagagcctgtcgaagcgaatcgggatcctcggcgaaggcctcggcaggatcacgtcctcccggcaaggtggccacgagaagctccacgcctgctgcctcggcgaggggggcgacctgctccgccgctcgctggcctgcgtcgtcaccgtcgaacaggaccacgacctggggagcgaagcgacgcaggatgcgcaggtggtcgtcggtgagcgccgtgccgcaggtcgcgaccgcagcgacgccagcggcatcgagtgcgatcacgtccgtgtagccctcgcacaccaacgcgcgccgctcgcgcaggaacgtcgaccgcgctcgatcgaggttgtagaggacctgacgcttgtggtagtaggccgtgtcctgcgtgttccgatacttcgggacgccatctctggccggaggcacgacccgaccgccgaacgcgatgacctgacccgcgacctcgcggatcgggaacacgatgcgtccgctcatcgggtcatgcagcgacccgtcctggccgcgcacgcggatcccgacctcgagcgcgatcgccgccgatgctccgagttcggcgaggctcgccgctcgcgacggcggtgcatagccgatgcggaacttcgcgatctggtcctcgctgatccctcgagccgcgagatactctcgagcgcgctcacctgccggtccagcgagctggtccgcgtaccaggtggtctgggcttcgagcacggtaagtgcctcgcgacgcgtggacgctcgcggctcaccggcagcctcgtgctcgatgcgaagaccggctcgtcgggcaagctgctcgacggcttcagtgaagtcgaggccctgcacctcacggacgaaggtgatcgcatcacctcgggcgtgacagccgaaacagtagtacaccccgagctctgggttcacactgaacgacggcgagcgctcgtcgtggaacggacacagaccgacccaacgcctcccgacccggcgcagcgcgaccgtctcggagacgagcgcgacgaggtccgtcgcatcgcgtacgcgccgcacatcggcgtcggctatggccactcgctcaaggctacgccgtctcggcggcgtccttcgcgcgcatcaacgactgtgcgacggcgaggcgcgcgatcggcacccggaacggtgacgcgctcacgtaatcgagaccggcctcgacgaactgcgcgatggaggccggatcgccaccatgttccccgcacacaccgaccttgagtccgggacgctctcgccgccccgcctcgaccgcctgccgcacgaggcgcatgaccccgcgtgggtcgaccgtcttgaacggattggccgcgaggagctcgctcgccagataggcgggcatgagcttggcctcgacgtcgtcgcgcgagaagccgaaggtcatctgggtgaggtcgttcgtaccgaaggagaagaagtcggcctcgcgagcgagttcgtcggcgatcagcgcagcccggggcgtctcgatcatcgtcccgaagcgcacttcgaatcgcgcgtccgaggccgcgcgcgcctcgtcgaaccattgcctggcgagcgcgagctcctccctgctcaccgtgagcgggatcatgacctccacgatgggctcaccaccggctcgtgcgacgtcctcggccgccgcaaggagggcgcgcacctgcatcccgtagaggccaggcttgacgacgccgaggcgaacgccacggatccccagcatcgggttctgctcatgccacgcacgtgccgcagcgagcaggcgctcgccctcgtcgtcgagaccccccgctgcctcggcacgctcaagcgcggtcacgtcggggaggaactcgtgcaggggtgggtccaagaggcgaaccgtcaccggcagcccactcatgacctcgaggatcccccgaaagtcacgccgctgggcctcgaagagctcctcgagcgcgctcgcttcctcctcggggctctcggccaggatcatccgccggacgatcgggagtcgatccggctggaggaacatgtgctcagtgcggcacaggccaatgcccttggccccgaagcgccgcgcacgctcggcgtcgtcggcggtgtcggcgttggcgcgcacgcccaccttcccaaaggcgatctcgtcagcccatccgagcacgatctcgaactcctccggcggtgcggactcggcaagcggcatccgtccggcgacgacgacgccactcgtgccgtcgatcgaaatccagtctccgacaccgacctgcctgccaccgacgcgaaaaccgccctcctcgatcacgatcgcgtccgcccccacgacggccggcttgccccagccacgcgcgacgaccgccgcgtgcgacaccagcccaccgcgggtcgtcaagatgccctcggccgcgagcatgccgcggacgtcctccgggctcgtctccttgcgaacgaggatgaccggctcgcctgccgcgtgtgcttcgaccgcactcgcggcgtcgagatacaccctcccgacggccgcacccggcgaggcaccgagcccccgggtcagtacgtcgacgacttcggcggcaaagcgcgggtggagcacctggtcgaggtggtcgggagtgatccgggcaaccgcctcctccttggtgagggcgatggcgggatccttggtcatctgcaccgccatgcggagtgcggcgacaccggttcgcttgccgactcgcgtctggagcagccagagcttgccctgttcgatcgtgaactcgacgtcgcacatgtcgcgaaaatgccgctccagccgtgcgaagacatccatgagctccgcaaagacctcggggaactgatcctggagggcagacagcggctcggtaatgcgaatgccggcgacgacgtcctctccttgggcgttgacaaggaagtctccataggcaccctgctccccggtcgcggggtcgcgagtgaagccgacgccggtacccgagcggtcatcgcggttgccgaagaccatggcctggacgttcaccgccgtccccaggtcgtcagggatgccttcgcgctcgcggtatgcgtgcgcgcgctcgccgttccacgaccgaaacacggcctcgatcgcgccacgcagctgatcgcgagggtgctgtgggaacgggctccctgcgagctcaccgacgagctcgaggtaggcaccggccagccgacgcaactcgcttgggggcagctcgccgtcgttctccgtgccgactcgttgcttcgcctcgacgagcaagcgctcgaacggctccggatcgagcccgagcacgatgcgcgcgtacatcgcgatgaatcggcgatacgagtcgtacgcgaagcgctcgtcattcgtctgacgagtgagaccttcgaccgacgagtcgttcagccccaggttgaggaccgtgtccatcatgcctggcatcgagaactgcgcgcccgagcgtaccgacacgagcagcggatcggatgggtcaccgagccgccgacccatgcgatcctcgagcgccccgacgtgacggtcgagctcctcgtcgagcccgtcgggccacccgttgcccaagtaggcacgacaggcgtccgtcgaaatcgtgaagccgggtggcaccggcagaccgagcacgctcgtcatctccgcgaggttggcacccttgccaccgaggagcgccttgagctccttcggcgcgactgggtgcgcatggtcgaatgggtagatgaacggcacgaaggaccctccacagctcaccgctcgtgcgcacggggcgcgcacgaggcatccgacgccgggcgtcgttgcccacaaggtgatgggagtctagcgttgatggaacgttaatgtccgagcacgcggcctcggcgtggccgccaagcgctcacgaacgtgggcgaccaggtctgcgaccggaatgcgtacctgctcgagcgtgtcccgatcgcgcaccgtcacggcgcgatcctccagcgagtcgaagtcgacggtgacgcaccacggggtgccgatctcatcctggcgccggtagcgcctcccgatcgactgggtctcgtcgtagtcgacgtccacgatcgtcgcgagatcggcgaagatctcgtgcgcgagctcgacgagggccggcttgcgcgagagcggcaagaccgccacggtgtagggcgcgagatgaggcgagagccgcagcacggtccgcgactccccgttgacctcgtcgacatggtaggccgcgaggaggaacgccatcgctgcgcgtgtgacgcctccggctggctcgatggtcgaggggtagtaacgctcctcggtcaccggatcgagcacggagagatcctcccccgaggcggcggcgtgggctcgcaggtcgaagtcggtccggtttgcgatcccctcgagctcaccgtagccccagggaaagcggaactcgatgtcgacggtgcgtgacgagtagtgcgagagctcgtcggcgtcgtgctctcgcaggcgcagccaatcaccctcgaggccgagctcttgataccagcgcagtcgctccgcgatccagaagtcgtgggcctcggcggccaccgacggatgcacgaagtactccatctccatctgctcgaactcgcgcgtgcgaaagacgaagttgcccggggtgatctcgttgcgaaaggacttgccgatctgcgcgataccaaaaggcggacgcagccgcatcgcgcgcgcgacgctctgtgcgtccacgaacatcccctgagccgtctcgggtcggaggtaggcctcggctccctccccctcgaccggaccgacgaaggtgcgaaacatgagattgaaggcccgtgccggggtgaggtcgcgagacccgcacttcggacacacgccatcgatctggtctgccctccagcgctcgtggcaggaccgacagtcgaccagcggatccgtgaagtgctcgaggtgacccgaggctcgccagatggccggaggcgtcaggatcgacgcctcgaggccgaccacctctcggcgctctcggaccatgtaggaccaccaggcctcgcggatcttgcggagcagaaggacgccaagcggcccgaagtcgtacgccgagcgaaatccgccgtagagctcggcggacggaaagatgaagccccgacgcttcgtgaggctgacgacggcgtccaaggtatcgggctcaggcatggcgccagtgtaggagcaacgaccctgctcatggcgcgacgggccggcttgggcgaggctcgggcgcgacgtgggcgagaccgcgcaagcgacgaccgaggaccgcctcggcgatccgggtcgcgagctcctcgaagcgccgcgcagccacggcatccacggcgcgcagtccgtcgcgcgtacgcccctcgagcaccagccgagcggcccgcatcgccggaaccccgatcgcgaccccgccgcaggcgtcacagcgcgcctgctgggaggcggggtcgatccgagtcagctccccctcagcgccgcacgaaccacaccgatcgaggctcggaccaaaacctgcgagctggaccgcccgcagcgtcaacgcggcgaagagctctcgagaaggggcctccacgagtagcccgagtccgcgcgcgaggagcgcgaacagcgcgtcgtcgccgtgcccgtcctcgctcagaccatcggcgagatcgagcagctcgtaacaccaaccgacggtgtccggatcgaggtccccacgtccggcgaggttcgccgcgacgagctgggcttgggccacgccgtcgagctcgcgcccccgccagcactccacgtcgagcaccgcggacggctgcacgatccctctgaggcggctcctcgcggcccgcgccccccgaacggtggcacggaccttgccgtgctcccgggtgagcagcaacgccaggcgatctcgctccccgagcggccaggtccgcagcacgaccgcaaggtcgcggtaccttccgctcacggcgcgcgacgtcggaagcgacgacgacgccccccgacgatgagcaaggcgacgaagatgaccccgacgagcaccatggctccgatcccggccgcaccccctccgatcgcaccggccgcgagggcacccatgaccgccaccacgagggcgagcaagaaccacccggccgctcgctgcagttgacccgagccgctcatcggcccaccccgccaaagcgccgatcgcgcccctggtactcggcgatggcctcgaagagatgctcgcgccgtacgtccggccagagggtgtccagaaacaccagctcggcataggcgagctgccagagcaggaaattggagatccgatactcgcccgacgtgcgcaccacgaggtcagggtcgggcatatccggaaagtacaagtgggaggccaccgtcgactcgtcgatcgctcgagccggcacgccttcggcaacgatccgtcgaagggcatcgacgatctcggctctgccaccgtaattgaaggccatcgtgagcgtcaggcgatcgttgtgcgcggtcagctcagccgcgagatccatctcgcgcgtcaccgacggcggcacgcgccgactgcgtcgccccaggaaccgaatccgcacgccacgatcgttgagctcatcgcgccggcggcggagcaggctccgattgaagttcatgaggaagcgcacctcgtcgggcgggcgtcgccagttctcggtggagaaggcatagacggtcagccaccgaaccccgacctcgagcgccccctcgaccacgtcgaacagcgccgtctcgccagcggcgtgcccctgggtgcgcggcagtccatagcgctgagcccaacgtccattgccgtccatcacgaacgccacgtgcagcggcacgcgcgtcgtatcgatgcgctcgagcgccgatggcacctcgctgggcctagccacggcgcaggcgtgactccaagtgctggtgcatgccccgctccatggcgtccatccagagctccgtcatgagctcatccccgcgcaacgtgaagcgacgctgcaccgcatccactcgcttggcgctcggcgtcgtcgcgacgacgagtgaggtcaaggagatgacgacaccaccctcggcttcctcggcaccgccctcgaggacctcgacgatgcccgttggctgcgccacgacgagctcgagccgaccgttcgcgacgaagcgcagataccccacctcggtgtggagcggcgatccgtccggacccgtcgtgtgctgttccatgcggaggaacggccgaccattgctctcgaagcgcaggcgctcttggtagctgaactcggcaacctcgggatagctgccgatcccgctcccggtccaggttccctcgagcatctctcgaatcgtcatcgcccctcccccggccagccctcagcctagcgaggtcggcgtcggcgcgtccgggcgtccggacctcacagccccagctcgtcgagcatccgtgcggatcggcgccagtcgcgctgcaccttgacccggagcgtgagcggcgggtacgcgcgcagccggcgctgggcctgacgtcgcacggcggccagcacccgtccctcgtggccgagcacgatcgcacgctggctcggccgttcgacgtagacgacgacctccacaccgtcgtcgctccacgactccacctggcacgcgagcgcctgtgggagctcgtcgcgcagatggtggaggaactcctcgcgcaccacctcggccacgtaggtcgcgcgtgggagatcgagcgcgacccctgcctcgtagagggcaggaccctccggcaacgaagaggccaggtaggagcgcagctcttcgatcccttccccggttcgcaccgaagccacgaagtactccgcgagcggcacctgagcgagctcggcaaggaccgcgagcgtgcgagcacgacggacgcgatcgatgcgtgcgacgacggcgacgtcgctcggcttcagacggctcgcgagttctcgctcacgagcacccacaccacgctcggcatccacgaccagcagcgcccggtccgcgccgtcccactcgtcatcgacccagcgtcgcaggcgcgccgagagttcgtcgtgcgccgctgcgatgccgggggtgtcgacgaggacgagctccgcatcgcccacgcgactgatgacccgcacggagcgccgggtcgtgttcggatgtcgagacacgatggtcgcgcgctcgcctgcgagcgcattgaccagcgacgacttgcccacgttcgtgcggccgatcaccgcaacgaaccctgatcggcgaatgggaggcgcgtcgtcaggatccatcgagacctcccgggtggcgctcgacgagcacggacgcgacccggtgacgcgccacttggcgtacctggagtcgcaccccatcaacgtcgacttcctcaccgacgcgcggcagatgaccgagcagccccatgatcagccccccaaccgagtcccactcgccctcgggcagctcctcgccgatacgctccgagaggtcgtcgatgctcaccgagccccgcacctcccagcgaccctcccccagctccaccacaccctcaccaccggcgtcgaactcgtcgtggatctcgcccacgagctcctcgatgaggtcctcgagggtcacgatgcccgcggtcgagccgtactcgtcgacgaccacggcgaggtggaacttcccgtcgcgcatctccttgagcaggtccgccaccggcttggtctccggtacgaagtggatcggtcgcatgtgctggccgaccggcacgtctcgaaggccagtgtgctcgagtgcgagcagatccttcgcaaggacgatgccaaggacgttgtcgagcgagctctcatagaccggcaatcgagagcgaccaacctcgatgacgacctcgatcgcgcccgcgaccgtcgtctccgctgggacggcgacgacgtccgggcgcggaaccatgacctcccgcgcgatcgtgtcgccgaaggagatcaccgagtggatgagttcacgctcgtcggtctcgatcacgtcaccctgctcggccgcgtccgccatggcgagcaactcggcctcactcacggtggcgccgggcgcgcgccacggcgtgagcagtgccgacaacgaggcgacgccaccggccaacacgcgaatcggccagaagcgcaccaagacggcgacgatcggagcgagacgcagcgcaaccccttcggggtgcaccgccgcgacgttcttggggatcgcctcgcccaccacgaagatcacgaggatctcgaccgccgttgcgacgacgaccccgagcgtgccgaagacatggtcggcgacgaccccgaccagcgtggccgcgatgagctgactgacgagcgttaggagcaacaccgtcgacaggtacgtcgagggagcttcgacgagcgaggccaaggcgcgagcgccccgccgtcgctgatcgacgagcgcttgggccttgactcggctcgtgcgtgtcaggccagtctcggccgcagacaggatcgccgataccccgacgagcagcacgaccgcgacgagggaccaccaatcagcggtgctcaccgctcgctcgccacctcagcaccaacctcgccacgaagcgcgcggtagcgctccagcagcgccgcctcctccgcctccatgcgctcggcgtcctcgtcggcctcgtggtcccaacctcggatgtgcaagatcccgtggatgagcagcaaggccacctcgtcacccacgctcccgtcgtggccacgatcgccgcggtgctcaggcgcgttcgtacgggcaacctcaggacagatcacgacgtcgccgaggagggtcggcaatcccgatgcggtcgagggacggtgctcgctggcgtcgtcgccgacgtcgtcgatcgcgaaggagaggacgtccgtcggcccgacgcggcctcgatagcgagcgttcaggctcgcgatggtctccgcatcgacgaagaccaccgacagctcgctgaccccgtgcacgccgagggcggtgagcacctcggtcgcgaggcgcgccaccatcgcttcgtggatctcgacggcggactgctcgttcgcgacgaccaccgtggccgcgggaggcgcaggatcagccacgggaccctgccgcggtggggtcgtcgtcgtaggcctcgaggatcgcgcgcaccacggggtggcgaacgatatcgcgccggtcgaggcgcacgatcgacacgtcggggatgttggcgagacgcccgatggcatctaggagcccggacgtccctccatcgagatcgatctgggtcgcgtcaccggtgacgacggcggtggatccgaagccgatccgcgtgaggaacatcttcatctgacccgtggtcgtgttctgagcctcgtcgaggataatgaagctctggttcagcgtacggccacgcatgaacgcgagcggagcgacctcgatcagccctcgctcgagcagtcggagcactgcttcgggctcgaggagatcgtagagcgcgtcgtagagcggacggagataggggtcgaccttggccgccacatcgccaggcaagaatccgagccgttcgcccgcctcgaccgccgggcgtgtgagcacgatgcgttgcacccgcttggcacgcagtgctgcagtcgccgccgccaccgcgagataggacttgcccgtgccggccggaccgacgccgaaggtcacggtcgagcgttggatggcttcgacgtagcgacgctggccggccgttcgcggccgcaggctgcgaccgtcgcgggtacgcaacagctcgagatcgctcacggccgacgggctctgctcgtgacgcaacatctcgaccacccgatgcacgaccgcagcttcgaccgcgtcgcctcgggcagcaagcgcgagcaactccccaaggacgcgcgccgcgaggtccgcatcggcgcccgagatcatcaccccgccgtcgcgcacgacgacgcgcgcctgtccgaccgcctcctcgagcacccggagcagctcgtcgtgggcgccgaagacgatcgccaacagctcaggccgatcaacgtcgacccgcgtcgccgcgagcggcggggtcaggcctgacgagaccgcgctcatcgatgccacccgcccagcacatggctcaagtgcccagaccgacgcgccgagacgagccccgtggacgagcgagcacacgaacccacgacacggggtgcctctcccgaccgcgtgatcgacctcgcggacgtgctcgcacggaccgagcgcgccgaggttcgcctcgtcgacggccgaacgtccaccggcttcgtcgatgcctggtcgtcgaggtgcgtacgcctgatccacccgggcggatcgacgtcgctcatccccaccgacgcggtggccgtgctcgccatctcgacctcacgcgcccctcgcgcgccaacgctcggctccttcgccgtcgagctcgaacgagcgggtctcggggcgaactggaccctgtggttgcgagacggctcgagcctcgcgacgagacgcatcgacgcactcggagaggacatcgcgctcatcgtgagcaccgagggcagatccctcgtcgttgcactccgctccctcgtccttgctcgccgctacgaccgcacggcaccacagtgacggctgttcgcgctgacaccacgcctctggcgccaccacgtttcgaccgtacggcacccctagcttagcaggctctgactcgtcatcgaggaagctccgtgcacgcgtcgactgccgagcgcccctggccgaacccgggccgactcgaggaacgcatcgaggtccgagcgtcggatccgcaagttccggccgatctggtacgccacgatggccccatcgtcgatcaaccgatacagcgttcgcagggagatgccgagctcttcggcggcctcccgagtaccgagccacccgttctccatggacacctccgtcgtcaacgcccatggtagacacacagcgcgatgaatcggcacgaacggcactagctgacattccagcacgaccacgacggttccatccatcgcttgcgcacgaggcgaggtggcgctaacatcgcgggcgcacggaagcaccactgatcaaggagtgatcatgcgcagcacgacgctgctgcgtggcgcgcgccggacctgggatcggccagccgtccggtggccctcgttgggttcctcggcgctacgcatcgtcggatccatcgtcctcgcgggcgtgtcgctggccctgctagtggcatcatggctgggtggcgttcgcaacgccggagcagcggttggcgtggtcgtcacgcgcccgatacctgctggcgcgaccatcgaacgcgccgacctcggcctcgcctcgatcaccgttccccaggcggtacgcgccacgctccttgcggtcgacgacgcggtgggccgcaccgcagccgtgaccatcgcacccggtaccctcttggagcgctcgatggtgctcgggccacgaccacggacgccagtgcgctcgatcaccattgccgtcccgtcgacctcggtcgcctcaggcgtcatcgaacctggtgatcgcgtcgacgtgctcgcaaccacccagagcgcatcgagccccgcaaccctcacgatcgcgacgcagctcctcgtcctcgacgtccaggcttcctcgggcgacgaactcgtgaccgtcgcgaccgacagcctcgaccaagctctcgccatcgcccaagccctcgctaccgccaaggtcgatctcgtgaacgccacgggcgtacccggagacacggtgctatcggtgtacccaccctcgatcgcagggctcgcgacccatggatgagcgtccagtcgtcgtccttcagctcgcgcacgccaacgcggtgcgcgcgctcgccgagctcgcacccgtggcacacgacctgcggttgcgatgggacccgaccggcgacgcgctcgacccggcgaccgtgtcggtgatcgtcacggatcgctccgcggccgtggcgcccggggtccggctcgttcgaacgaccgaccccaactgggtggtctcgcttcgcgaggccgtggccgcacaacggccgcgctcggacatgtgtggcagcgacgtcgaacccaaccgcccccacccactctcacgcgacgagcgcccccggtggtcaggtctcgaccactcggacgacaccgacgtcggcgagcaccaccacgtggcggcggcatccgcctcagacgatgccgtgggcacggcgcccgagcacgacctcgaggtgcgtcgagcgcgtctcgtggtcatcgtcgatctcggctcggcgagctccgtcgccatcgcactcgcagcctgcgccggtcggggcacgctcctcgtcgatgtgcgcgatcggccgacgctctggttcctccatgacctcgccccagagctcacgacgacggcccgcatgccggagcggccctacgagctcgcacccccgcatgggaccctcgccaacgagctcgtcctggcagatccgctcagcgagcgccgaacgcttcgagccgccacccgaagcttcgacctcatcgtggtcgtgaccgatgcccgcgaccacgccgccggcgatgaacgatcgacggcgctgcgatcgctgtggcgcgacgcccaggcgaccgtactggccggagcctgcaggctggaggaccgctaccgcatcctcaccacggccgtcgcactctccgcgctgcgccgtgacctcacggtcgcctgtgtcggcgcacgtggggcctcggcgcacagccacgcgaccgcgatcgtgcgcgcactcagcgagcgtgtcccgcgatcggtcagggtcgacgggttcggtctcgaagagctcggcgaccagatccacgagcgacgccacccgatcccggaccgcctggtgcgccccctccgtcccgtcgtccaagaggctcgctcgaggccaccgttcgacccgggagatccagacctcccgctggcaccgctcgaggggctcagatggctcgtccccgaggcgctcgaggcgatctaccacacctcgtcggacggcaaggaggcgtggtgagggccctccgtcgcgacgagcgctcgcgcccgctcggcgagctccggcgcctcgtgatcgcccagccacacgagcgtcgcgagcgtctgacgcaccgccgcctcggtgacgatgggatcaccgaggtcgccatagatcgtccgcaccagttcgccgaggtcgaggccttcgccgagcgcctcacgcacctgatcgatgcgagtacgtcgatgctcttccaggaacgtcaggaccgccccgatgtgcgcaccttcgaccacaggcccatggccgggcagcaggcggcgcggttcgagcgaggcgacgaccgtgagcgacgcgaagtatgcctcgagggagccctccgggtagatgatcgccgaggtgccccggcccagtacgtggtcaccggtcagcagctgtcgatcgggcgtgacgaaccccacgtggtcggctgcgtgacccggaagcgcgacgacgaccacgtccatcgcctcgagcagcgcttcggcgccgcggccggatgcatggacatcgcagccgagcagcgccgccaagggctccgctgcttcggcgtggtcagggtgggcgtgggtggtgagcacaccccgctgcctcgcgcccgcacgatcgatggcatcggcgatggccccgagatgcgcgtcgatcatggggccgggatcgaccaccacggcgtgggtctgcgtcgagaggatgtaggtgttggtgccctcgagggtcatcggggaagggttcggcgcgaggatccgctcgatgcgcaccggtccgtgccgcgacggccccacgtcagcatcgcgggcgtctcggtgtgcatcggcctcgaccacgactcccacgttaggggacgacgcggtggctgagtacccctggctcgaccgctacctgtcgctgtgcgctcgcctcgagcacgcggtgcgcgccgagctcgatcccgccgccctgcccaccgacgcagcagcgctcgaccagctcgctcgccgccacgccctcgacatcgacgaccttgcggcctcggaacaactcctcggcgccgtcgtacgctacgtcatcttctcgatgcgcgcgctcggtcccctggagccgttgctcgcggaccccgacgtcgaggagatctcgatcaatgccccgagggaggtgtgggtacggcgccgggggcgcttcgcgcgcgcaccgctcggtttctacgaccacgagcacgtgcgacgagcgctcgaacgcctcaccacgaccgctcgcggcgcccaacgccagctcgatccaggccagggcatccaagacttcacgctcgccgatggctctcgcgtccacgtcgtccatcccgaactcaccccgcacggcacctggctcgtgaacatccggcgcccgctggcgaccatcgggcacgccatggccgaggtaccgcccctcctggcgagcgccgtgcgcgtcggcgccacgatcctgatcgcgggcctacctggcgtcggcaagaccacactggcacgagcgctgctcgatggcctcgacgacgccgtgcgagtcgtcgtcgccgaggaggtcggagagactcggctcgcgcgtgggaacgttgcgcacctgcaaacccgccgccaacggccgggggtcgaggcgatctcgctccgtgcgctcgttgcggcgtcgcttcgcatgacgcccgagcgactggtcatcggcgaggtccgagacgaggaggccctgcccttcgtcgtggcggtcgcgagcggcatcccaggactctcgacgatccatgcccgcgagccccgcgcggcgctcgagcgactcgcgacgctcgccgccatcgcaccagaggcgccaggcaccgcgacgctccgccatctcgtggccgacgcgatcgacctcgtcgtgcagctcgcctggcacgacggaccacgagtgaccggactcgtcgccgtcgagggactcagcacccccgatggcatgggccccttcgtcgtcaccaacctgctcgctccggccgctacgcggacctcacgcctcttcagcagattcccacagctcctcgaggcacgcacggagctcgtcggatgagtgcacacttgcgcgacgcgatcgccgggctcttggcactcggcgccatcgctgtgctcgccctacccgcccttgcccggttgcacgcccgtagctccgcaggacgccgaccacgacctgcgaccgtcgcgctcgggcttgccggtgcggcgatgatcacgctgtggcgtctgccggcgatcgccgatctcatcgcggcagcggcgctcggactcgccgtggtggggactcgtcgccgcgacgctcgccgcgagctcaccgcgctcgacgcatggcaccgatggctcagcgagttggcactgcgcgtcggcacgctcggcgaggcgctgtcggaggcgttctgggtcgccgtggagccgatcccaccggatcttgcccttgcgatcgcacgggccagatcgcactttcgcgtcgctcgggacttcgccgcagcgatcggcctcctgggtgagcaggcctcggatgcgacgaccgccaccgtatgccgagcgctgaccaccctcgatggcctcgcgacccacgaggtcactcgcagtctcgaggcgctcgctcgcgacctcgatgcgcaacgagcggtggcccacgaactcgatgcgcggctcgcgggcgcgcggctggcccgcgggctcgtcctcgccgtccccgcactcctcgtcgtcgtcgggatggcgatcgccggaccgagtgcctatgccaccccgctcgccgaacgtatcgaggcggtgagcctggttaccctgctcggctgctggctgtgggcgtcgcacctgctcgtgccggtggttgccgttcgcggccagaaggaggtgccgtgagttccttgatcggccttggtggtgtcgcgctcctcctcgcctcggcgtggttggcgacgaccgtgcgcgagatcgtcccggctcggctcctccgccacctcgagctcccgcccccgtcacgtccggtcgcgcggtgggtcgcacgtcgctccgacgactggctgctggccacaggggtgcagcccgcgaccgatctcgctcgcttcgccgatccggccctcggagcctcaggattggtcggcgccgttggcatcgtgggccacagcgctcccgccgtgtcgggcgccctgatggcaccggtcgtcgtcgtcgcgctccgcgtcgccatggtcatggccaccgcacggcgcgtccgcgagcgcctgcgcgcgacgtggtccagcgagctcggtgagatccgtcatctcgtggccgctggcgcaagcctccccggggccctcacgactcgtcgggacgccgacaccccatggtcgacgcagtggcacggtgccctcgccgagatgggcgagggcaccgacctcgaggtggcgctcgcgcacgtggcggaacgcctgcgcgatgcgaacgtcggggcagcgctacgcctgctggggagctcgtgggcggtcggcgccgtgacccctgcgctcggcgagctcgaacgcgacgcgctcgcacgccgacgcgccgacgcactgcgtctcgccagccgacgtgagcagctcgtctggatccccgtcgcggtcagcgccctcgtacccggcgtcacgttggtcgtcgtcccgctcgccgcgggccttcagaagctcgtcggcctctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagcccatcgatggcacgggcacgtgacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatttcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagctcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctaggcacgctcaccgagacgagccgagtttcttgcctctttagtcattgtatggtatcctatgatcatccacggaaggaggtcacaatgccgacacggacgttggctccatcgacgcgcgactggttccgccgaaccctcgagcgacgacgacggatcgctcggagtctcgagaggctggtcatcgccatcgtgacacggaacgatcccctccacgaggctggcgagggcgtcgtgtcgaccgcgatcatcgtcgtgatcatggcgttcctcgcggtggggttgtggttcgcgttcaagaccatcatggccaatgccacgacgaccgtctcgaatcaggtcgcgcagctcgggagctgaggatggctcctcactcctggcgagcctcctggccgcggctgggacggtgtggatcctcgcactcgtcgccgccgtcggcagcaccgcgctcgcccaactccagctcaacgagtggtcccaggaggcggtggccgctgccgcggcgacactcgccagcggcccgacggccgcactggccgcaggcgaccaggtcctgcgcgccggaccgaccgtggtccgcgacgcgcacgcgacgtggaccatcacgtcgaccaccgtcgcgatcgacctcacgacccatgccccgagcgcactcgtcggttcggtcacgctcgacgctgcggcctcgcagcgaggaccgtgaacgcggctcgatcgatctcgtcgcactgatcgctgcgctcgccgtcgtcgcatgggtcctcggtccatggctggtggcgatcctgcgcacactcagcgccgaggcgacactgtcacagatcgcgtggtcgctggcgcgcggggccgagaccaccgggcagccaccgccccaggccgtcgcggttcccggcatcggaacggtcacggtgagctggagtggcagtctcggtcgctgcggcatcgcgacggtcacgacgcatgcgaccctcgctgccccacgctttggcgttctcgggccaggcgcgatctcgctcgccgagcgagcgaccgtctcgggcgacgccttcgtcggcggcacgatcgtcggggcgtgtggtgggacgtgagcgagccgaggcgggctcggcgctcgtgctcatcccgatcctcgcactcgcgacctcgatcatgctcctcgtcatcggtgcgatcggtgcgctcggtgtccgccacgcccaactgcgcaacctggccgcgagctgcgcgttgtacgcatcgcgtgccgtgtcgacgacggcctgggaagcgactggccagctcgccatcgacccgacgacggcacgcctggacgcggcgagttgccttggcgcaagcggtgtcgccctgtcgggttggtcgttgaccgtcacgcccccgatgaccgtcaccgtggcgctcgaggaacgcctcgcgatcccagtcgtgagctggctcaccggctcgcccgcactggtgcaggcaaccgcaagcgccacccagtcgtcctccggccccggataggctcgctgtgtgcacgcccttgccgtcgacgcgaccttcgtgcgagccgcatcggtcctcgtcgtcgcacgcgatcgcgtccccggtgccttcgcgagcgcctttcgcccctggggcgacggctcgctcctcgccatcgcgtaccaaggagacgagcccgccccgctcgtgcgcctcgtcgaggacgggaccaccctcgagatcgcgacacgccgtgttcgcctcgatggcgccaccaacttccgcgatgctgggggactccagacgcctcgaggaccgctgccttggcgccgtcgcttccgctccgagaatctcgcacgcctgagcacacgcgactgggacgtcctcgaagcgctcgggatccgcctcgtcatcgacctgcgcgcaccctcggaagccgccatggccccgacgcgagcaccgtcgttcgtcgagcttcgaccgatgccgctcgcagcgccactcgcgggcgccgaggacgccaccgaggccatcctcacgggcaggctccagagagtgacccccgatgacctcatcgtccactacgagcgactcgtcaagcaccacgcgtcggtcctccacgcagccgccgacgtcctcgacaccgcacccgacccgctggtcgtgcactgcaccgccggcaaggaccgcaccggactcgtggtggcgctctggcagctcggcgcgggtgccgacctcaccagcgtgatcgaggatttcgcactctcgaacctcctccgaaccgtgccacgcttcgtcgaactccgagatcgcatcgccgcaaccggcacagatccacgggccgtccagccctacctgagtgccgtcgtccccgcactgctgcacgcgctgtcactgctcggcgtggtcaccgcctgacaccgcgcaccgtccgcgacgaacgtccgggcagcgcaggtgcctcgaaggctcggtgcacgatcgcggaaccatcgtggctcgaaggccggaatgcttgcaggtgcgcgtgcaacaagctactgtcgggtttggccaccacgcaccgtgggggcatggcactcgtcgacacgtcacaagcgccaccagcacagacacgcggacgaaggagggggcatggccgatccaacgatcgaggcgctctacgaagagagcaggctcttccctccaccaccgaacgtgctcgaaggcgcagaggtcacctcgcgcgagatctacgagcgcggccgagatcccatcgcctactgggagcaggaggcatcgcacatccagtggcgcacgccctggacgagcgtgctcgattggtcgaacccgccctttgcgcggtggttcgtcgacgcaacgctcaacgtgaccgagagctgtctcgatcgtcacgccgaggccacgcccgacaaggtcgcctactacttcgagggcgaagagggcgacaccagggtcatcacctatcgccagctcctcgaggatgtctgccgcttggccaacggtcttgcgcagctcggcgtcagcaagggcgaccgcgtcgcgatctacatgggtatgatccccgagttcccgatggcgctgctcgcctgcgctcgcctgggcgcggtccactcggtggtcttcggcggcttctccgccgacgcgctcgccgatcggatcaacgacgcccaagcaagcgtggtcatcacctgcgaccagtcccgtcgcaagggccagaccatcgacctcaagcgcatcaccgaccaggccctcgaacgatgccccagtgtccaccatgtcgtggtcgtcgaacgcacgggcgccgacgttcccatgacgaccggccgagacgtgcgctaccacgacctcgtcgccgaccagccggccgagcggcccgccacggagacctcgagtgaggacccgctctacatcctgtatacctccgggaccaccggcaagcccaagggcatcgtgcacacgacgggtggctacctggtcggggtgtcgagcacgcatcgactggtgttcgatctgcggcccgacgacgtctactggtgcaccgccgacatcggctgggtgaccggccactcctacatcgtctatggcccgctcgccaacgggaccacgagcgtcctctacgagggtgtgccggactaccccgatcgcgaccgctactgggcgatcatcgagaagtaccgcgtgacccagctctacaccgcacccacttcgattcggacgttcatgaagtggggggacgagtaccccggtcgccatgacctgagctcgctccgcgtgatcggcacggtcggcgaaccgatcaaccccgaggcgtggatgtggtaccgcgaggtcatcggccagaatcgttgcccagtggtcgacacctggtggcagaccgagaccggtgcgatggtgatcgcaccgatcccgacggtgacgcccacgaagccaggatcggcgaccatccctctccccggctaccaagccgacatcgtcgacgacaacggcgagtccgtcccgctcggtggcggtggctacctcgtgctcacacacccgtggccgtcgatggcgcgaacgatcttcggcgatccccagcgctacatcgacacctactgggcgcgcttctccgatcgcgagcacaacgtgtggcgctacttcgctggcgacggcgccaagcgcgacaacgacggctacttctggctgctcgggcgggtcgacgacgtgatgaacgtctccggacaccgcatctcgaccctcgaggtcgagtcggcgctcgtcgaccatcccgcggttgccgaggccgcggtgatcggaagggccgaccccatcactggccaagcgatcgcggccttcgtgacgctgcgcgccggcatcgtcggtgacgacgccctcctcgcggccctccgagaccacgtcgccgagcgcatcggcaagatcgcccgaccggcctccatcgtcttcaccgacgagctgccaaagacgcgctccggcaagatcatgcgcaggctcctgcgcgacatctccgagcaacgccagctcggcgacgtgaccaccctggccaatgcggacgtcgtcgccgagatcgctgcgcgcgcccaggcacagcagacaccttccgacgatcgttgagacggaggcacccgatggggtgccacgagcagcacgaaagagcagcagcacccacgtgggtgctgcgaccaatcgcccgacacggccacagcgcccgcacggacgtgtcggggtcagccgcgccacccgcgcgggcagccagcatcgttggctgcagcatcacagggggaaaggaaaccataccgatgaccatgactgacgcccacaccgaggtggaggtctcgtccgtcaaggcgaccgcggacccgggcccgctcgggctcgctggcttcgcactcacgacattcgtactcagcacgatcaacgccgggatcgtatcgggcaccctcgtcggtgtcgttctgcccctcgcgttgttctacggcggtctcgcccaactcctggcggggatgtgggagttcaagcgagcgaacggcttcggcgcggttgcgttcaccacgtacggtgcgttctggatgtcgttcgctgcgtacgcctactacatcttgccgaagctgccagcggcgacggcctaccaagcgaccgggctctacctgctcgcatggaccatcatcacggtgatcctgttcgtcgcgacgctcgggctgacgcccttcttgaagatcctcttcgcactgctggccctgacgttcctcgcgctgaccatcggggcgcttggccagtcgacgtcgatgaccaagatcggcggttacctcggcatcatcaccgcgatcatcgcctggtacggcgtgctcgccaacctcacgaaccaggccttcaagcgccgggttctgccccagtagtaccgcgcgctcgctgagcctgaaacatcgccgccaacggggacggtccgaggacctccccaatggcggcgatggcgcgttcacggcccgccccatcgccagctgccaccgcgtcggcgagctcctcgagcagcgcaggcagcgcgtcgagctcgacgagctgattgagcgtgcggatctggcgagcctcacggcgtaagcccgtcgcatcgtccgctccaagggccaccgctgcgcgctcgatcgcgctcaccaccgtccgctgcttccgtccgtccatcgctcatcctcccgagtgcgagacgacgctccgacgaggccaccctcgccgcgagcctcccgcgccctcgcgcggcccacccatccgtcgccgggtggagcgcttcactgcccacgcgaaccggtgctcgagacgcgctctggccgagcccccgtggtgattccgtcggctgcgcgcttcgatggcgcgctgccacctcgggccaccgtccgcctgagcgccccgacccacgaggtgagcctacgtgggcggatggccgtcgcgacgcgacgatgactcgaggatcgcagcgacgacgagcgcgacctcgcgcacctcgatcgcgaacgccgcgagatcagccaccgaccccgagtggtgtcgtaacgcatcggccaccgcctcacgcatcaccggatcgaggtgacgctcgagcacgtcgaggaggcgttcggtgacggccccctcgtcgtcgagcaccaagccgagcgcttccgcgtcgcgcttcgtcaggcggcccaccgtgcgtaggctagcgctcgtcccagcgagccacgatctcgtcggcgagcagacgaccgcgcaccgtgaggcgacgtcgtccgggcgcgccttcctcgaagaacgcagccgcccaggccgggacggcctcctcgtcgatcccgtcgcgctgacggagggcgaggtaacgagcctcgaggacacgggcgctcgatgaaagcacctcgagcccctccgtcggcacgagacccgcccgcacccgctcacgccacctcggccagctcgccacgttccacgagcgcacaggatcacgaaacgaatgcgcgctcggtccgagcccgagataggcgccaccaccccagtaggtctggttgtgtcgcgactcctggccggggcgggcccagttcgagatctcgtaccacgcataaccagccgccccgaggacggcatcggcgacctcgtagcggcgagcctgtgtctcatcgtcgacccggagcgaccgaaagcgcgtgcccggctcgacggtgagggcgtaggtcgagacgtgcccaatgccgaggtcgacgacgccggccaaggtgcgtcgccacgacgcgtcatcctccagcgggtcaccgaagatgagatcgacgctcaccctgaggtctgcgaacgcctcgacgaccgcacggatccgtccgagcgcatctgctgcgttgtgtccacggccgaggtgggcgagcacgcggtcgtcgagcgactgcagcccaaccgagatgcgcccgacaccggcctcccgccacctcgcaacccgccccacggagagatcctcgggattgacctcgatggtgacctcggcgccggagacggggcgcgcgagccgaatcagcctcgcgaccgcgccgtcatcgaggtaggagggcgtccccccaccgagaaagaccgaggtggcgcagaagcgttcgtcgacgaggccctcctcgacgcggttggcaagctcgcgttcgacgtcgtcgacgaagtcgcggtcgggctcgcgaatcgcgaccgagaagtcgcagtaggcacagcgtcgccgacagaacgggacgtggacgtagagcgccgcctcccggaggggctcgtcgcgaccgtcgacgctcagcgtggctccggcagggccctcagacccaagcggtcgatgtgctcgatcatgccctcgagactcaagccgagcagtgcaccgatgatccgcagatcctcgcggcgcaccgtcatgacgcgaccgttgaagtcctggcgttgcacctggatcatgccgaggtagcgctcgaggagctcacgctcgggcccctcgaggctccgcagccgctggagatcgatggtgcacttctcggtcgtcggcgccgccaccgatgccgcccgctccatctccgcgagatcgatggtgacgcgatcgtcgtcgaggatccgcgcggcacgctccgtggtgctgaccgctggcgtcagctcactcgtcggcctcgggagcagctgctcgacgtcgacccgatagaacgctgccaagcgccgcagccgcggcaccgaaatggacctttccccccgctcgtaggcgccgagcaccgaggccttgaactccttggccgagagcgcctcgaccgcctggaggctgtagcgctgctgcttgcgcaccagccgcaagcggcgaccgacctcacgtgcatacgcgcgctctgcgctgtccatcgcgatcctcctgtccgcaccatggtgagcgcgccctcgctccgctcaacctcaagcgtagccgcccgcacacgcagggtccacaatattgccaccaagggcgacgagcagtgcacccgcgaccacagccgccgtctccacacggaggatcccgcctggcaaacgcacgcgccgcacgtcggcgaggccatcgatccggccggactcaggaccgatgacgatgcagcgtacgtcgcgtcccacgaggccacctcccgccggatctgccacgacgacgccgtctcgcgggagctcgtcgagtgtgccgacgtcgtggatccgcaccacccagggcacctctgcctgctgggccgcttcccgcgcgatgcgctcgagccgaccgagctcgtgcgctgagagcggttcgccaccgcgacggtcgtggggagcgcgcaggagccacagatcggcgatgccgagctcggcgagcttggcgaccatccacgccaggcgctctctcgagggcgcatacgacgcgatcgatacctccggcgtgcgtcgtggctgcgccacgatctccccgcacgcctcgatccgagccgtccgacgccccacctccgcgagcgtcgcggcccgtacgcgaccccgaccgtctccgatccagatcgatgcccgaggcccgagtcggcgagcgcgcaggtgggcagccaaggcatcgtcgacgaccggggcctcgagatcgtcgacgatgaagaacggttcgaggcgtccggttgccccgttggcgtcgcgacccacgcctacttgaaggcggaacgcagcttcgagagcagcgactggtcgtgatgctcgctgaccagctcaccacgcagggcagcgaggcgccgccacagctcgtcctcctcggccgtgagctcgctcgggatcgtcacctggacctcgacgatgaggtcgccgcgcccgcgacgacccgacagcgcaggcacacctctcccccgaacgcgcgtcgcccacccaggctgcgtgccggcggggatctcgatgacctcgagcccatcgagcgtctcgagttcgagcttggtaccgagcaccgcctgcggcgccgagatctggacacgggtgatgagatcgttgccgcgccgctcaaaccgctccgacggctccaccagcacgtggacgtacagcgttcccggctgaccaccacggggcgctgccggccccttgccggagagcttgaggaccaacccattgtcggcaccaggtgggacatcgaccacgaagcggcgctcctgcgtgcgtcgaccctcgcctcggcagtcggggcacgggtcggcgatcaccgttccctcgcctcgacagacgtcgcaggtcgccgtggtcaccatgcgcccgaggaacgactgggtgatccgcctgaccgcaccggttccctggcactgcgagcacacacgcggctgggtgcccggccgggcgcccgagccttggcaggtgccacacaccgcgggcatgcgcagggagatctccttctgcgccccgaagacggcctcttcgaaggtgagccgcacctcggtctcgatgtcctcgccgcgacgctgggccccttggggctgctgcgtgaacccgccgaagacgctctggaacaggtcggagaagtccggcccgaacggcccgccgccgaaggggtctccgggcccgaacggtccgccctgaaccgatcccgtccggtcgtaggttcgacgcttgtccgggtcgctcaggacgtcgtaggcctcggtcacgagcttgaagcgctcctcggcgcctcgatcgccgccgttcacatctgggtgcagctgacgagcgaggcgccgatacgcgcgcttgatctcctcactggaggcgttccgagacacccccaggacttcgtagtagtcgaccacgtcactcctcatcgtcgacgccgcacgcggcgttacccgaccgcctctgccacgccctcgcgcagcgcctcgaccaccaccgacgccccaccgtagtccatgcgcaccggccccaacagaccgatcgacccgacgatggtcccgtcgacctcgcacggagcgacgacgagggagcagtcgtccagagcggcgaccccgctctcgttcccgatcgagaccggctcaccttcgtcgatgaggcggcgcagcacctcgacgagcgacagtcgttgctcgatcgtttcgagcacaccggcgaccttcgagagctgatcgagtgcgctcgcggtcttggcgacctctcgaacccgaagttccggccgctcgcgcacgcggctctcgtcgatcgcggcgagggccgcgaagacgaccgcgtccatctccgcattcccgctcgggaggacggctagtcgctccgacattcggtgcccgcgcaaccgagacgcgaggaagttccctgccgcgacgacgaccgactccggcggggtcggctcgatctcgaacatcgcacgctcgagcgcaccccgcgagccgacgacgaccccaaggatcgtcggtggatccaagggcacgagatggacggcacgcaccacctcgacctccgaggaccacaccgcgatcacggccgtgtactgcgagtgctcgaccgcgagatccagcgtcagctcgaggacgtcgtcccactcaccacgggcagcacgcaggcgacccacaatctctcggcgcagccgctcgatgagcgtcgtatcgacacgcatgagacgatcgacgaagtatcggtagcccttcacgagtgggatccgccccgacgagacgtggggctgtgccaggaagccctcctgctcgagctgggccatctgcgcgcgcacggacgccggcgagagaccgaggtgggtcacatcgagcacgtgcttgctcccgaccgggacaccggtccggacgtactcggccacgaccgccatcaagatggcttcttggcgcggactcagctgctcttcgaccacgatgtgcgcgaacctcccgtgaggatgctcgccctcagtctagccgcgcacgcgcccacgctgggattgcgcccttcggcctggtctcgaggcccaggtcgctcagcctcagtggctaggcctcggtggcgctgcgctctcgattgacggctcgcatgaggcgcgacttgcgacgcgcagcctggttcggatggatgatgcccttcttcgcggccttgtcgagtcgctggatcgcggcacggagatactgctcgccgtcgtccgcggtggcgttctggagcgcacgcttgacgcgcgtcttcaactcgctccgaaccgccttgttccgctcgcgccggcgctcgtcttggcggatgcgcttcagttgtcccttgatgttggccatgactccctctcggcgacgacgctctcgaatccctgcttcgaaatcctgcttcgaatccctgcgctcgcggcgttcccgcgacaccaacccacgagcacacccgcgtacgctcgagagcggtgcagcgcaagccgcagcactcggacgacgaagtctagccgtgaggccagcgcatcctcgcacctaggctggagcgaccatggtggacccggcctcgatccgcaacatctcgatcatcgcacacatcgaccacggcaagtcgacgctctccgatcgcatcctcgaactcaccggcgcggtggacgcccgcaacatgcgcgagcagttcctcgactccctcgagatcgagcgcgagcgtggcatcacgatcaaggctcagaacgtgcgagttcgatggggtggaaccaccatccatctgatcgacacgcccggccacgtcgacttcggctacgaggtgtcgcgttcgctcgccgcctgcgagggggtcgtgctgctcgtggacgcctcgcaaggcatcgaggcacagacgctccacaactgctaccttgcccttgagcacgacctcaccatcgtcgccgccctcaacaagatcgacctgcccgcagccgaccccgatcgaacggccctcgagatcgagacggtgctcggcattcccgcctccgagatcctgcgcatctccgccaagaccggcgaaggcgtccctgcgctcctcgacgccgtcgtggagcgcgtcccagcaccgacgggggacccggatgccccgcttgccgccctcatcttcgactcggtctacgaccaatatcgaggggtcgtcagctcgttgcgggtcgtcaacggcaccgcgcgcgcgggcgcccagattcgcctcatgcaggccggcaccgtgcacaccgccgaggagatcggggtgcggctgcccgcctcgacaccggtcgccgatctcgggccgggcgaggtcggctacctgatcgctgggatcaaggacgtcggcgaggcacgctcgggcgagacggtgacccaggcggatcgtccagccgatgcacccctgccgggctacgagcatcccaagccgatggtgttctgtggtctctacccggtcgacggcgacgacttcgaggacctgcgcgactccctcgagaaactccggctcaacgacgcgagcttcacctacgagccggagacctcggccgctctcggcttcggctttcgctgtggcttcctcggcctcttgcacatggagatcgtgcgagagcggctcgaacgcgagttcgggctcagcctcatcgcaaccgcgcccagcgtgaactaccgcatcaccttgacctccgctacgacgatcgagatcgcaagccccgcagccatgccgccaccgaaccaggtcgctgagatcgccgagccgatgctgcgcatctcgatcatctctcccagcgagtacatcggcacgctcatggatctcgcgtcgacgcgtcgagggtcgctcgtcacgatgacgtacctctctcccgagcgcgtcgagctcatctaccgcattccgctcgccgaggtcgtgatcgacttctacgaccagttgaagagccggacgcgcggctatgcctccctcgactacgagcccgacggctaccaggtcgccgacctcgtcaagctggacatcctcatcaaccaagagcccgtcgacgccttcaccgcgatcgtccaccgcgaccacgcctacgactacggtcgccagctggtgacccgcctccgcgagctcatcccccgtcagctgtttgacgtcccgatccaagcagcgattgggtcgcgcatcatcgcccgcgagacggtcaaggctcgtcgcaaggacgtactcgccaagtgctacgggggtgacatcacgcgcaagcgcaaactcctcgagaagcagaaggaaggaaagaagcgcatgaagcagatcggccgcgtcgaggtaccccaagaggccttcatctccgccctgcgcatcgaccgctaaggcgacacccttcgcccaggtgcgcgagcgtcgctgcatgaggaggggcacgcgcaccatcgccatcgccgcggtcgtcgtgctcgtcggtggagggaccgcattggccatcggcgtgcggagcagccctcccacggtgccccggtcgcgctcccatccctcggcgagcaccgcggcggcgcggacgactcagggggtagcgatcactggcgcgccgacaccggaccacgtctcgacggtgcaagacgtcatctgttcgggggcgacctgcgtcgccgtcggcagctcaccctccggcgaccccctcatgtggtggtcgagcgacggcggcgccaccttccagcccagcgaggccacaatccccgccgacgtcaccctcaacggcgtcacgtgccaagaacagacctgcgtcgcgaccggcctcgcgagcgccccgccccccgcggggacgccggtggcgttcgcctcgaccgatggggggcgctccttcacacccaccacgctgcccgagggcgcgggaggggacgggctcgcctgctcgcgctccctctgcgtgctcgccgagctaccgctcgggacgggcggcgtggggtcagtcctcgtcgcgtcgcatcccctcggaccctggacgcagctctacctgtcgttcgcccctgccgcatcacccacagcaccgaccacgaacatcctgcggtcgagcggcctcgccgcctgtgccgaggacggcccctgcctcgtcgccaacgaggtcaccacgatcatggcccttcgtacgtccccaccgtgtggacactgactggaccacgttcggcacgcgtcgtcgtcgcgacaccctctgccccgctcggcggtggagggctctggtcagggatcacgacctgcgcgatcctcgcgcctcgctcgggcaccacgtactccctcgtcgtcgcgacgacgagggcgagcacgcgcgacgtcgtcaccgatccctcgggatccgcatcctcggaccaggacccattcctcgatccccgcgtcctcacctgcatcaatcgctcctgcatcatcgcatccccgtcgaagttcgcgcccgcagccctgtgggccgagcgcgacgggcgtctcacgaggcttcctaactccctccccgcctggatccagctcggcctctccgggaccgccgagccctcgcgaggcacgctcctcgtccccgcaccggcccacgacggctccatggacgcgacgctcctgcgactctcggtctcgccgacgggcgtcacgcccaagggattcgtcacgctccctccgtcgtagtgggtcagcgtgctgtcgcgccgtacgaagccgagccaaccacgacgaggaccgcggctcacaatgcctcgatgccgatcacacccgcatgaaccgccagccccgaagcaggcatgcacggtgacggtacgcgaggaccgaagctcgccacctctccccgtcatgccgaagcgagcacctcgatcgcaccaccccaacgacgctcgccgccgcgtgtgaccacgtaccaccccaccccggggatggccgagagcgccgccgcgagcgcctcacctgcgacgaggagggccgtcgccaaaccgtcggcgagccacagggtgggcgcgcacacggtggcttggctgagcgcgagctgacccccgggggcacgcacgtgatcgcctcgctccagcgtgccggacgttgcgacgccgccatcttcgacccgaagcacggccacgagggcacctcggacctggggatgtgccaccccgacccgatgatccccgcggagccagacgtccccgcctgccgccaccgaaactcgtgcaccgggcgcgagatcggcgaacgcctcgagcgcggcacgctcgacgatccaccccttggccacgccgtcgagatcgaggccgagcgggccgtggggatcgaacgcaccgtgagtgagcacccgaaggacctcagcgagtgcctcgacctcgcgcagcgccggatcgtcgaccacctcgccgcggcgccgccgtaggagtgccgagtcgtcccgccaggccgacagggatcgctcgagtgcctcgacacgggcgacgagccgctcgcaccgactctccgccgatccatcctccacgccttcgatggcgacgctcacgaccgttcccatcgcctcgaaggtgacctggctcacgtccgagcgcgctcccggtcgagcgcagcctgcaccgaggtcgcgtaggcctccgaggtgtaggtcgcgccggtgacgacctcgatcgggaggccttgtgccgcgagcacctcgtggtcgaggatgccgacggccgcttgctcaagcgcggctgagtagctatcggcggcgacgaagtggatcacttgaatcgattcgagccggtgccgtgcgaacgtcacggcggtctggagttcgccgtagccgtagttgatggtggcgccatcgaccgtggtgggagcgacgggcgcatacgtcgcaacggcgcggtgggccttcgtcgacgacgacgccgtgtgagcggcggcagaggagccgaagacgtcggccgcgagcgcatggagcgatcggagtccaccaccggcaccgacgacgatggcaaagctcgcgaccgccgaggtcaccgagagcgcagctcgccgcatcgcacctcctcagatcgtgtaggggtcaccatggatggcccgtcgcctcgcaccacgctggagtgccaccgcaccgacggcggtgacgaaggcaggcggccccgcgatccacacgtcggcgctccgcagctcgcccaccccctcgaagatggcagacaaaggcacctcgcgtcgcgagcccaccagcacccgcacgctgccgtggcgctcggccaccaacctgcggatctcgtcgccgagcacgagatccgcctcgtcgctcacgcgcacgatgacctgggggcgtgccgctgcatcgaggtcagccaacagggcgagggtcgccgtctgacccgcgcccccggcgacgaggatggcgcgtcgctcgctgcgctcggcgacggtgaacgacccgtagggaccctcgatcctgacacggctcccgaggcccacgttggcgaggtcgtcggtgaagtccccgatccgacgcgcaacgaggcgaagcccaccgggctcacgcccgtgaaggaccgtgaagggatgggcctcgagacgacgcccgggcacatcgagcctccagaggcagtactgaccgccacggaacgagagcggcctcgcgacggcgacctcgacctcgacgtagcgaccgtctccgagggtgcgcacacctgcgactcgcaggtcgagcgcgcgcgagaggcgccacggcttgatgagtcgaaacacgatcacgccgagcgccgcgaggacccacgcaacgatccagacggcacgggccaggggatggcggatgaaggtgggtccgagcgcaagttcgtgggcgacggcgagcacgagcgcgccatagagcgcgagatgcaccgcccaccagcgctctcgggggatccgagagcgcacccacggcacggagatcgcaccgaccacgacgagcaccacggcggcgatggtggcctcgacgaggcccacggacgaggtcaccacctggcccgtcgctccgaagaacgacgtgtgggtcgcgaccgcggccgcaccgatcgcgaggatgacgtgggctgtgatgagtccgatcgcccacggcgccacctggcggtgccagcgcatgacccgaggctgcccgatggcctggtcgagccatggcatccgcgacgcgagcaccaccatgatccaggcgagaaccgaccccacgagtccggtcagcgtggacgctgcaagcagcgaccctccaggggcgtgcacctccgcgagggtcccatcgaccaccggggccgcaagggcgacgccgacggccacaccaaagacgacggcaagcacgtcagcgccggcacgccgaggacgctcacttgcccaggtcgacgactccaccgcagcgctcacgcccacctccttgctgaggagcctacgggcgcgcggctcgcgatggctcgccggcgacggcgagcgatgctgggctagcctcagctccgtgcgcgtgctctggctccgaggcgacctacgctcctacgaccacgccggctggtctgagctcggcatcggcgacgcagcggtcttcgtcctcgacccgggccttgcccgacatgcgtcgcccattcgccgcgcatggctcgccggtgcgctcggcgagatcgacgactggaccgaccaccgactctcgctcctccacgcgcgccacggcgacgagctcgctgcgatctttgccgcgtggggcgcgacggaggtcctcacccatcaaggcgtcgcgccggggatccgccgtcggatcgacgccacccgccgctcgcttgaggcacggggaatcgcactgcgcgtcgtcgacagcgcctacgccgttgcgcccgggtccctgacgcgacccgagggtggcgcctggagggtcttcggcgccttctggcgccagtggcgcccggccgtccacggcctcggccccttcgaggcgaccgcaccgccttcgctcgcggtgaccgagcgccacttcgaacccgccgacctgcgaccccccgatcagccgctgctcaccccgcaacgcacggccctcgagcggctcgagcgcttcgtcgactcgcgacttgcgcactatgccgccgaccgcgaccgacccgccgtggcagccaccagcgagctctctcctgcccttcacatcggcgcgatccatccgcgcaccatcctcgccgccctcggcgacctcgatcgcgcggaccggttcgtccgcgaactcgcctggcgcgagttctacgcgcacgcgctgtggcaccatcccgacctcgtcgatctcgagctggacccgaccctgcgccagatcgcctgggacgagggcgacgaggccgacgctcgattccgggcctggtgcgacggtcgcaccgggttccccatcgtcgacgccgggatgcgcgaactcgccgccaccggctggctccacaaccgcgtccgcatgatcgtcgcctcgctcctggtcaaggacctccacctcgactggcgtcgaggggcggcgtggttcgaagccacgctcgccgacgcggacatcgcttccaatcgtggcaattggcagtgggtggccggcaccggtctcgacgcagctccctacttccgcgtcttcaacccgacactccagggcaagaagttcgaccccgacggccactacgtccgccggtgggtccccgagctccgtgcgtgcccgaccagcctcatccacgagccgtggcgctgggtgggacgagagaacgcgggctaccccctccctatcgtcgaccacgaccgggagcgacgcgaggccctggcgcgctacgacgctgcgcgcgcctcggcaccaggctcgccgcgcgcgcgacgagcaacctgagggtcgtctcgtcgggggcaacggagtcacctcgaagatcgcgtgcagcggtggcgacgagacgcacgagccgacccgcgcgctctggaccgatggcggcagcgagctcgcccagcgctcgcgcggcaaagtctgggcgcggtcgcaggcctgcttcccgcagcgctgcgttcacgccagcaccgtcgcgcgcgcccgtccccgcaaccgcgaagagctcgagaacacgccgctcgatgagcgtgagcagcagcaccgtgggcatctgcgcagcgagcatggcgtcgaggacctcgagcgctcgcgggagatcgccagcctcgatcgcgtcggtgagctcccagggcggacgggcgccgacctcgagcgcgaccgcacccagcgcctcctcgtcgacgcgaccgccctcaccaacgaccccgacgagcgaacgggcgatggatccggctcgcgagacctcctctccgagcgcccaggcgagctgatcgacgaccgctggttctgcactcagaccgacctcacgaaaggcgtcctcgatcgccgcacgccttcgatcactgcgcaggcggcgccgatcttcgacgtggttgtcgacgtgcgcgacgaccgacttcgccggctcccccacgacgacgaagacgacttcgttgggtccaggagcctcgctcgcggccttcacgagctctccggcctcgcgtgccgcgagcgcgccaagcccggtgacgacgatgcgccgacgatcggcgaacatcggcagctgcgagaacgacgttgcgagctcatggacggctgccgcatcgaccatggcgtgcaggaactccacctctgccgccacgccgcgctcgcgttcgacgacccgctggacttcgacctcgtcatcgcaggccacgaggcgaacggaggccatcgctaggcgctcgccgagatcgccgccaatgtgtcgagcgcacgacgcgctccacgcacgtcgtgcatccggaacaggcgcgcgccccgtaggtaggcgatcgcggctgcagcgatggacgcctcgcgtcgctccccgacctcgagcccaagtgtctcgccgacgaagcccttgttcgaggtggcgaccagcaccggatagccgagctcgacgaggcgatcggtggcggcgaggagggcgagcgactgcgacgtggtcttgccgaggtcgaaaccagcgtcgaggatcacctgggatgggccgaggcccgcggcgagcgcccgctccgcccgctcggcaaggaacccaacgaccgtctcgacgagatcgtcgtagtgcggatcggggtcgtcgacgcgtggggcgagacgaatgtgagtcgcgacgacggcggcatcgcccgccgcagcgacttcgagataggcagggtcgccaaagccagagatgtcgttgccgatgtgggcgcccgcctcgagtgacgcccggagcacctcactgtgccacgtgtcgacggagatggtcacgtcaaaacgacgagccacggcctccaccgcaggtaccacccgatcgagttcctcggagaggctcacctcggggccagcgcccgccttgactccaccgatgtccacgatgtccgccccggcctcgacgagcccctccacgtgggcgaggaagcgatcgaaggcgaagtaggacccgtggtcgaagaacgagtcaggggtgcgattggcgatccccatcacgaggggacggctcgcatcgagcacgcgaccgcgtgccacgagcgacggcgccggggcgacggtcatgcctagaacagcgctgaggtcagtcgccggcgccaggtcgagacccgtgggtccccctccggcaagagccggagcaggtcgaggaactcctggcgcgcctcctcgtcgcccttcacacgcccgagcaggtcttcgaggcgcgactcgatggtcgcctcgtcgagggcagcctcgccacgagccgcgagacgcgcccgagccttgagcgcagcgatcggctcggtatcggggaagcgcgcgaggatcgcttcggcctcctcgagctcgccgcggacgagcagcagctccacgagtccgaccgcagcacgctcgttcccgggctcgagctcgagcgcctgacgcagcgagggttcggtaccctcggcgatcagcacgtcgacgaccgtttcggccggggcgagcttcgtcacgaagtcgcgcacggcctgctccggataggcgccgacgaaggagtccacgaccttgccgtcacggatggcgaacaccgccggaatgccctgcacgcgaaaggcctgcgcgatcccggggttctcgtcgacgttgaccttggcgagcaccactcgcccctcggtctcggccaccaccttctcgatgatcgggctcagcgtgcgacacgggccacaccagggcgcccacaggtcgacgaccacaggccgctccttcgacgcctcgagcacgtcgcgttcgaacgtcgcatcggtgacatccatgcactccagtctaggagccacgcccagagggctcgtgagcccaagccctcggcacgaatggcctaggctaccggcatggaacagcgcatgttgggccgcaccggccacgcgtccagcgtggcgatcctcggatgctgcgccttcggcgacggcgacgtcgacgccaccggccactccctcgaggccgcactcgccgctggcgtcaaccacctcgacatcgcaccgtcgtatgggcaggcggaactcgccgtcggggcacacctcccctcgttccgcgaccaggtcttcctcgccgccaagaccatggagcgcaccgccgacggcgcgcgccgcgaactcgagcgcacgctcgagcgcctacgcaccgaccacctcgacctctaccagttccacgccgtgaccagcgacgaggagctcgaccagatcacggctcctggcggggcgctcgagacgttcctcgccgcgcgcgacgagggcacgacgcgcttcctcggcatcaccggccacttcctcgacgccccacgcgtcttccgacgtgccctcgatcgcatgcccctggacaccgtcatgctgcccctcggcatcgcacacttcgtcgacccggcctatcgccgcgacgccgaggccctcctcgaggcggcaaccgagcgcggcgtcggggtcatggccatcaaggcgctcgcacgccgcccgtggcccaagtccacccacgcctacgagacctggtacgagccgttggacgagccctcgcgcgtgcaggtcgccgtcgacttcaccctcagcttgccggtcaccgggttcgcgaccccgtgtgaccgacgcctgctgtccctggcgctgcgtgccgccgaggcctcccagcccctcgacgaggccgagcgggaggcggtcctactcagccaggatctcgcgccgctcggacgggatgcgggcctgtgagcacgacgagccgtcacgtcgagctgcgcgggccgagcgacgcgccggccatcgtcctcttgccctccctcggcacgcaggccgccctctgggacctggtggcgaccgtgctcgaggagcggtggcgcctcgtgctcatcgagcacccggggcatcgacccggcgccggcccgacgccggtcgcggcctcggtggaggcctacggccgcgaggtgctcgaggttctcgacgcactcgggatcgaacgcgcccacgtcgtcggggtctcgatcggtggcgccatcgccctcgccctcgcacgtgaccaccccgaacgcatccggcgcctcggcgtggtcggcgcaccgcgccgcttcggctcggccgaggcctggcacgagcgcgcagctgccgtccgcgccaacggcacagcgagtctcgtcgacggtctgctcgagcgctgggtgccaacgggctggtcggatgccaatccgagcgagcgtgaccaggtcgccgactgggtccgcgcgtgcgacgacgaggcctacgcacgccactgcgaggcgctcgccaagttcttgttcgcccccgaccgtaccgtcgaaacgcccacccttctcgtgacggggcgcgacgatccggtcgcaccgcccgcagccgtgctcgatctcgcggcctcgttcgccgccgccacggtggtcgtgctcgggcgatcacgacacctgccgtgcctgagtgagcctcgcgccctggcgaccctcctcgacgaccacctgagcggccggctcgacgactaggtcgccagagggtgcctcagcgcggcacgcaacctctcgcggccaagtccgaggtcgccgcgcaccaatgggcggttcggctcggcgaggagcggccgcagcaacgcccgcgcctcggccctcgcgaccgcctcgaagccaagcaaggctaggtgggccgtcatccactgtccatcgatgacgccgtagcccgcgtccttggcagcgacgacgagccccaggaacgccactttcgatgcgttcggcaccagcgagaccatggactcaccgacgaagcagcgtccgagcccgagtccgaacaagccgccgacgagacgacctcccagccagcactcgaccgagtgcgcgaggcctcgtgcgtgcagctcgcggtagaagcgccgaaaggtggcgtcgatccacgcacctggtcgagccggatccgcgcacgcctcgagcacggcatcgaaggcggtgtcgatgcgcacggatgcccgatcgacctcgcggagcaccgagcggtgggcaatgcgcgagagatctccctcgaggcgaagaagcgcgcgccacctgggctcgaaccagccgagcaccccttcgtccagccacatgggaaaccgagcgttgcggtagccctcgaggaccctgtccggttcgaagccgaactggacgtccacgaggtcgtcctcgtggggcccgaccacctcggcgagcgtcggcacgcgccctcgctcaggcgaggccgggcccgtcgtcgcgagcgaccaggcgacggaccgacacgggcaccgcgacaccgaacgcgagatccggggcgggctccgcccagcgcgtcggcgccccgacgtggatcacccctgcccatgcgttgcccgtgaggtcatcgggctcgtcgctcggccaaccagcggacaccttgagcgaccactccacgatcggcacgcggagcaccatggtggcgaggagctctcgacggaggggacgacgaacttccgccgttcgaccggggaggagcttgtcggtgatccgatcgagcgcgcgctctcgctccttgccctcgagcaccgtccccgtaccgaagagcaccgcggaacggtagcgaaggctcgagtggaacgcactgcgcgccacgatgagcccgtcgaggtgcgcgacactgatcgcgagcgccccgcccgccttggcatgtcgcatccaccccgacccgaccgacccgtggagcacgagcgcgtcaccgtcgcgagcgaacgccgtcggcaccacgaccggtccgtggtcgcgaacgacggcaacgtgtgcgatcagctcctcgtcgaggagctgatcgagggcggctcgatcgtcggagcgccgatcgcgttcacgggtgaggtcggtacgcaccacgcgctcacgctaccaaggtgcggccagaacgcagcgagactcaaccagccgtcgtcggctcgcccgagggcccgcgctgtccgtcggcgcgctcggcaaccgtgccatggtcgatgacgagcctgcgccgagcgcgaccggcgacggtcgagtcgtgcgtcaccacgatcagcgtgatccctcgatcccgccacaggccctccaagagcgcgacgatgtcgtcgcgcgtctgctcgtcgaggttgccggtcggctcgtcagcgagcagcacctcggggtccttgacaagcgcacgcgcgatcgccacgcgctgctgttggccacccgagagctccgtaggcaggtgctgagcccgatcagcgagtcccagctcttcgagtacccgtgctgcccgcttgtgccgttcctcggtctcgacgtgcagcggcacgagcgccgtctcgacgttctcctgcgccgtcagtgtcggtatgaggttgaaggtctggaagacgaacccgagcgcggtagcgcggagctcggcaagctcggcttcgccgaggtgcgcgagatcgcggccctcgaagcgcaactcaccggcgtctggccgatcgagtgctcccagcagcgtcaagagcgtggtcttgccctggccggtcgggccctgaatggccacgaactccccgcgctcgatcacgagatcgacaccgtcgagtgcgttgacgacggcgccgtggcgtcgaaacgacttacgaacaccacgtagctcgtacagcggctccatgtctcgaatctgtccttcggtcatgctcgactccttctcgtcctgacgcacgcttactgcacactccgaagcgcgtccgccggccggagcgaggaagctcgccaggcaccaaggccaccggccaccagcccgccgatgatggccaggccgaccgcaagtgcaatggtgtcagcctgcaagggggcactcagatgcacgaggacggttcgtacgcccgctgcctggcgcagcccagctcgcacacccgcgaagccgccgccgaagccaccaccgccaaaaccaccaccgaaggccaccgatcgaccgacggtcgctcgaagtgtcggtgacgccgccgagagagcttcggccccagcgatgccgagaacaaggccagcgatgccgccaccgacgccaaggacgagtccttcgctcatgacctgggcaacgatccggcgcgttcgccacccaatcgccttcaaggtgccgaactcacgggtgcgcctcgacacggcagccatcatcaacaaccctgcgaccagcaccgccatcaccagcgccgcgacggagatccacttcccgagacttgagagcagactgctcgtactggccagcgaccccgagacgtcgctggcaagactcgccgaggtcgacaccgtcacacctgggaggatcttggccacctcgcttgcgagcgtgctgacgttgctcgcgctctgcgcgctcacgtagatcgtcgagatgttgcccgcctcgcccgagagctgctgcgcggtggcgagcggcaggaacacgtcggccgtgctcgttggcgtcgtcgcgatgccgatgaccttcaccgacgcgcctccgacgtcgagggtcgagccgacggagagctgctgggacgtcgcatacccgctgctcacgatggcgacgtccttggtggcgtccgccgcggtgaagtacgcgcccttcgtgacctcggaaggagtgagagggccgacgccgctcgacgagatctggactccatccacgctgaaggagttgatactgaacgaaccgccgccaccactgccaaaggtcggaacagtccccgagaacgacgtgtccgtgagctggagaccgccggtcgcacccgcgacgccgcgcaaccgagcaaccttcgagacgtcagcggccggcaacgcggcctgaccacgagtcagatgcaatcggttacctgcgagacgcgcactcctcgcagctcgggggttgaaggctcccgatccaaagccaaagcgctcacccccgaagctcccgggcgttgcggtcttcgagacgatcatgtccgtaccgacgccgtacaagctgtggagcacctcgccatcggccgaacgcacgccagccgttgcagccgagaccgtcacaacgaggccgattcctacagcaagcccggccgacacgaggacggcctgtcgactgcgccgacgcagttcacgcctcacgtaggttgtgatcatcgagagctcctcgtaaccaagcgatcggtgtcaatgctgctggagcgtacggagcatggttggggcacgtctgaggaactggtgtgagcaggcttccgcttcgccggatgccgtgacacatcgctcacatctgcaacgaatcgccctcgaagcccccacgacgacccgttggcgtggcaaaggcccatttcgacgcccggttgcgcccggggattggtggagtggacagtgcccttcccccattcgaggttgacacctgcttgaggaggaagggatgagtcagacaccacgcctacccccggccgccgggaccgaatgacaacacgcagccgcgatcacctcccaccgagcggtgtcactgcactgcctggctggcctcagcccaccacgcaaggctcttcctcggcgggcgaggccagcacgcgagcagcgcggaggggccgagacgtcttcgaggtgcccgccgtgtgtcgtcactcgtggcagtttcgagctcgaccatggactcctctgacaggtcgtgtggctcgaagacgccccatgtgccgtgctggccgagcacgacagcggtgatgaggcgcacgaagccacttcgcgcccgaagaccccgacacgtggtgcgccgctcgatctcatgatgggcccgaccagagcgggttcgtgacgagatcgtgcgcgaggagctctcgggaagctgtgcagacctcctctgtggcctcggcgaccatggcgcgagccgctgggagcctcgtgggtaagcgagtcgatgacctcgtcgtactgggtcgggagtgctgccggggaggcttcgagcaaagatcgtgcggatcttgagccaggaccatctccgtagctccccttctgcgatgcgagcgagcacgtcgcgcatgctgcacgcagcagcgctcacgagttcgcccgacgaaggagctggcgatggcttggtgagcccgccctcgcccatcggagttgcacaggtgcacaccaccgagacacacgatcgctgggctccctcgagcactcgccccgcaaactctcgctctgcccatcgccgacacagcacttccgaagacctcgcacaccccggcgctgtggatgcccgtgatggccacccggatactagagatgacctggtgctcgaggcggcccatgacgccaggtggcatgggcgaagggggagcagaactcgagcgatggcccagcctgtggtgatggaaccttgccatctcctcgtcgagggatgcgacgatgcgggagacctcgccctttgcgatctccgtccgaccgcaggccgcgatgaggtcatcgacgcttcgggtgctgagcccccgagacgttggcctccagaaccacgcacgtgagagagcacgatcgacccggcggcggcgctcgccgatggctgggacgagctccccacacggagctgtgcggattgcggagctccacgtgccgcccttggtgacgagcagacggtcgcgctaaccgttgcgcttcgcgtctggcgtctctcgcctcgttcgtctcggcaagcgccgatgaccgctgctgtctcttccccgatgagggcttggaggatgagctggccccctctcgggagaagtcgatgtctccgcctgctctgatggcgccagggcacgccgggagcgtcggagggggtcagggccacctgagtggctcctctggccatctgttgtctgacacgccagagatcgctcagtggcccgccctcctcgcgtgcaggccgcccggcaatgacaccacgtggtgggatggcactgcgtccagcgcgtcgagcgcgatcctcgcgagcgggatcgaacggcggctccgctgcgtcttgacggcccctcgatgatgtgagaacctgcgacgtggcgcgaagtgcggacgtggagcgtgtcgccctcgacgtcccccagcgcagcccgagcagttcagctcggcgtagtcccgtcacgagcgcgagcacgaacaggtttccgagccgttcggacttcgcctcagcgaggaacctggctacctgctcgggggacagcgggggcagctcgacgcgaggcgcagagcgaatgggttccaccccttgcgtcggatcgttcgcgaggagccctcttgccatgccccagcgcgcagcttggccgagcacgtccctgaagagcttcagggtgcgcggggagaggttggggttgtgcgcgaggagcttttcgacgtggcggaagttcagcccgtcgagcctcacgtggccgatgatgggtgagatcgcgcccacggcgtagggatactgcgcaagcgttgcctcgcgaacgttgcgggaagcgagccaggcatcgagcaagtcggcaaccgtcttgatgcctcgctcgggggcaagcatgcgatcccgctcggctcggaacgcagcgagggtggcttcagcttcgtagcaagtgtcgcagagcttcgaccggtacacctggcggccgtcgagcgtggagcacaacgccgctcggtgcttcccatacgcgggtgtgatggtcccgtaccctcgcgtccgtcgccgtgccatgtcgtccgacgtcgcacgctcgagacgataggtcgcacgataagggcaaaaataaagcccccgagcctctgcactcggtcgtatatggcctctgagctgggcttttggagtggaggtgatgggactcgaacccacgaacctcttgactgccagtcaagcgctctaccagctgagctacacccccgtgctgtcggtagtgtagtgggtggcgtcatgccgctcgtcgatggcccgctgccggtgacggttgctgtcgtggccagcagggcgactgcgatgggggaggcgatggatctctgggtggcgaacacggatcgaaggtggttcgactttctgcgccaggcgggactcgaggaggtgaacttctggtcaccctcaccgtcccctccgagttcggcgatcgcggtcggaaccccgtggatcttccgcctgaagaagcctgattacgcacttgccggattcggatacttcgctcgcttcgagcaactttcggccaggttggcatgggatcggttcggacagggaaacggtttcgcctcgttcgaggagttcctcgatcaggtcgtacggctccgacgcctgctgaggacttcgtatcccgatcgcgacaccaagatcggctgcacgacgctcgtcggcgcctgcttcctcgaggaggatcgttggcttgcgccagtccctgggttcgagcccaatgtcgtgaggggcaagggttactacgtcaactccagtgaaggtgatgcgatctccgaatggctcgcccaacagcaggcggctgcagcactgccggagtcggttgccgcactgcccgtggctgggtacagggaggcgctgactcgcgtgcggctgggtcagtatggcttccaggcgctcgtgcgctcggcttacggggggcgctgcgccatcaccggagaatcgaccgctatcgcgctggaggccgcccacatcgttcccttcgcgctcgagcagcgccacgacgtgcggaatgggttgttgctccgagccgacttccaccgactcttcgacgccgggctcatcggggtggatcccagcgaatggacggttcgcgttagccctgcgatcgcggacccggacgagaatggccagctctacccgacctaccaaggacaactggccttcccccctccaggttgacacctgctataggaggaagggatgagccagacaccgaacccaccaccgggcgacggccccgctggacgacgacgcggccgctacccgagccagttccgcaaggacgcggcagcgttggttctcgaccagcgccgcaccatcgctgacgtcgcccgtgagcttggcatcaacgagcagacccttggtaactgggtccgtcaggaacgcatcgaccgaggtgagcgagagggcctgacgagcgccgagcgcgaggagctgacacggctgcgccgccaggtcaagcagctcaccgtggaacgcgagctgctcaagcgagcgatggccttctgggtgaaggaggggggacagtgagccgctaccactggatctcccgccaggaggccaagggcttctctgtagcggcagcagcacgagtcatcggggtctctcgccaggcctactacgcctggcgacaccgtcgggaccgaggcgaggatcccgagcacctggtgctcgcgagcgagcttcgcgccatctggcacgagagcgacggcacctacggcagcccccgcatcacccacgagctgcgacggcgcgggttctgcgtgaaccacaagcgggtggaacgcctgatgcgcgagctcgagatggcagcgggcccacgccggcgcttcgtagtcacgacgaggcggggagaggacgcagcgctcccggacctcgtccgtcaggacttcgctcctggtgagccgaagcgcaggtatgtgagcgacatcacctacgtccgcaccgatgaggggttctgctatctcgccacggtggcagatcttggctcgaggcgcatcgtgggctggtcacttgggcgtcacatgcccgatgacctggtggtcgaggcgatccgcgaagcactcgggactcggggcagcctggctggggcgatctttcacagcgatcgcggcagccagtacctctcccggaaggtacggagcctgctcgcgacccttggcattcgccagtcggtggggagggtcgcgacctgctacgacaacgccgtggccgagtccttcttcgggagcttgaagcgcgagctggtggctcgctaccgcttcgcgaacctctcaggggctcgctctgccatcgctagctggattcaccgttacaacacggtccgcctgcactcaagcctcgggtacctaccgcccgtcgagtacgagctctcctgggcctgccgggaggtggccgtggcctaaattcagactgtcaagcaaatggggggaagcccaaacctctgaaagtcgttcctcgcgaccggcagtaccagcctgacccggagcgactccgctggcacctctcgcacgtcttcaagggctagcggccctccccgagactcagggccgagatagacgcctcctgcgacacttcgacgcggacggtcgacttcatgtggccttcccccatttgcttagcagtctgaatgtaggccgcggccacctcctcgcatgcccaggagagctcgtactcgacgggcggtaggtacccgaggctcgagtgcagccggaccgtgttgtgacggtggatgtaggcagcgatggctgagcgagcctcagcggattcaacgacatctacggcctcatccaggccgtggaggacggcgcgacggtgcgggtctactacgaggcgaggcttgcgaaggtcgagctgcccgacgaagcacggggagcgctcgatgcggagttcgacgaggtcgccgaggcaatggagacggagtccagggagcgtctcaagacccgttgggcgcgcatcgaggccatcgtgggcgccgagaagcgcatcgccgccgtcgcggccgacatcgtcgagcactgggagaagcgccgcgccgccttgaccggcaagggactcatcgtgtgggcttccccccatttgcttgacagtctgaatttaggccacggccgcctcctcccgggcccaggtgagctcgtactcgattggcggtcggtacccgaggctcgagtgcagccggacggtgttgtagcgatggatccaggctgcgatggctgagcgggcctcggcgaggttcgcgaagcggtagcgagccaccagctcgcgcttcaggctcccgaagaaagactcggccacggcgttgtcgtagcaagtagccaccctgcccaccgactggcgaacgccgagggtcgcgagcaggctccgaaccttccgggagaggtactgattggcgcgatcgctgtggaagatggccccagcgaggctgccccgagtccgctgggctccctcaatcgcctcgatcacctgttttcctggcatgcgacgctggatcgaccagcccacgatgcgcctcgagccaaggtctgccaccgtggcgagggagcagaagccctcgtcggttcggacataggtgatgtcgctcacgtaccggcgcgctggctcacgaggagcgaagtcctgacagacgagatctgggagcggtgtgtcttccccacgcctcgtggtacgcacgaagcgccggggtgggcacgctgccagccccagctcgcgcatcatgcgctccacccgcttgtggttcacgcagtaaccacgtcgtcgcagctcgtgggttactctggggctgccgtaggtgctgtcgctcgcctgccagatggtgcgaagctcgctcgcgagcaccaggtgctctgggtcagggcctcggtcccgacggtgtcgccaggcgtagtaggcctggcgggagaccccgatgactcgcgctggcaccgccacgggcaagccgttggcctcctggctggcaacccagtggtagcggctcactggttgccctccttcaccgagtgggccatcgctcgctttgccagctcgcgttccatcgtgagctgcttgacctgccgacgcagccgggtcagctcctcgcgctcggcgctggtgagaccttcgcgctcgccgcggtcgatgcgttcggagcgcacccagttgccaagggtctgctcgatgaaggcgagctcgcgggcgacgtcggcgatggttcgccgctgatcgaggaccaacgctgcggcgtccttacggaactggctcgggtagcgacctcgtcgacgtcgagctggcccgtcggccggtggtgggttcggtgtctggctcatcccttcctcctatagcaggtgtcaacctggaggggggaaggccagtgtgcatgagtcgccgtatctgcgtagagctctacgaccagatcgtcaagctccgcgccgactggcatgccgacgatgacgccgccggcacgatcaaggtcgtcatcacgggttctgcctcggacggtcctgagctcaactaccacgtgcggagcaaggagcggctcgcagcactcaagcagcgcgcgaaggatcctgacgatcccctcgagctcgtcatcgtgcgcgacatgtggctcacggggttcgactcgccatcgctccacgcgatatacggcgacaagccgatgcgcggagccggtctcatgcaggccatcgctcgcgtcaaccggacctttcgcgacaagcccggagggctcgtcgtcgactacatcggcatcaccgagagcctccgggcggcccttgcggagtacaccgagcgcgatcgagctcgccaggaggtcggcgcacccatcgacgaggccctggccgttcttgaagagcaccacgaggtctgctgcgagctgctctttgggtgcccgtggcgagaggcgctcgagtccgggagcgacaaggcgcgcatcgaggcgatcatggcagctctcgaacacctcctcgccggcgctgacatggagctaccggagcgcttcctgcgccacgtccgcgcagccactcagagcttcgccattgccgtagcctctcccgaggcggcccgctaccgcggcgaccttgccttcttccaagcggtggccgtcgagctgcggcgagcgcgggctgaggagcgggcaaagagcgatgaggtcgagctcgagacggcaatccgtcaggtcgtctccgacgccgtgacggcctccggcgtcatcgacatctacgccgcctctggtttcggcctccgcaccccggctgatgtccactatgacgtgctgaggggctccgagcacgccgggccgaggcgctggaagctgcctggcgtgctcaccccgagcgcttcgtgcgcatgcggcccgaaccaccccggctccctacagccgtctggatcaacccaccggaggaggtgagcacgacgacacagtggaactgaaccggacgtgtcactcagaggttgacaggctccgagaacgccgaagggatcaccaccgagcgcctcgaggatgcgtgccaggtcgtcatcggggatcgccttaccggttgcccgctccccgcgagctggacgggacgcagccgcgacgttgcgctcgacgagccgcgaggtctccacgtaggcaagcatggctcgcaacgtggtgcgcacgaggcgaaccgacgacgtgctgagcccctcgagcgaggcgaggaacctatcgacgtcaggggtcgtgacggcggcgagctcgcgccctccgagcgcctcgacgatccgctccgtggcccatcggtactgcgcgagcgtcgaggggcgcacctcggtcgccttgagcgtgagccaggcttccgcgagctgacccagggtacggatcgtctggcgcgacgcgagcccagcttgggccgtcttgcgaagccccgcgagggcgagcacagcttcggccttggtgtcggccactcgcgagacgtagcgcaagcgcccgttcgggagacgttcggggagcgggtacctcgccatccaccgatccccgtagcggtgaaccgcgccctcacccttggccctgcgcgccttgcccgtccgcacgtgtccaggcaagttcgccaaacccatagccgcaacgatggacgcgatcttagggggttatagtggcgtgcatactgatgcacagatatctaccaggggttttgagtggaggtgatgggactcaaacccacgaacctcttgactgccatcaagcgccctaccagctgagctacacccccatgctgggtcctcatactggggcgcgcccgagtcccgcaggacgccgagcgccctcaaggcgcgccgtaggctggtgggcatggccgaggagtacgacccacccgcgctggagcgctcttggcaggagcgctgggacaacgacgagacctactacgtctccgccgacgatccgcgtcccaagtcgtacgtcctgtgcatgtatccgtacccgtcaggatctgctcatcaaggacacgtacgcaactacgccttcggcgacctcaacgtccgctaccgcaccatgcgcgggcatgcggtgctctctcccttcgggttcgactccttcggactccccgctgagaacgccgcgatcaagactggggtccaccctcgcctgttcacagaggaacggatcgctgaactcaaggcctccgtcaagcgactcggtaccgcctacgactggcgccgcgagatcaagagccatgaccccagctacatccgatggacgcagtatctgttcctgaagctctacgaagctggactcgcctaccaggccgatgcaccagtgaactggtgcccgggttgtcagaccgtgctcgccaacgagcaggtgctccccgacgggacatgcgagcgcagcggtgacgtcgtcgtcaggcgcaatctccgtcagtggttcttcgcgatcacgcgctacgccaatgagctgctcgacaccctcgacgaactggcctggccggaacgtgtcaaggtcatgcagcgcaactggatcggcagaagcgagggggccgagatcgacttcccactcgcggacgatcccacgcgctccatcacggtcttcaccacacgaccggacaccattttcggggtgacctttctcgttctcgcgcccgaacatcccctcgtcgagtcgatcacaccaccagagcgtcgcgacgaggtcgaagcgttccgagccgacgtggcgacacgctccgaactcgaacgccagagcgatgtcgcaagcctcgacaagcgcggactcgcactcggcatctcggtgcgcaaccccatcaccggtgacgaagtgcccgtcttccttgccgactacgtcctcgctcactacgggacgggcgccgtcatgggcgttcccggcgaagacgaacgcgacttccgcttcgccaccgcatacggactgccggtcgtcgaaacggtgacgcgcccgagcgaccatcccggcggcgcatggtcgggtgatggcaccaagatcaactcgggacccttcgatggcctgagcgtagcggcggccaagcgggccgtcatcgaagcgctggagcagcaaggggcgggccggagtcgaaccgtctaccgccttcgcgactggctgatttcccgtcagcgctactggggctgtccaatcccgatcgttcactgctcggcgtgtgggaccgtcccagtacccgaggaccagctacccgtcctcgctcccgacgacgtcgagttcctccccaccggcgagtcgccgcttgctcgccacgcgggcttcgtgaacaccacctgcccacaatgcggcggcccggcacgccgcgagaccgacaccatggacaccttcgtcgactcctcgtggtacttcctgcggttctgcgaccccttcagtgaagatcgcccgttcgatatcgccgcggtcgaagcgtggatgcccgtcgatcagtacatcggaggcatcgagcacgcgatcctccacctgctctacgcacgcttcttcaccaaggccctcagcgatctcggcctcatccccgcgacgcttcgagagcccttccgacagctcttcacccaaggcatgatccgcttccatggctcgaagatgtccaagtcgaagggcaacctcgtcacgccgcagcagtacttcgacaccgtcggtgccgatgcgctccggctgtatcacttcttcgtcggtccgcctgcggacgacgtcgactggaccgaccagaccgacgagatcatcgagggctgcgcccgatacctccaacgcgtctggcggctggccgagcgcattggggtcacggacacaccgacgagcgccccggtggcaaacgacctcgccatcgccatcgagcgcctcacccaacgggtcacggatgcgatcgagcgctggtcctacaacgccgcggtcgcagcgctcatggagctcgcgaacctcctcggcgacgagcgcctcctcgcccagcccgacctcgccgacttcggccttgcgcgcctcctcacgatgctggcgccgttcacaccgcacatcacagcagagctcttcgagcgccgctatgggcgcaacgtgcatcgcgagccctggccaaccgtggatcacgaactcctcgcgagcgcccggactaccctggcggtccaggtgaacggcaagctccgcggcaccatcgaggtcgacccttccatcgaggagtccgaagccatcgacctcgctcgcgccctcccgtccgtcgacgcagcgctcgcaggtcgcgagcccgagcgctgcatcgtacgactccctcgaatcgtcaacttcgtggtccgctaggagtcccctgaacaactcctccacgtagggcggctacgggaagcgcttccctccgcctgtcaagcgccatttgcccagctcagctagactttttgcatgctgggcaccgaatcagaccaggcacacctcaccgcgacggaggccttctgctcctcgctcatcgagccagggtccatctacgccttcctcgccgagcaccgcagagagctcttccccgacgagcgcttccgccatctctacccctccacgaccggcagaccctccatccccgcctcgagggtgctcgcggtcatggtgctccaggtgctcgaggggctctcggacaccgaggcgacagagcaggtccgctacaacctccgctggaagtacgcccttggtcttgatctcgaggacccaggctttcaccccacggtgctcacctactggcgcaggcgcatcgccacctccgagaccccaagactcatcggcgagctcgtggccgaggtgatcggtgccacgggggtgctcaagggcaagacgaagcgcgtcgtcgactccaccgtgctcgccgatgcggttgccacccaagacaccatgacccaacttgtcgcccagatcaaccgggtacgcaggctgatccccgaactacgcgacattcctctgtcaccagcgatcgactacacccgcgcaaagcctgccatcgactatcgggacgaagaggcagtggtgcgcacggtgagtgccctcgtcgccgatgccactgcccacctcgcccatgcagagaagctcgcatccctcaccgagccacagaccgaagcccttggtctccttgggctcgtggcgggccaagacgtggagtgtgtcgatgccaaggaaggtcgctggcgcatcgcgaggcgggtagccacagacagggtcatctccaccgtggaccctgacgctcgccacgtccacaagtcccgtgcccgtgccatcgatggctacaagggccacgtggccgtcgagccagacagtggcatcgtcaccgctgcgaccatcacgaagggcaccgtgccggacgcagcagtggcgagcgagctccttcgtgacgaggacggcccgcgcacggtctatggcgacagcgcctatgccacgagcgaggtctccaacgagctcgccgctcgtggccacgacgaggtgatcaagcctcggccccttgccatggcggtccctggtggctttaccatcgatgacttcgtcgtcgaggagggatgggtcagctgtccccaaggacaccgagtacccatctccgccaagggtcgtgcttcctttgtcaagcactgcaccggctgtccgctccgggatcgctgcacgcgctcgaagcgaggacgggtcctcaccttcacccctgccacctggcacgcaatcagccagcgggcgcactttggggaccctgccgttcgtctcgactatcagcgcacccgaccgaacgtcgagcggatccacgcacagctcaaacgcaagctctccggcgcgaggctgcgctacctggggctcgtgcgcaaccgactccacttcgagctgctctgtgccacctggaacctgaaggtgctccttcgcctggggctcacccgggtgggtggtggctgggtgcttgccacctgagaggcgctcgggtcctctcctcctcgccccacaggaggggcgaggaggagagggtgaggagcgagatgggaacgggtcagctgggctcgttcccgggctgggtgggcgtgctcagccaccaccagggaggggcttgttcagagggctcctagcgcgacccgctctgctcgtgtcgccgaggtgcactcggcttgcgttccggcgtcgatgctgcgctgcgtagacgtcatacgcgcgagcggcccgatccggaggtcatgccacgacggagctgggccgggccgagacgagcggatctccgagcgatccggcaccccgacccaccccggtggcgtgccgtcggggagcacacgaccacggcgctcaccggtctggagcgagcaggccacaccaagcgagcggcctgcctggcccgtgagccgcaggccccaccgctatactgggaggcccgcgcgcctctagctcaacggcagagcaacggactcttaatccgcaggttctgggttcgaatcccagggggcgcaccggccggttgcacgcacgagaggcgtctcgtggccgcgccacacgtgtgctgggctcagctgtgccgagatctcagctgtgccgagatctcagatgtgccgagatctcagatgtgccgagatctcagatgtgccgagatcaagtgtgcagaactcaagtgtgcagagctcggtccgcaccgtgaggcggcctcctccattcgggttccacactcccccgtcggatgtgcccgtccgctgcagtctcggcccagctccccaggcgtcaagggctcggagcgtcactcgccgtgccatcgtcagcggtcgatcacgccgtagcgagcctcacccgcaccggtcatgagtccccagtactgatccccccacgaccagtgccaccactccgtcgggtagttgacgagccccaccgccacgagcaccgagcgcagcacgctccgcatgcgtcgtgcctctcggccaatggtctcggcgtcgaagaagcatcgacctgcgctctcctccggactcgcgttcaccgccgatcccatgtccacttccgcgccgtcggctccgacgagcgtcaggtcgacagccgccccgcagcaatgcggcgggaatccgtccggaggcgctacatagcggctcgccagcagacgagtccgctcgggatctgctccccgattcgcctccaggagctctgcgtagtactcctcgaagtagcgccgctgcagctcgcgggaccggaagccttcgacgaccgcgaggcgcagtccctcgggcagtgcacgcgccgcacgcaccaggcgctccgccaatccctcgcgcacgaaccgatggttgccggtcccatcgtcgagccgatcgtcgatcacgatgagatcgcgctcgccgaggtccaccagcggctcgccgcactcactgacgggaacttgctgcaccgcctggtcgccgatcaagaccacaccaggtggcacgaggctcatcgcacccacctcgagaggacttcttcgtcgtctcccagcaccgtgtgcatcgtggccaccctcatgcgtgatcctcaggcatcggcaggtccgcgaccggcgcgcctccaagcgtgctcgcaccccgacgcgccagtgtgacgacaaccccgacgaccacgatgaccgccgtgatgatgaggtcgcccttcgactgctgactcaacgcgagcacgacgcccccgatcgcaacgacagcaggaactggccacagaggcatacggaagacgccactcgagcgccgctcgcgcaccctggcgacgagtgccgacaccgcaaccagcaggtagatcgtcacgatgatcacgccggtgaaggtgatgaggttgttgagcgacgtgaagatcgcaaggatgccgttgccgacgaagagcaccagaaacccccaagtcggaaccttggtgcgcggtgagacgtgggcaaagaagcggttcagcgccgcaagcggccacatctcgtcacgtccagaggcgtagtagatgcgcgcataggcaaggttacccgcgagaccagtatcgaacatggcgatgatcaccccgacgagcaggatcttcgcccccgtcggacccatgacgcgatcggcaatcaacgagagtggtgacgcgctctgtgccgtgtgcgccagaccgtggatggccaaggtagcagccaccaccgcggcgagttcgaagagcacgctgatgcccacggcaagcagcacggctcgaggcagggcgcgacgatccgtggtctcctcggcaaagtagagcggccagtcatagccgttgtaagcgaacagggccggaacgacggcgatcagcacggcagagagcccgaccgttccgagcacgcccttcgaaccgatcggaacgacgggatggacgagcaggcgccccgggagcgccgggtgcgcaaaggccgcgatcgcaaagacggtgatcaccgcgagctcgagcaccagcatggcggccgtcatccagctggtcggtgagattcgatcgagcgacaagagggtgatgatcgccatcatggcgaacgccgtccagttcaccggcagcgccggtgccaacgattgaagatacgtcgccgcagcaacgaggatcgacgcggtgacgacaaccccgagcacgaggaagagcacgttgaccacgccgccgccgatcgggccgagggctcggcgaacgatcgtgtaggcgccccccgcagagggaaacagcgagcctacctccgcatagcacaacgccatcgcgatggcgatgaccgcgccgatggcgaacgccgcgaccacgccggtacccgcagtcgcgataccggctccgaacaccaagaacaccgacgtcgtcggcgagatcgccgccaccgcgatggcaagcacgttcatgggacgcagtgcacctcgagccaagccctgcccgccccccgtgcgctccctcgtcatcactccccctccttcgtggcacgtgggacgatggtagcaaagcgatggcagaatggtctgacctttcgtccattgttcacgctgccgtgatctgtcaggtgccacgagggcgccgcccgatacgatgatgcgacgtgggccgagagcatcagggggcggttcctcccatcgccgacgtccggggccacctcgatctctcgcgaatcctgcgacctcagagcgcaccagaccagatcgccgatcggatcctcgccgccatcgccgtcggcattctctaccccggcgaccggttgccgcccgaacgcgagctcacctcgcgcctcggcgtctcgcgggccacgctgcgcgaagccatcggccgcctcgccgccttcggtgttctcgagacccgacgagggcgcgggggcgggaccttcgtgactggcgtgcatcgcgagagcgaggaacgcgcagcgctcgaacgagccctcgcgccgatcaagtcaacgctcgaggcactcctcgattaccgcaacgtcgtcgagcaggcgctggcccgtgccgctgccgagcggcgcaccgatgacgatgtggctgcgatgcgcagcgccctcgccgcgtacgaggacgcagcgagcgcccaggcttctcgcgcagccgatcgcgcgctgcacgaggccatcgctcgagcgacccacaaccctctcctcgaacgcgccaacgcagaactgttcgaggggacgaacctgggctttgactcccatccgtactcgccacagctccatgcgaaggctcgccagcaacatcgcgccatcgtggacgcgatcgcacgacgcgacgtcatcgcggcgggcaccctgacacacgagcacttcctcgtgaccggaacgtacccgctcatcgatccggacgagcccgatcacaccgctgcgcgagcctcgacggcctgaggcgctcacctcggggcgcggccaaccccacgctcgcgcgacagccttcccgcgcggcaccgccagcacgggccgtcacgaaggccaacgcgcaccgatcgccccgcgccaacgcgcgcgcgtcacggacacgaccgcgatcgcgcccgagcgcgacgaaggccggctcacccgatggcggcagcgctcgcgggatcgaagaagtagaggcgctcaggatcgatgccgatcccgacctgctgaccgctcttcaccgactggtcggcatcgatcctcgcaatggcctccgcccctccaccgacgagacccgccgcgggttcgagatcttcctcgtcgacctcgaggcgatagggggtcgcgtctacccgaacgtgcacgagctgttcgttcccgagctcctcgaccagctcgaccgttgccgcgagtgagttcggctcgccgacgctgccgaaacggccgagcgcgtcgggtcgcaccccgacgatcaccgcaccaccgacgtgcgccgcgatggccggatgggcggcgagaaaccgttcgtcgaggccgatgcgctgcgaaccgagcatgagagcgacaccgtcgtcacggacgagggatccctgaaagaggttcatcgcgggcgagccgatgaagcccgcgacgaacaggttcgccgggcgctggtagagggtttggggatccgcgtactgctggagctggccgcggtgcaagaccgcgacccgatcgcccatcgtcatcgcctccacctggtcgtgggtgacatagagcgcggcgacaccgatcctgcgctggatgcgaaggacctcggcgcgcatctggacgcgaagcttcgcatccaggttggagagcggctcgtccatgaggaacacattcggctcacgcacgatcgctcgccccatcgcgacgcgctggcgctgaccgcccgacagctgcgacggcttgcggtcgagcaacggctcgagtccgaggacatgcgcggcctcgcgcactcgccgctcacgctcgccgctcggaaccttggccagcttcagtgcgaagccgatgttctcctccaccgtcatatggggatagagcgcgtagttctggaagaccatggcgacatcgcgctccttcggcgacagatcgttgacgacccgatcgccgaagcggatggtgcccgaactcacctcctcgaggcccgccaccatgcgcagcgtcgtggtcttgccacaccccgaggggccgacgagcaccacgaactcgccgtcctcgatcgccagtgacagatcatcgaccgccacgacaccgttcgcatagcgcttcgtgacaccgtcgatcgtgatgcttgccatggaccctcctacgacgcggacgactcgtccagatcgaccacaaccacctcgctcgaggcgagctggagcgtgccccccacgcgctcgctcccgcgtcgccgagttccaacgagcacacgcccgccatccacgtcgacggtccggtcgccgtcggcaaggttgacgtagacctccgtctgcgttcctcgtcgaaagcgaaggacaccctcgggcgcatcgaggaaacgaatcccgccaacgacgaggtcctcacgtgcacgccgcgacgcgatgatcgccttcgtgcgcgcaagcaccgaggtcggatcggcgagctgctcctcgacgctcggatcgtcaccgaagggcagccacggctcgaccgagggcgccgtgaacccggcgccaggtcctggttgccatcggataggggtgcggcaagggtcgcgcgagacgttgccaccatcggcatgctggcccatggggtcgcggacgcgctcgggcggcaccgagccatcgcgcatgccaagttcgtcaccggcgtagagcaacgccgcgcccggcaggaggaggatcagggcgaccagcgcgagcgctcgctctcggtcgccatgagcccagcgggttgcgagcctggagacgtcgtgattcgaacccgtccagagcgggatcgctcccaccggcagcgcggcgatcgtcgtctcgatcacccgacgcagcgaagatgcatctggctcggacgccatgaaccccacgttcaggcacagatcgagttcgggcgcctccgccgagccgtagtagcgagcgagttcgatgggatcgaggacccaggtttcgccgagcaacacgcgggccggttcccacttggccaccagctcatgccaccgacggtagatctcgtgcacctccgggcgattggccgagtagcgcttcagcttccctgcccaggcgatccacggatgcgtgccgggaggggccggaggatcgtcgcgccccaaggcgtccttcacgagcccgtgcgccacgtcgatgcgaaacccgccgacgcctcgctccagccactcctcgaggatcgcttcgaaggcggcgcgtacctcggggttccaccagttgagatcgggctgggtcgggaggaagttgtggaggtagtactggccagaggcgggatcgagcgtccacgcggacgaccctgtggcatcgacccagttgttcggcggcccaccatcggcgcgcggctcggcgaacacgtaccacgcacgtctcgggctcgacggatcagcaagcgcctcttggaaccacggatgctgatcgctggtgtggttcggcacgagatcgatgagcacccgcagacctcctgcctcggcatcggccatgagtccccgaaaggccgcctcaccgccgagtgccgggtcgaccacgtcgtagtcggcgacgtcgtagccccagtcggtccgtgggctcggcatgatcggtgacagccagatcgcatcgaccccgagcgtccggaggtagtcgagtcgctggcgtagaccgccgaggtctccgagaccgtcgccgtcgctgtcggcaaacgaccacacgtacacctgatagagcaggcccccggcccaccagcgtcctccggcccgcgctgccgcgagcgtcgcaccaagttcgtccaccgagtccattcgcgccgatgcctcctaacccttcaccgcgccagccgtcaaccctgagaccacccacttacgaaagacgaacacgaggatcccgatcggtacgatcgccacgacagcggccgcgaagatcgtaccgaagggaatcaccgtcggcgatccgaagagcgcgatgcccaccggaatggtccgatagctgttggagctatcgaaggtgagcgccatgaggaactccgtccagcaggccgtgaaggtgaagatccctgcggtgaagacccctgggagcgcctgcggcaggatcaccgaccagacggtgcgcagcgtggatgcgccgtcgacccgggcagcctcttccatctcatgggggatgccgaggaagtagttccgcaagatccacaccgcaaagggaaggttgaacgccgtgtaggggacgatgagggcctgatagctgttcagccaattgagctggcgcagcaccagatacagcggcggcaccaccgcgatctcggggaagaccgagatcatgagcaggaccacgagcaccaccgcgaccccgcgcatgggcagccgaccgaacgcgtagcccgcgagcgtcccgagcaccagcacgagcgcggtggctcccagcgtgacgatgaccgaattgagcacgtaacgcccgaagccgtagtggacgaacgcactctggtagttcgccagcgagatcggattcgggatgtactgcgtaggcgaagccccgatgttcacgggggtcttcaacgacgatgcgagcagccagtacagcggtgccgcgatcaagaccacgacgagtgccacggtagcccaccgcccgacccgggcgaggggacgttggcgacgagcacccatcacgcctccttcgccgcgccgacttgggcgcggaagactcgcaggaacacgatgcaaccagccagcacgagcgcggtcgtcgtggtcgcaatggccgcacccggtccgaaactcacatcctcgaacatcaccttgtagccgagcagcgcgagcgacgtcgtcgacgtcccaggtcccccgccggtcagcacgaagggaaggtcgaacagcccgaaggcctggagtatacgaaacagcgtcgcgatcgcgagcgtcggccgcaggagcgggaaggtgatgcgccagaacgtcgtccagcccgaagcgccgtcgatctgggccgcctcgaagacgtcctccggcagcatcacgagacccgcgagcacgatgatcccgacgaacggcgtcgtcttccagatgtccgccaccatcatcgagatgatcgcaggagtcggcgtcccgaggaacagcggatggccaagcccgaccgcctggaacaaggcgtcggccacgccgtaagtcccctggtagatgtagccccacagctcggccgagatcaccgtgatcatcgaccagggcaggagcaagagggccatgaagagccctcggcccttcgtcaaccgcgccgccacgagtgcgatcagcgtgccgagcacgacctcgacgaagaccgtgatcacggtgtagccgaccgtgaactcgagggcgtagcgccatacggcagcgtggacgatctcgctgtagttggcgcccgtcgcgccgccgagctggaagcccgcgccggtcacgttgacgttggagagactgagcacgatggagaacacgatcgggaagaccgtgaccgcgccgatgacgacgagcgccggagcagacagccaccaccctgctcgagccaggcctcgacgagcacgatggtcgtccgaccgttgtgcgggtgcggtccgaggcgggaccgcgataccagcgaccatagaactacctccccggcggcaccgatggccgacgatcgacctcacaaacctcgacagcctggcgtcggatgcgccagcgcggatggagctcgcccgggaggcccgagcaacgggaccctcccgggcgaggagcgacgactagatgccgccagcgagcgccgtgttgatctgcgacgccgcagtcttcaaggcagcgctcgggctcatcgaccccgccagggccgcgttcacgttggtgtaaatcgccgaggacacctgcgggtagttcggcgtgcccgcgggccgcggcacgagccgcgtctcggcagccaccttgatcgggggtgcgatcgacgggtccttcgcgagcgcgagccgcaccgactcgaccgtcgggatctccgagtaggtcttgccgaggatgtcctgagcctgtgtcgaggacatccacttgatgaagaccaggtcggcggcgaggttcttcgagtgcgggttgatgtagaggttccagccgccgatgttcgagtacccgggataggactcgccctggaaggtcggcaacggggcgacacccacatcaccgacgaccttcgagtccgatggggtctgggagttggcccacgcatagtcccagttgcgcaggaaggccgcctgacccgagtcgaagaccgccatcgcctgaggctcttcgaaggtcgtgacggccgcaggcgacgcgcccgaggtgatcaagctgcgcatgaacgtgagcgcgcgcaacgccgccggcgagtcgatggtggccttcgtataggagctgttcacgacgctgccgccagcgctcgtgaggtactccatgaagtcacaggtcaacccctcgtagctgttgccctcccagacgaagccgtacttgaccgcgttgtcatggaccagcgtcacagcatcgctctcgagctgctcccaggtcttcgggaccgggagatgatacttggcgagcaggtccttgcggtagtagaggaagccctcgtcctcgaacagtggcgatccgtacaccttgcccttgtaggtcgcgccttgcacgagaccgggggcgaacttcgcccagtagctcgacggcaaatagttcgacagtgggacggcgaagccatgcgccccgaactcggccggccagatgacgtcacccatgaacacgtcgggcgtcgacgcaccaccggaaatggtgttgacgagatccgcacggttggtgtcggtgttggtgggtgcactcaccaagttgacgtgaatcttgggataggccttctcgaaggcgcggatcagcgcggcgcggattcctacctgcgcaatggggctcgcccaccaggtgatcgtgccgtgcgcactggatagattgacgccagacgtcgtcgacgaggtcgacgaggtcgtcgacgacgacccgcaggcagcgagcagcgccatcgaccctgcgagaacgacaccgacggcaccggagcgccgcagtcgccgccgactccgtgtcgtctgctggccctcggtcgccctcgcgaactcgtgtcggttggttccgtgactcatacgtatccccctgtctcactcccggcgcgcggtcgtggccgcgcgccatcctgacacgtcttcctacgtcctcgaaccgctcgtcaccgctcgacgcggcgcggtctgcacacctgcacctcctctccgattgccgttgcgatcgccccggacccgacgatccgcgctcaaccccgacgactcgtcaggcgacacctggcgtcgtactggccccgtcgttccgcgaacgatgacctcgagcggcagccatacacggccgccgtcgacgggctcgccatggagccatgcggcaagtacccctgctgcccaggcaccactcccctcgagcggctgacgaaccgtcgtgagtccgatcacctcggcgagctcgatgtcgtcgaaacccacgatggagaggtcgtcgggcacgcgcaggccgagctccgccgccgtacgaaggacccccatcgcctggacgtccgaggcaaccgagaccgccgtcggcggcgagccgctcgcgagcagcgaccgcacgctcgccgcagcttcggcgacgccgaagggaggatggcgaacccaagcacgccgcaaggtcaagcccgcctcattgaggacctgccgcacgcctcgctcgcgctccgcgctcgcagagaagcccatgccgacggccggccgatccccgacgaagccgatgcgctcgtgaccgagcgagacgaggtgcgaggcagcgagtcgtccaccgagcacgttgtcgatgacgaccgacggccaaccaggggcatcgtggtcgacgctcacgacgagtccaccgcgctcacgcagtcgcgatgaccacgcatcaggcacctcgatcgagatcgccacgatcgcgtcggcgacaccctctccgaccaggaccgcaagggcgcgttcgcgctggtgaggatcggcaacgtccacgaggacggggtcgaggccgagcggtgcgagcgccttgatgaggccacgcacacgctcgacgaccgatgcctgggtcacgccgctcaccagcacgcccacgacgttcgactcacggcgccgcagcgaacgagcggctcgactgggccgaaacccgaggtcacggatcgcgtcctcgacgtggcgacgggtgacgtcggccaccgggccggaaccgttgaccacgcgtgagaccgtcgcgatgccaacgcccgcctgacgggcgacatcgcgaatggtcacgcgatgattccgcgccccgagacgcccaccgcgagcggtggaaccgtttccacgcacacccagattgtgcgtcgcagccatcgcgccgtcaaggaattgcctggctccgcctcaggctgtgctcaggaatcgagccaggcacctgcctcgttcgcccacgcgcccaagtccacggatctgggcgcgcgctgcgcgacaccgaggcgcgaggcctcatccggcctcgccgccaccagagctcgcgacgacgcatgccccacgcgctgcacgacgagtggtgctcgcgcgccgtcgcgcatcggccctctcgacgcaccgggtgcgcgagcacagccgaaccgctttcgcagccgccgatgccccgaccgacgatcaacgatcggccgacaggcccgagatgacgctacccccggtacctcgtggtagcgggggtagccatgcatccgagagggaatggagaaggactagcgccggaagaatccccggccgccggaggaggagccgcattggcaccgatcttccggcggaatgtgtccgagaacctgctcaacatgctggccgcagccagaccaggtcggacgcttgcactgtggacaggtcaccgctctgcacatacccaatagggtatcacgtcttcgaggacatccggccccgataccgcacgattcgcccgcgcggtcgtctcggcgtcagcgcccctcgagcttggccagcacgcgacgcgcacgctcgcgtgccccgatcgagctcacgaccgcgacggacgcgacgagcaccatcacgaccccgagcacgacgaacgcgatgctcggccagcgagcaaggatcacgccggccgcaaccagcacggtgcccacagcagcgccgaaaggcacgggttgcgcgacgacgcgataggcctgctcacgcaccaggggctcgagctcgcgcggcacgggcccacggcgcagcgcaaggagcacggcagctcgctgcgagcggtcgagttgacggaacgactgcagcgccgtccgcagacgcagatcgcggcgagatgtcgtccggagccggacgagatcgacgacgatgcctgcgaagccgacgatggtgaggaccagcccaacgaaaccgacgacccccgtcgccgcgcgagcgaccgctgcgaccatgagcacctcccgttgcgcgaggctagcgctgcggatcgccgcagcactcctacactcacggcgtggcccgggcgaggagaccgtgacgaccgcagcgaccgcactggtcgtcctcgatcttgctcaactcatcgccatctccgtcgtggccgtcaccgcgcgtcccctcggcaacgtgggccgacgggctctcatgctctggcgtgggttcgcctggatcgccctcgccgccgccaccgccatcgccacggcttcactcctcgcgtcgcaccatcgagcagccccgatcggcgtcccgacgctcgccgtcgacgagacgttcgtcgccgcggcgctcgtcgccaccgcaactggtctcgcgccgaaccttcgacggagcgcgacctggctcgccgcactcggagcggctgcaagcgcgggcggcatcctcgccctcgtccctatcccgctacttgtcatctggccggtcgtcaccttcccggtcgccgtcgcgatcgccgcgctctggcgtcttccgcgccgctggccccgaccgctccggggagcgctcgtcgccgtggcggcgatcggcctcgtggtcagcttcctcctgcatccgccccccgtctccctcgagatcgccggaacgccccaacacaccttcacgatcgccgcacccgctgcgcaacgtgcctccatcgagacgctgtcgagcggggtgctgaccgacaccgagcacaccgcccagcgatcggtgacgctgtcgctcgcgggcgtcttcgacgcttctcgaccgaacttccaccaggtcgtgaacgtcgctatccgactcgtcggccgacccgccctgcatctcgtcgtcgacgcagcgggcatcccccaacccaacggcgcactcgcgctcgtgcactcgcgcatctcgctccagaccgggcgccggttcctccgcggcgtcggacacctcacgaccttcgcccccgatgccctcatcggcacactcggcatcgatcatcatgcctggtcgatactcgtcagcctggatcccatcggcgacggtaccactcgagcaaccgtgacgctgtggccctcggtcggcctgcacctctcctgagcgccgccaggtaggctatcgcccactcggtgaccgtagctcagctggttagagcgccagattgtggctctggaggtcgggggttcgaatcccctcggtcaccccatctcgcccgccgacacgatcccccaggacctgcgacgactcacggcgacgtggtcgcgtcgcgcatgccgcaaccgcgggacggcgctcctgcacggggggcgctggtgtgaggcgtcgtctactcccagagcatgtcgctcccagaggatattgttcccagcggatattgttcccagcggatattgttcccagcggatattgttcccagcggatattgttcccagcggatattgttcccagcggatattgttcccagcggatattgttcccagcggatattgttcccagcggatattgcccccagaacgtagggccccgaggcgatgtagcagtcggaccgtgccgcgtgagacaactattgggccgacgttggagcctctctgtgccgatgtccccgaaccgacgaccctcacaagtcgctgcacggtcgcgagcactctcgcgacaccgacctcacccgcgttctggccgcatcgtcctcgggcgctcacgccacacgatctcgagggcgtcagggagctgcgccagctcgaggggacgagctcaaatggagaagtcgatgacgctctcggactgctcggcgagtcccgggagcaccgtgatggtaccctcgggggtcgttccctcgatcgtggaacacaggcgggggtcgcgacggacgacccgcgccggcgcaccgacgacgacggcgtgtgacggcatcgactcgaggaccacggcgtttgcaccgacgtgggtgtcgtggccgatctcgaccggcccgaggatcttcgcgcccgcaccgacgaccacgcgatcgcccagggtcggatgacgcttgccgtgctcgagactacgacccccgagcgtcacaccgtgatacagcgtgacgtcctcgccgacctcggccgtctccccgatgacgacaccggtcgcgtgatcgatgaagaggcctgcaccgatgcgagctgcagggtgaatctcgacacctgtgcgccgccgcagccagtaggacaaccaccgggctccgaaccgatggccgcgctcccagagtcgatgggccaggcgatacccccacaccgcatggacgcctggatagagcaacgcgacttcgatgcgcgaacgagccgcagggtcccggtggagcgccgcgtcgaggtcgcggcgcatctcgttcagcatcacgcgtccgccaagtcggcgaagagcggcgtcgagaggtaccgctccccgaaggacgggatgatgacggcgatgagcttgcccgccgactcgggccgctgtgctacgcgccgcgccgcagccacggctgcgccggacgagatcccgacgagcaggccctcttcgcgcgccatccgccgagccatctcgaaggcctcatcgttcgtcacctggacgacttcgtcgacgaccgttgcgtcataggtcccggggacaaaaccggccccgatcccctggatcgggtgcggtcccttctggccacccgagagcacgggagaagccgcgggttcgacggcgatcagctgcagcgagggtcgccgtggcttgagcgcctgaccgatgccggagatcgttccacccgtgccaacgcccccgaccaccacgtcgatcgcgccgtcagtgtcccgccagagctcctcggcggtcgtggctcgatggatcgcgggattcgccggattctcgaattgctggagcatgacgtagtcagggtgctccttgacgagctgttccgccctggcgatggcgccgcccataccttcgggacccggcgtgagcaccagttcggcgccgaaggcacgcagcagcatcctgcgctcgcgactcatcgtctcgggcatggtcaagatgcaccggtaaccgcgtgcggcggcgaccatggcgagcgcgataccggtattgccactcgtcggctcgacgatggtcgacccgggcttgaggcgcccctcgcgctcggccgcgtcgatcatggccacgccgatgcgatctttcacgctgttggcagggttgtagaactcgagctttgcgacgacggtggcccccgccccgtcgatcacgcggttgagtcgtacgagcggagtattgccgaccagcttggtgacgtcctcagcgatacgcacgcgtccctcctatcgcagagcctgcacatgctctaacgccaagcctagccaataattccgatctgttctatcgactttgtgcgcggtgggtcagcgaggtcgctccgggacccaccaccgttcctgtccgtcggtctcgacgaggccatcggcacgcagccctcgcagcgccgcttcgaggcgatggtcgtcgacacccgagtgtcgctcgaggtcgcgcaggctctggggaccggcgaggagtgctcgcaggacacgggcccgggcctcacgaagcgaaccgacatacggaccctgccgatgccgcgacacccacggatcagtgagtccctctcggtgggttcgacacgaccggcgtagctcgcacgcatcgcactgtggcgccgctcggcaccgcaacgcgccgacgtcgaagactgcctgcgtcagccgatcggcgtcgcatccgttcaccagctcgcacccgacctgctcgaggatcgagtcggatgcgggcgcgccgaggagcgcgcgcaccaggacccgacgcgcgttcgtgtcgatcgggagagcggcgagcccaccgcactgaaccgcaacggcgcgggcgacgtagcgccccaccccaggcaacgcccgcagcgcgtcctctccgacggggcaggcgccggcccacgtctccacgatcaccacggcggcgcgccacaggcgctcggcccgccggtagtagccaagtcgtccccacgactcgagcgcagcgacgagtccgccgtctgcaagcgcgcgtggcgtcgggaagcgctcgatgaaggcgacgaaggtctcttcgaccctcgcaacttgggtctgcaccaacatggtctccgcaaccaagacgtgccacggatcgcacggtcgcgcccgccagggcagcgggcgcaggtcgacctgcccgaggtcccgacgcagggcttcgagccgtgactcgtcgaggctgtctccaggcacaccaaccacggtagaagaagcacggacccgacacgagctcgcacgcgcccgctgacgggtcctcgaggcgcgccgtgtcgctacccgcacggcaggcgtgcctggtgtcctcgatgcacgacgaccgggcctcgtgatggacccgaccccgaaccgagcgacgacgggggcagttcgtcgatccgtcgccggccccgccccaggcccaatccactgcacgctgacagagggcgcgcgtttgggagctcctcgatggcacaacgccccccgcaccgagatttcgcaaggaatctttcgcaaattttgttgcgcaaggattccttcgtaactagcatgggagccatgaccgatgccgccgcgaccccacgacacctccgcgacccacgcgcgttgcgcgcactcgcacacccgttgcgcatcaagctcctcgaagccctggtcacccatggcacgctcaccgcgacgcaagccagtgagctgttctcgacgacgcctgcgagctgctcgttccaccttcgtgaactcgcacgcttcggcttcgtcgagcgcgctgacggtggtcacggacgagaacggccctggagggccgtcgccgcccccctgcacttcgacccccacgccgacgacccggacgaagccatcgcggcgagcgagcttgctcgcgtcctccagggccgctggatcgagcgtttcgaaggctggtcgcaggtggcccacacgtatgcagcaccgtggcgccacgcgctctcgacatctcagttcgtcgtctggctcacccccactgagaccaccgacctgctcgccgaactcgctcgcctgatccaggagcgctacccagaccggctcagcgatccctcgacccgtccccctgacgccatggctgtcgagatcatcctcgatgcgcaccccttcgacctcgaggctggcggagcccagcaccaatgagaccggcggttcccccggcccttcgcgagccgggctttcggctcctcgtcgccggacaactcgcatccacgctcggcgacctcgcctacgcagtcgctctgccttggtacgtcctggcccagcacgacggtccaatcctccttgcggcggtcctcgccgcctacggggtgcctcgcaccgcgttcgtcgcggtgggcggcttcatcgccgaccgagtgcggccctggaccgccatgctcatcgcagacggcacgagaaccgcagccgccgggctgcttgccgccgtcgcactccacggaccggcacaaccagccgtgctcatccccatcgccctcgtcctcggcgcctgcgaggggatctttctcccggcgtccttctcgatcatcccagcgctcatcgcagccgaccaactccaaggagccaacgcgacttcaaccgcggccacccagctcgccacgctgcttggcccggcgttcggcggcctcatcgtggggatcgcaggcccaggtaccggcttcggcatcgatgctgcgacctttgccgtctcggcaggatcgctcgcgctcatcgctcaccatcgcaccgacgacgcggtccactcacacggtccggcctcgacgagcacacggcaagcgggccccgccccctctcctccactcacgcttcggcgcctcctcgtgcacgagccggtgctgctcctcatgatcgcaaccacggtggctgccaatctcggcctcggcggcctcagcgaggtcgctctgcccgtctttgcgcgcaccacgctccacgccgatgccactggctacggcgtcatccttgccagcttcggcgccgggggcctcgtcggtgcgctcgcggcagcgcgcctccctcggctacaccgaccgctcgtcgtcggcggcaccctcctcacaagcgcgaccgtgctcctgcttctcatgcccgcaaccgcatcgctccccatcgccgcgatcgaccttgcgggcttcagcgctctcctcgccgttgcgaacatcgtcatggtgacggccgttcaactctgggccgatccgcgcctgctcgggcgcatcatgagcatgatggtgctcgcctcggtggggctctttccagtctcagttgccatcgccggtttcgcggtacgcgccatcggcgcgtcacgcttcgtcgacgtggccgggctcgccttgctcctcgctgcgctcgccgtgctcgcaacaccagcctcgcgtcgcttcgcttcaccaccagcggcgcccgcgcctgagcttgcggagcccgccgactagcgcgccttggttcacgcgcgccgccacgcctttcccccgcacgcagcctcgacctcagcgcgttccacgcgagcgaacgcgacccgtcgtggcgcctggcaacagcgcctgtccgacacgcgtagctgccacagtctgcactggcgccacggaaacccccgagacggcgagttgcgcctcagaagactgcggcgagacctagcagacgtgacccgcgggcgcgctgcaaccagcaagcacctcgaggtgggcggcggactcgaacgcactcggcgtgccgacgggttcgcctaccacgagccaggagaagtgaccggccaaggggtcgccgaagaaacgaccctcgtagatcagatagtcgcccgctggcaccaccccgccgacgaggtctgtcggctggatcaaccagtagcccttcgcatcgactaccggccacacccgcactggatccggtcggccgccgggaacggccgcttcggccacctgggccgacgctgggaactgaccctgctgggcttgaccgttcaaggcagtcaggtcgggttctgcgcttccaagagcgaagtactccgcggcgaccgccggcatcgaggcaccccagaccagccacggacgccaaaggggactcgtcggcaagctcacctcctcggccacggaaccgtgtctcgtcgtcaccgttacgttgacgccggccgaggagaaggcctcggcctctgcgctactcgtgtacggcaccgagaacacgatgtgctgatcagaccactgtcgcagcgtgccgccgctcgtcgccccgccgaggatcgccgacgcaagatcttgtccgttggctcgagcaaccgtgaacgagtccgcgttcggcgtgtctcccagcctgctcccctcgaccgacaccaccacccccgtcggcaagctcccgtccgggctcggaacgaaggagagctcgatccccgcgatgtccggcggagcagcgctactacttgccgacggtgtcggagttacgacaggagtggtcgtcgagtggctcgcacgctgcggtgcagaggcgtgatgaccgcttgagacgaccgcaccgcacccggccattcccacccccgcgagcacgagcaaggaagaccatcgcgaacgttcgaaccgcactgtcatgcctgccccctctcactcgacccacacgcccacgaccggacggcaggtcttcgggtccacaaccccggtcatctccaacctgcgcgcatcgtgcgacgctgtcaagcgctgcccagggtaggcaccggccttcttgtgacccggggtcagcggtcagagccgacccgcttgcggcacagctgtcgacggtgccggtagagtcatgacactcggcgtcacctcgaccgagcacctgctcgctgacgccgagctcgcgggcgaactcggcgatgttgcggtgctggccgaggacgagcacggccgcgtctctacggaactggtcgaggtcgtggcctcttcccaggcgagcgggtccgttagcgagggctggtggcggtgtccagttcatcccttcccccgtaacaagtgtcaacccatttgggaaggcaatcctcgccggatgcgtggtcgtgccgtacgtcgcccggtcaggcaaacggaggaaagctcgcgcgtcccttgtctggccctgggagacgggtcaataaccgagccgctactcccctgagcaccggggcgtcctctcgagcgacggtccacacgcgctcgacgtttacgtcggcgtaggcgtgaatgaggacgttacgaagggccttgaggcggccccaagggatctcggtgttgctgcggcggaaggcttcgctcagccgacccgccgcctccccgatgatctccaactgtcggatgaccgcactttgcttctcgtcattcgcaaggaaggcgtcgtacgacactccagccaagtaccggtcaatccggtcgcaagcgaccacgatgtggtcaagatacacgctgtctgtgtggcgtgacatagatcgtgcgccgatcggccagcacttgttcccggatgaatcggtgcagcaggtgaggttccacgagatcgacacgccggcgcaacagcgccccgagttcctgctggacctcgatcaggtcgagcaggctccgcaccgggctgtcgggctcgaacgtcacgagcatgtccacgtcgctcgttggcatgaagtcgtcgcgcagcaccgacccgaacagagccagttcttcgatgccgaagcgatcggccaaggccgccaacgcggcgtcgtcgacgctcagcctgggatgctcgcgaatgatcacgctccgcgcctcctgatgcaaggctaccacggcgcgaccgcctcgcctcgaaggcgacaccagctcgtaacgcgatgaccggctccttgtccccgcgcgaaggggccagccagcctcttggcgtcgcttggtggcgcacgcacgacaaggggccttgccgagcacgtcgacccaccgcagctgagcacggtaaccgtcgcgatagcgggtggtcgaacccatccctctggtaggccgcgtgccaacctacccaagagcgtcccacctcagtgggttgggccataggttgctttctaggtagcaggagcacccaagtctgaactatgcagcttcgcacctagcgcctcagtgaggagtgatgctggtcgggctggccggatttgaaccggcgacctcttgacccccagtcaagcgcgctaaccaagctgcgccacagcccgttgccagcgagtctaccgagcgagagtccgggggcctcctagccttggcggccgtcgtcgagaccaaagcgacgagcggcgctcacgacctcacggcgatcagggcgttctcgatcaagcccatgagagcggacgatgtcgtggagccggccggagatctctccgacggcctcttgctgctgatcggtggccgttgcgatctcacccacgcgaccttgcaccgatgcgagcccgtccacgatccccgccacggcagcccgagccgaacccccaagttcgacgctgcgctccgactcttcgagaccttcgctgatcactcgcacggcctcgctgacgccatcgcgcacttcagcgatgccgaccccaatctggtgcgctagctcgcccgcacgacctgccagctgtcgaacctcgtcggcgacgaccgcaaacccccgtcccgcagtccccgcacgagatgcctcgatggcggcgttcagggcgagcagattggtctggtccgcgatccccccgatggccccggcaacggcatcgagcgaacgggtgcgctcggcaagggcggtcagcgcctcggaggtgctccggattcgctccgacaggaccccgaccgcgtcgatcactcgaccgaccgtggcgtccccgtcgcgagcagcctccgatgcgctcgtcgcgagctgtcgcaggtcccctgatgcgcgcgcaacctcggccgcagaggcgcgcagctcctcgaccgcggccgcgatctgggcgacgcccgacgagagctcaccgaacctcgcctcggcacgaaccgcctcctcgcgcgccagttgttcgatcgccgtccggtcgaaccagtgagccaggtaacccacgagccgaccccgatcgtgcaccggacgtacgtgggtctcgaggatgcgatcaccaatccgaatctgggcgctgtgactcccgccgcgcgcccgcagttctccgagcacgcgtcggacgcgctccggatcgcggtggaaccgatggatgctccccccgaatgcatggcgcacgtcggcgccttgcaagccggcgttcagctcgacagcgtgctcggcgaagagggcctcggctgccgggttgacgtagacgatggtctgctctccctccggttcggcgatcatcaccgggatctcgaccgcgtccagtgcagcagcccggagctcgagagaacgaagtgtggacggagcgacgacgcgaagagccatgcacgaggtatcggcccgagatctgattccagttgaggacggggtcacgaccctctgtcgtcctgctcaggcgtggcaggtcagcgggcgtccgccgttgtaggcgatcatatcgccgaaggcagcgagcacatcgacctcgcgcccatcgagctcggcgatcgctcgatgcacgttgccgacgaggcgctctgggtccaaccacgcagcgaactcgccgagatcgacggagcgcgccgcctcgagcgggggcaccccggcctcgtgtgcttcgtgcgcgaggtgccacacgaagcggagatagcgctcgacggcgtcgagatcagccgtcgtcgcaagtgggccgtgccccggcacgatgacgtcggcgtcgaaggttcggagccacgcgatgacctcgatccagccctgcaccgacccgcccagcgcaaagggggtgccgccgacgaacaggaggtcgccagcgaagagcacgcggctctcgggcaaccagaccaccgcgtcgcctcgtgtgtgcgcaggccgacccgccgccctcacctcgatctcgtgatcgtcgaaccgcagggtaagaccgtcgtcgaagagcacgtccggcatgcgcacgtcgatctccccccactccaccggcgtgaacacgcccggcggcggcacgacgatcccggtcgcgagctcctcgggcaccgagcgctgagcgatcatcacctcaggatcgagggttgcggtgccgttcgtgtgatcgccatggtggtgcgtcgccaccagcaggcggcgcgatggtgctccgacgcgtcgagctgcctcgaggagcgcctgggtacgacgcacggttgcggtggtatcgacgtggacgctacgctccccagcgagcacgattcctgcgttcgacaggaaccaggagccatcgggttggaggtaggcgaacacccccggggccagctcctcgagtacgccgtctcgacgcggcgtccatgacgacgagctagacgagctagaggacatggtgcagccacatgatgagctggatgaggcgataggtcaggtagatcaccgtcgcgaccagcagcagcttgaagtgccacggggttcgcttcggcggtgcgatgacggtaccacagctcgggcagtgcccttccttgtccagctccgtggcatcctggaagcgctcgcagctctcgcaccagggcatgcctcaagcctagtggcagcgctcaccgaagtgcggtgctacaccggtggtaccccgtgtcgacgctccgagaaatggcgatccttgaccgccgcacggctgagtcgagcgatcagctccgagcggaggtcctcgggttggacgatggcatccacgacgaggtctgcggcgagccgaacgaggtcgacgtcgcgctcgtactcctcacgacgagcggcgacgaagcgctcacgctcggccggatcgtcgatctcctggatcttgcgatagtaaaccgcgttcactgcaggctctgggcccatgaccgcgatcgacgcccctggcagggcgatcgtcgcctcggggtcaaaggctggaccgcacatcgcatagagccccgcaccgtaggccttgcgaacgatcacgctcaccttcggcaccgtcgcctcggcgaccgcagtgatcatcttggcgccgtgacggatgatcccctggcgctcgacctcggagccgatcatgaaccccggcacgtccgcgaggaacacgagcgggatattgaacgcatcgcagagccaaatgaagcgagcagccttgtccgcggagtccacgaagaggacgccccccttgaccgcagggttgttcgccacgatcccgatgctctggccgtcgaggcgtgcgaagccgatcacgagctccggggcgaacagcggcttgagctcgaagaagctccccgcgtccaccagaccctcgatcacgcgatggatgtcgtagccttgctgtggagcgtctgggatcagtgaccgcacgagcggcacgagcggctctcgaggctcctcacggggaggatcgccctcgaagtcgctcggcagatacgacaggaatgctcgagccgcctcgatcgccccacgatcgtcgacgacgaggttgtccccgcatccagagatcgtcgcgtgcatgcgcgcgccgcccatctcctcgagcgtcacgcgctcaccgatcaccacctctgccatgcggggagagccgaggtacatcgaggcgtgtccctccaccatgaagaccacgtcgcagaaggccgggatgtaggcccctcccgccgccgatgggccaaacagacagcacacctgcgggaccctgcccgagagacgaacctggttcgcaaagatgcgccccgcaccccgtcggcccgggaacagctcgacctgatcggtgatgcgagctcccgccgaatcgaccaggtagatgatcgggagtcgatggcggtaggcgagctcagtgatacgaacgatcttctcgacggtgcgcgcaccccaggagccggccttgacggtctggtcgttcgccatgatcgccaccggacggccgtcgacggtgcccgtaccggtcacgaccccgtcggccgggagcgaggggtcggtggcgttcgcgaacagaccgtcctctcgaaaactgcccgcatcgacgagcagaccgatgcgctcacgcgcgtgcaacttgcccgaggccacgagacgctcctcgaccgagctcggccaggcgtacttcgtggtctcggcgagctcaccgatgcgctcgtactgatccacgcgaccctcctccactcacgccccgcggcgacgcaccctgagcttgatcggcgtcgcatccatctcgaaggcctctcggatccggtgctcgaggaatcgcaggtacggcggcgggaggctgcggttcgcaaagagtgtgaaggtcggcggccgcgtcgccccctgtaccgcgtagaggatgcgcccggcgggcggggggtgctccgactggagctcgttcaagaagcgattgagctggcccgtcggcacgcgacgctcgtagtcggcccgagccgcgaagatcgccggcagcactcgatgcacgccgcggcccgtgagtgccgagatccgaaccggatcgagccccgtcacgaaagccagtcggtcctcgacgtcacgctcgatgcggtccttggcctcggcgtcgagctggtcccacttgttcagcacgacgacgaccggtgagcccgcggcgtcgatgcgctcgacgaggcgctgatcccatccggtgacgccctcggtcgcgtcgatcacgagcagcgacacgtcggccgcatcgatcgccgccagcgtgcgcaccatcgagaagtactcagtgcccgactcgtagcggctgcggcgccggagcccagcggtgtcaacgaagcggatgcgaccctcgtcggtctcgacgaccgtatccaaggtgtcgacggtcgtgcccggctggtcatagacgatggcccgcggctcgccaaccagtcggttgaacaggctcgacttgccgacgttcggccgccccacgatcgcgacggcaacgtcggctgccggcgccgcctccggctcctccgccgcggtgaggtcgagtcgccgtgcaacgagatcgagcagctcgaagacaccacgaccgtgcatcgccgacaccggcaccggctcgccgaccccgagcgccaagtgctcccagatggccggctcatgcccagggctgtccaccttgttcgcgacgaggatcgagggcaccttggcgcggcgcaccacgcgggcgatggctgcgtcctcctcggtggggggcacacgcgcatcgacgaccacgagcgcgagatccgcccgccggagcgccgcctccaccgcagccgacaccgcagcatcgagaccgtctgcgcccgcgaggtagccgccggtgtcgacgatcgccagcggcgccccctcccagtcgatggtcgcctccttcgcatcccgcgtcaccttgggccgttcctcgaccaccgcctctcgtcgtcccaccacgcggttgaacaggctggacttgccgacgttcgggcgcccgacgatcacgacgcgcttcatgctgctctccccacgcggatcgcccaccgcagcgcgctcccgttcgtcgcgacgacctcgagccgcgggtcgagttcatcgagagcgacgccgtcgatgaaccgacccccggacagacacacgtccggcagcaggagccgatcctcaggggcgtctgcgaccgctcgagccacgtcgctgcccgcgaggaggcctgcgacccccacgttgccgccgaaatactcgttcgccacctcgacgacacgaacatcgccgtagccatggcgctcgaggagcgggcgcagcacggctgctccatagctggatgtgacgacggccgttgctgggcctgggcgccgccgacccgagagctcgacgcgcgtcgctcggtagccgagggccggggctccctcgatcgcccgaaagaacccgctcgcgggctccgtcgacggcgacctggcgccgaggaactcggcctcgaaggccctcgcgagcccgataccgttctcgagctgaggcagaccggcgtagtcctcgagcggcgggaactcgacccccccgaccaggtagagctcgtcggcggcccaggcacggggcgcacgccgatcgcgggcccagcggtcgtagcgctcgatgatctcgaccgcccggcgtgcctcgtcgggggtgtgggcacgcaggtgctcgcggctgaagcgcgacacgccgtagggcacgaccccgatgctcgcaaggcccggtgcgaggagcgccagctcggccaaggtcgcctcgagctcgtccgcgtcgttgcgctccggcacgagcacgacctgcgcatgcacctcgacgcccgcctcgacgagcgcgaccagccagcgcagcgacaccgcgccacgcgggttacgcagcatcgacgcccgcagcgcggggttcgtggcatgcaccgagacgtagaggggccccaggcgttcggtgacgacccgttcgaagtccgcctcggtgaaacgcgtgagcgtcgtgaagttgccgtagaggaacgagaggcgatagtcgtcgtccttgacgtacagcgtccgtcgcaagcccttcggcagttggtagatgaagcagaactcgcagtggttgtcgcaggtggtcaccccgtcgaacacggcgtcagagagctccgccccgagcggcatgcccgccgccttgtcgacggccacctcgagcgacacaccgcctcgctcgacctcgagcaccgggtctgcgtcgtcgatgagctggcggtactcgatgacgtcccgaggctccacgccgttcaccgcgaccagcacgtcgccgggcgcgagaccggcgcggcccgcaggcgagtcaggctcgacgaagagcaggtgaggacgaggcacaccgagagcctagtgagcacccagagggcgccttctcgagcgccctagactcacgaaccatggccgtcgacaaggtcctgctcgccgctcctcgtggtttttgtgccggggtcgagcgggccatcggcgccctcggctggatgctgcgcatcttcgaaccgcccgtgtactgctaccacgagatcgtgcacaaccgcctcgtggtcgaggcgttcgaagcagcaggcgtcgtcttcgtcgacgacgtcgagagcgtcccccctggtcgcccggtcatgctgtctgcccacgggaccgcccccgaggtcctcgaggcggcgcgccaacgctgtcccatcgtcgtcgatgccgtctgtccgctcgtcacgaaggtccaccacgagatccgaacgcgagcccagcgcggctaccagatcgtctacgtcggtcatcgtggccacgaggaggccatcggcgccaccgccgaagctcccgaagccgtcaccttcgtcgagacgccagaggaggctcgcgccatcaccctcggcgacgggccggtcgcgctgctcgcccagaccacgctcgccgtgcccgaatgggaggcgatcgccgccatcgtcgccagccagacgcccaacctctggcagccgggccgctccgacctgtgctacgccaccacgaaccgacaggcggccgttcgggcgcttgcagagcgtgtcgacgccatggtcgtggtcggatctgcgaactcctcgaacacccgcgctctcgagcgcgtcgccacgagcgccggcgtgggccacgtcgagcgcgtcaaccgcccgagcgagctcgtcggcccgttcgagggcatcgtgggcgtcaccgccggggcatcggctgcggagtccgtcgtcaaagatgtggtggccgcactcgcgccgcggctgggcgtcgaggagatcagcgtcctcgaggaggacgagttcttcccactccctcccgatctgcgcgacctcatcggtgcgctcgcgggcgtcgtcgcggttgcaacaggcgtctccccagagggcgcactgcccgagcgagagtccgccgaggcgatactcgccgcactcgacactcgccaccgctagtcacgcctacgtcggtcgatccgtcagatcgcctgcgtcccgtcgagacggatcgaacgctcatggaccggagggagcttcggcagctgcgtcggatcagacgccacccgccgcccggaggcgacgatgagggctcgcgagcgtcgagccgcagcgaggagccgattgagctcggactcgagcatctcgctgagctggcggatctcctggcgccgaacgcgcccggcccaggatgcgcgaacttcgccgggccagagggctcgaccaacctcgatcgccacgggagccgggaggatcagtgcagatccagggcgcatcgcccgctccgacccggcgatggccgccggcacgaccggcacgcccgcccgcaaggcgaggtaggccgctccctcctcgatgccctccacgcgctcgccgcgacggcgcgtcccttcggggaacaccacgagcgagcgcccgctgccgagcgccgcgagcgcgagctcgatcgcctcccgatcggtcgcttcgcggtgcaccgggaatccaccgagcagccgcagaagcgcgccgaaacccggtgcctccatgacgccggacttggccatgtaggtcatcggctcgcccgtgatcgagccgatgaagggcgtgtcgagattcgagcgatgcgtcggcgcgaggatgtagggcgccgggggcagcgcctcctcgaacccgaccgcgacagcgaacatggcccgattggccagccggacgagctcgcgcgcgccgcggtagaaggcccgctgggccaacgagccgacctcgatcacgcaggcacctccgagagcgccgccacgagttcgcccacccgcacggcgagtgctgcaacggagacgtccgacgtgtcgacgacgatcgcatcggcggcaggcaacgccggcgccacagcgcggcgtgcgttgacccgatcccgcgcgagcaccgcgacaccctcgtcgtgtctcctcgccacacgcaccgcgtcccgcgcgacgaggaacagcttgagctcggcgtcgggaacgacgaccgtcccgatgtcacgaccctcgacgaccgccgaaccgagcgcgtggatgtcggctcgctcgagcgcgaggacggcgtcacgaaccaggcgatcttgcgtcagcacggcaagcacctcggtgagtgtgggatcgcgcaggcgcgcgccgagcgcttcggcctcgcggtagcgagcgagcgggtcgccgacgcgccggagctcttcggccacctccgccggtgccaacccctcggcctcggcgaggtgcgcagcgaaacggaagtagagccccgtgttgatacaggcaatcttgagatcgtcggcgagccgcaccgcgagagtcgacttaccggtccctgagaggccgtcgatcgcgatcacgagacggcggcgctgggctacggccccatcgtgccgagatctcgcctccacggccaggtaggctagtgaggagcaaccgacgggacgtgcgggtgcgctccgtgcgaattcgagttctgggctcaggtcattctcggattgtccggacacactcacaatgactaggtcggcgtcggatgaaggagttgggtgtgagcagaacgactcgctttgccaaggatcgcgggttgacggcacggatgaccttcaccatcttcctcctcgggctggtgtacgtcctgttcttcggactgctcatcgccgtcggcgtcggcgcgctcaccgtggtcgtcatcgcggcgatcttcctcttcgtgcagtacttctacgccgacaagatcgcgctcttcggcatgcgtggccacctcgtcaccgaggaccaggagccgcagctctaccagatcgtcgagcgactcgccgccctcgctgacatgcccatgccgaagatcgccgtgtcggaactcgacatcccgaacgccttcgccaccggccggagcccgtcgaaggcggtcgtgtgtgtgacgcgcggcctccagcgccgcctctccccccaagagctcgaggcggtcctctcccacgagctcagccacgtcgcccatcgagacgtcgccgtcatgaccatcgcatcgttcatcggcgtgctcgccggcctgctgatccgggtgatgttctactccgagctcttctcgggtgggttgggctacggcgggggacgtggtcgtggggggcagatgcaaggcggcggccaactcgtcgccgtcgagatgctgatcatgctcgtctcggcgatcgtgtacgccatcagcttcctcctcatccgcgcgctcagccgctaccgcgaactggctgccgatcgctccggcgcgatcctcatcgggcgtcccgcgctcctgaagtcggcgctcttgcgcatctcgggcgccatgggacagatcccgacgcgggacctccgaagcgcccaggcgttcaacgcgttcttcttcaccccggcgatcgcacctcgcggtggcatcggcctcggcgagctgttctcgacccatccctcgctcgagaagcgcatcgcccaactggatgcgctcgagcgccaactcggtacggcggagtaggcgtggggttcttcgacaccctcttcggccgcaccaaggtggcccagcccaaggtggacgccctcttcgcgctcccgggggcagcgatcacgctcgaggtcgccgccaacctcacgagcgacggatggggcgcggtggtcttcaagcccgcctcgggagccgccttcgcgaacaccgagcacgagttccgcgacgtgctcgccgagctgaccgacacgacggtcacgcaggccaccgatggcttcggctatcgctgggtcctccttcgcgccgcggatctcgagaccctggtcacggccgtgcacgccgtgaaccggagcctcgaggaccatggattcggccctcagctcctctgctcactgttcgccttccatgacaccacaggcgcccagcccgtcttctgggtctacctctacaagcgcggcaccttctacccattcgtccccaccggccacgaacaacgtgacaacgagcgcgaactgtcactgaaggcggtggtgggctccgatctccccgtcgaagaggacctgacgcgctggttccccctgtgggacatccccgacccgccacctgccgccgcccaagacggcacgggctcgacgacctaatcctcggttcggacgacggcctcgcacaaccgcacgaaatcgtcgacgaagccggggtagctggtcgcgacccactcggcgtcgcgaatgcgcgccccgatgccctgggtggccgcccagacggccgcactcatcgcgatccgatggtcacgcaccgaatccacgaggacgggcccgctggggctcgtcgggccctcgaccacgaagccgtcgtgcgaggtctcgaccgtcgcaccgaaggcctcgagcatccgagccgtcgtctcgatgcggtcggactccttgacgcgtagctccgcagctccctcgatgcgactcgtgccccgagcggcagcaaaggcgacggcgagcacggggacctcgtcgatcaggctcggcacctcgtcggcgacgatcgtcgtcgcgccgagcgcggcgccgcgcacgatcaccgtgtcgcgtccgagcacctcgatctcggcgcccatacgccgcagcacgtcgagatagcccgtcctcgtcggccccaggtaggcaccacgaacctcgagccgtgctcccggggtcgctgccgcggccaccacgaagaaggccgcagccgaggggtcacgcgcgaccacgatgcgctcgacggggcgcggtgtgccgggcaccacgctcacccgatgtcgcccatcggcgagctcctcctcgtcgacctcgagaccgagcagaccgaggagttcttccgtgtgcggacgggtcgcgaccggctcgacgacgctcaccgccgacgccgccccaaggccagccaacagcagggccgacttgacctgggccgaggcgacacgcagctcgatggtcccgcccgcaagccgcgcgccgcgcacggcagcaggcagccagcgagccccccctcgcgcgtcgatcaccgcgccgaggctccgcagcggctcgatcacgcgtgccatcggccgccggcgcaccgacgcatccccgtcgatgaccacgaggccaggcacgagcgtcgcgaccccgagtccgagccgcgcgagggttcccgagttgccgacgtcgatcacgccttcgggctcgacgaggccctcgatgccggggccgtcgatctcgagggtgccgttcgcacgctccgacacgacggccccgaaggcacggatcgcctcgagcgtggcggtgacgtcgagcgcgcgcgagaggccctcgacgatcgtcgttccccgcgcgaggagcgcgccgaggagcgctcgatggctgatggatttgtcgggcggcggctcgagcacgccagagggggcatgtgcacccggccggatgacgaggtccacgctcgtgacctaggccggcaggtcgtctcgcagaccgaccgcgccatggaggtagacgtggtggaaggcgctccggggtcgctcgtcttcgaggtgcatcagcacgcgcacgcaccgctgggttccccccacgatgtcgagctcgcgcgcgcagatcaacggcacgtcaccaaggccgatctcgcgggctgcggtggcaggaaagagcgagtgcagatcgtcggtcgcggtgaagaggatcgagacgagctgctccttgccgatgccgttcgccgccagcatgcggctcacgagctcctggacacgctcgcgcatcgcctcgggcgtgtcctcgtcaagcgtcgtcgctccccgcaacccccgtagcgccatgggccgacaggctagcggccccgatcgcacgacgcaggcgtgcgagctcacgcggctcgagtcggcgcgcgacccccggagggaggtgagggtcgacgagcggaccgatccgcacccgcaccaaccgctcaacgctgagtccgaccgcgcccaccatccgacggatctggcggttgcggccttcggtgaggacgatgcgcaccagcctcggaccgaccgtaccgacggatgaggcacgaaggagctcaccgtcgacctcgaccccttcgcgcagttcccgcccgaggcgtctcggcacgggccgatcgacccacacgaggtattccttgggcacgtgaaaccgcggatgggtcagctggtaggtgagcgggccgtcgttcgtgaggatcaacagaccctcgctgtcgacgtcgagacgccccaccggatacaccctcgacgtggtcgccaccagcgagcgtacggtcgggcgcccctcgggatcgaccaccgacgacaccacgccgcgcggcttgttgaggagccagtactcgcgctgctcctcggtcgcgatctcgaggccatcgaactccacacggtcgacgcccggacgcacccgcgcaccgatcgtggcaacctcgccgttgatccgcacccgaccgtcgcgaatcgcgtcctcgaggacccgacgcgaaccgcagccagctcgcgcgagcaggacgtgcaccttgaccgactcggcgctcacgactggccgcgcacctcggtctcgagctcggccacctcggccgcgctcggcacgtagcgaccgagcggcggcagctcctcgatggagccgagccccgcacgcaccaggaacgccgtcgtcgttcgaaaggcgacagggtcactcgaggggacctcttcgatgaggccacgctcgaggagcgtccgcacgactccgtccgagacgacgccgcggacctcgctcacctgcgcgcgcgtcaccggctgcagatacgcgacgacggcgagcgcctcgagcgcagctcgcgagaggcgccggtccgcgaccccgagcgcccgacgagcgagcgccgcgtactccggcactacctcgaagaccgcaaacccatcccgaacgcgcacgcgtaccccccgagcgggggcggcctcggcggccgcgatctgcgcctcgatctcggcgacgtcgcgctcgaggagctcggcgagttcgccgatcgcgacggacccgcaggcgccgaccaccgcctcgatcgctgcgccgagctcggccggatcggcggcgccaggcgcgcgctcgtcagtcatgcgacgccacgccgatcccaaccaacgcccgtgccgcgtcgtcgtcgacgagtcccacccacagctcgtcgccgacgacctcgagggtgagtgcgccgagcgcgtagccctcgagcacgatcacgaagcccacgacgacctcgagtgctcgccacccgcgtacgacgtcgcggaaggtcgtacgacgacgtgcgcgtaccgaagcgagtacccgctcggcgaccacctcgatccgtaccatctgactcggcagcgtgacggtgccaacggcccgtcgcccgcgaccttccaacccgacgagtgctgcccggagcgacgctggatcgatcggtgcgagcggcggctcgggcaccggaaccgctcgcgcgagcaccgcgtcctgatcgccgagtcgctgcgcgagctgccctgcggcccgcgagatcgcccgctgcagcgcgagcgcgacgagcacccgctcacgacgttcgtcagcgagctcgagcacctcctcgtccggctccgtggtgagcgcgcccaaccatctcgcgagcaaccaactcgcagccaccaacgccccaccgagcacctcggggtcgtcgatgccgacgagggcgctctcgacgagcgcgccgagctcgagcgagctcggatcgagccgttgggccctgacggcctcgaccgcctcagcgaggctcgttggccccatcgaacctcatcaccatcatgacgtgcggaccgacgccgggaacctcgaacgacgccccgacgcccgtgaaaccaagacgttcgtagaagccgagcacccacgctctcgcgtgcaggaacatcccgcgggggccgcgctcctcggccgtcaaccgctccagcgcctcggagacgagcatgcgaccgatcccgcgacgctgcgccgactcgaccaccgccatgccccgcaggcgccaggcccgtccctcaggatcgagcgtccccgcgagcacgtctgccgcagcagggccaggggcctcgaggaccacagtcacgacgccgatggtcgaaccatccgcacgcgaggccgcgaggtggaggctccgaggatcctcgtccccccgaaagcgcgcagcatcggcgggcttgcccggccgcagcacggccgcgcgcacctcgagcacgtcgtcgatcccgacactgcggatcgtgacgtcgctcacctctgcctcctcgccctctccgccgagctcacggcactccggtagcgtaccgtcaccgacgtggcgtcgcgcctcgacgagcagcctcgatcgagcgggcgaccagcgtcaccggatgcacgacgtcgacctctggtccgagcagcgcccgcagctgcagtgtgcagcccgggttcgggcttgcgaccacgctggcggccgtctcggtcaccgcgcgtgccttgcgctcaccgacctgcgtcgagagctcgggctcgaggaggctgtagagtccgccagccccacagcagcgcggcccgccgacgtccaccagctcgagaccggggatctggcggagcagcgcccggggggcatcgacgatcccctgtgcgaaggcgagatggcacgcgtcgtgcaccgcgacacgagcctcgatggctccgcggggggctcggggtgcgtcctcggtgagcaactccgtgatgtcgatggtggcgcgcgcgaccgccgcgccctcctcccccacgatccactcgtagcgacgcaggtgcgccccgcacccagcagaggtcaccacaagccgcaccgactcgtcacgatcggcgagtgctgccatgatgcgccgcgcatgacggcgagcagccgcctcgtcgccagcgtgctcagacagcgcaccacagcacacgctctcgagcacctcgaccgagtagccctcggcctcgagcacgctcaccgcgtcgtcgttcgtggacccgagcgcagccgaggcgacgcatccagcgagcagcaggacgcgtcgacgaggcgatcgggccgaggacgtgatgcgaggttgcccaccgtggcgtcgatcggcgacacggccctcgtcgagcgcgcgcgcaacgcgtcgtccgaacccacccccccgcgccagtgccggacgaagggcgaacaacggccgaccgagcgcgagtgcggctgcgctcgcacgagccgaggggaagagccgggcgagcgaccgacgccacgttcgatcggcgagcggccgccccggctcgacgagtccacgcgcgagatggatgatctcgtcgtagcgcacgccggaagggcacgcaggcacgcaggcttcacagccgatgcagcgatcgatgtgcagtcgaaccctgtcggcgacgacggggccgctcctggtggcctcctcggcgagcaaccagatacgaccacggggcgaatccgcctctgcgcgtgtgaccgcataggtggggcacgcggagaggcagaacccacagtggacgcacgtcgcggcgagctcggcgatccgtgcgcgagacgtcgtgtgggtcgccgtcatcggaaccgcctctcaggatcgagttcgtcggcgagtcgcgtcacgagcggatgtgcgaagcggtcgacgagaccgaaacccaccgcgtcgtccaccccctcggctcggcgcacctcgccgacggcaccctcgcggcgcgcatcgtcgagcagtgccgggagcgcttctgccccgcccggatcggcgacgacgtcgacgagaccggcacccggatagctcgcaaacgagatcccaggaggagccgtcgtgcgctcgagccacgcgagcatccgcgaggcacggccggcgagccgcagcaccacgccctcacgaggcacccggaacgcggcccgcgccgtccgctccgcgtcgagacgcgcagcatcgagctccgtggcggcgatcccgtgtgcacgaagcacccgctcgagccgctcggactgcgcctcgaccccgcgctcggtgccctcgaacaccacgagcgcctcggtcgaggctgcgagccagtcgatcgcgaccggctcaacccgctccgcgagcgacacctcgaggagcgtgcggagctcggcaggaccggacgccaccagcacaccacgctcggcctggggtcgagggtgggcgcgcaacaccacctcgccgacgagtgcgatccgaccccgtgccccgcacacgagcttggcgaggtcgtagcccgcgacgttcttgatcacgtgcccgcccgaatgcgcgacggtaccgtcagccagcagcaacgtcgcgccgatgacgaggtcgcgcaccccgccatagcgccacaccatggcgccgtgagcactcgtcgcgaccatggcgccgacggtaccgtcggccacgggatcgagcgcgatccgcaggcgcgcctcggcgaggacggcgttgagctcggagaggcgtaccccggcaccgacggcgacggtgaggtcgtccacacgggcgtcgatccagtcgagtccggtggtccgaagctcgagggagcccgctacgacaggctcttggttcgttccctcaccgacgatgcgaacgggctgctcgggctcgaggccggcgagcagtcggctcgcctcctcgatcgaggtgggcgccgctaccatcgagtcgccaccccggcctcctcgagcggatgcggccggtaccgacccgcctgctccccgcacaggcgaggggtcggcaacagcttgcccgggttggcgaggccacggggatcgagggcagtcctcacgcgtgcgaagacggacaggtccgtcgcactgaacatctcgggcatcttgcagaccttgtcgaccccgatgccgtgctcgccggtgagcgagccgccctcggcgagacagaggctgaggatcgcggccgcgacctcctcggcgcgcgcctcctcgccggggacggatgggtcgtaggtgacgagagggtgcaggttgccgtcgccggcgtggaagacgttgaggatctcgagccccgactcccgggcgaggtcgccgatggccgccagcacccgcgggagcgacgtgcgcgggatgacgccatcttggacgatgtaggcgggcgcgacgcgaccggccgccgcaaacgccgccttgcgcgcacgccacatgcgctcgcgctcggcctccgtcgtcgcgacccacaccgaacgtgcccccgcggccgcgagcgcctccctgaccgcgacgaagccctcgtccacctcctccgcggggccatcgagctcgacgagcagggcggctccccagtcgagctcgagtccggcgtgcgtcgccgcctcacaggccacgagtgccgggcgatccatcatctcgatcgcggcaggcacgaggccagcccccacgatctccgacaccgcatcccctgcttgcaccgcgtcgtcgaagtaggcgaccagcgtccgacgaagggacggttggttgatgaggcgacagacgatggtcgtggcgatgccgagggtgccctcggatccgatgatgagaccgcggacgtccggccctggcgactcgagggactgcccacccacgaagaccagctcacccgtcgggtcgatgagctcgagaccgagcacgtggttcgtggtgaagccgtacttgaagcagtgggcaccgccggagttctcggcgatgttgccgccgatggtgcaggcgatctgcgaggaggggtcaggggcgaacagcaacccctccccagcgaccgctgccgacaggtcgaggttgacgactcctggctcgaccacggccacccgcgagatgggatcgatctcgagcacacgggtgagccgcgcgagcacgacgaggacgccgtccgtctccggcaacgcgccccccgaaaggccggtaccggcccctctcgctacgaagggaaggccgagacggatgatctcgcgaaccccgacgatgagctcgtcacgactcgagggcacgaagacgagacccggagtggcgcgatggctggtgaggccgtcacagctgtaggcttgccgctcgcgaggatcgtcgatcaccgcatccggaccagcgacggatcgcgcgaacgctgcaaagcgcgcgagcgctgtcgacccgctcatggcggcaagtgtagcccgggtgggtgatccgcccgaggaggaaggagcaacgatgacacagaaggtcgtcatcacgggcgcaacggcggggatcgggctcgccaccgcccgcaccctgcacgcagccggctgggagatcatcgccatcggtcgacgcgacgatcgcctgcgagacctcgccgacgagttcggcggggagcgcatccacaccgtcgcgatggacgtccgcgacggtcaggcgatcggccgtctacgcgccatcgtgggtgtgcccgacgccatcgtcaacaacgccggcggcgcacgaggcctcgaacgggccgacgccgcgcagctcgacgactggctgtggatgatcgagacgaacgtcatcgggctcgtacggctcacgcacctcttcctccccgacatggtggcgcgcgggagcggcacgatcgtgaacgtcggctccgtggcgggcgagtttccctatccgggtgggaacgtctacggcgcgaccaaggcgttcgtgcgccagttcaccttgaacctccgggccgacctcgccgggacgggcgtgcgcgtgaccgacgtcgaaccagggatggtcggtggcaccgagttctcgctcacgcgcttcggcggcgacgagtcccgtgccgcggaggtctacgaaggcatgacacccctcggtcccgacgacgtcgccgaggtcatcgcgttcgtgctctcgcgacctgcgcacgtgaacatcaacacggtcgcgttcatgccgaccgaccagggtttcggacccttcaaggtggcccgccacgacgacgtctgagcgtccacctacgctcgaggccatgacctcgaccctcgggcgtagcgacctcgcagccccttcaccgagccgaagtagccggcgtcgggagggatggctcgcgaccagtggcgggacgctccacccagagggtgtcgtgagcgcccacccagagccgacacgactcgagcgccccgcccctcacgaacgcacggcccgcgaggacctcgaggcgatcagcctcgctccgggcgcgacccgcgccgagggggcgggacgacgagccgtcccagaggctcccgacccgttgcgaacctgcttcgaacgcgaccgcgaccgcatcgtgcactcgagcgcgttccgccgccttgccggcaagacacaggtcttcatcttcccccgcgaccaccagcgcactcgcctcacgcacgcgctcgaggtcgcccaagtcgcacgcgcgatcgcgcgtgggctccgcctgaacgagacgctcgtcgaggccatcgcgctcggccacgactgcggtcacggaccaggagggcacccgagcgagacggcgctcgacccctacctccctgaaggctatgaccacgccgtccagggtgcccgcatggcgctcggctcgctcaacctgtgcgtcgagacgctcgacggcatcgagaaccactcgtggtcacggccgcgacccatgacccccgagggggaggtcgtctccctcgccgaccggatcgcctacctcgcccacgacctcgaagacgccgtccacgcaggcatcgtgaagggagacgagctgccagcgagcgtacgagagctgctcggcgcgcaccgaggcgaccagctcgacgccctcattcgcgacgtgatcgaccagacggtcacgaagggggtgatcgggttctcccccgccgtggctgaagccatggccgacttgcgacgcttcaactacgagcgcatctatgaccgacctgcctcacgccgccaggcggccttcgtcgtcgccctcctgcgctcgctcatggactacctgctcgcgaacccgaccgcagttcccgaggtcgcagcctcgccggagccgacgagggctgccgtcgcctgggtggcaggcatgaccgatcgattcgcgctcgacgtcgccaagacctggctgggctggcgcaccgagccacccagtgcacgaggcgagggcctctaacgatatactcgatatatcgttagaaaggaggatggcatgtgtcacggacaccatcaccatccaggtgaaggagccttcggcgaaggaccgcatcgtggagctcgcggacccttcggcggcggacccttcggaggcgggccattcggcggcgggatgcgacgcggaggacgtgcaccgcgcggacgcattcgagctgagatcctgcggctcctcctcgatgggcccaagcacggctacgagctgatgaacctcatcgccgagcagagtggaggcgcatggcagccgagccccggctccatctaccccacgctccagctcctcgaggatcaaggactcgtggcgagcgccagcgatggcgatcgtcgcgtctaccagctcaccgacgcaggccgtgaggaagccgaacgactccagcacgagcccgggccacacgcaggtccggctggcgcccgactcggtcccgagatcgctcaggtcatgggcgcgctgcgcacgatcgcgatgtcggggacgccagagcagcgtgacgctgcccagagcgccatcgcggagtttcgccgaacgctctaccagatcctcgcgcagtagcgcgagtgctcgagcgcgttcgggcccgagggacgtgaggcccggtcatgagccgggcctcacgcgcgactctgatcgcgctcggacttagacgccgacgacctgatagccggcctcgacgagctcgacgaggacctcgccggccggacgcagaccgactccttgtgcctccaccacggcgtgatccagcccgagctgatcgacgttggcaggacaggcctgaacctcgacctcgccttcgcgaagctcggcgagcaccgcactcacctcggtgtgcgtcccgtcggcgagcgcgacacccggtccgaagaggtacaccttgacgtcctcaccacggcgcgtcttgagacgctccgcaagtcggagtccgctcatcgccttcccgacctgatcgggccctgctgtgatccagaatgcaatcttcgccatggcatcaggctaccccgagcacccccttttcgtgcacatcattacagttgcacgtgcaccgaaatttgccgaccacgtcgctctgggagcagtgctcactcgctccgagcgcgtgcccgagatgaccgggcgcgagaggcgcctctgctcggtcgacgacacgaaaccgttgcgcgagcacaccgtgggtcgctaggctcctgccaaccgaccggtcggtcgggacggacgctgtggttgccaaggggggacatgcacaccgtacgcgatccgctcatgcgcgccgagctcatcgctcgtgacggcaccgccgtcgtgtgtggcgccacgacgctcacctaccgcgacctcgccgaccgcgttcgacgcctcgccaacggcctcgcgggccttggccttgcgtccggcgatcgcgtggcgatcatcgccgacaactgccaccgctacgtggaggcctacctcgcggtaccgggtgcgggtttcgtgctcgtgccactcaacacgcgatcgagcccagccgagatcagcttcgccctcgaggacgccggcgtgcgcatcctgctcaccgatcgcgatccggccgcctacgaccacagcgtcgaacgagtcgtccgcatgcccgacgactacgaggacctcctcgagcgcacccctcctggtccgcttccgaacgcccccaccgagaacgacgtcgccgggctcttctacaccggcggcaccaccggccggtcgaagggcgtcatgcttacgcaccgcaatctcatcgcgaacgccgtcactgcgctcgagtggacgaggatgcgcgccgacgaccgttggctcgtcatggcaccgatgttccacgccgcgggcacctgctgcgtgctgacgtgctgctgggtcggcgcttcgcaggccatgctcccgagctttgacgccgccagcgccctcgatctcatcgaacagactcgagccaccggcaccctggccgtgccgaccatgctgaacgcgatgaacgatctccaggccaccgagccccgtgacgtctcgagcctccgcctcctcagccacggcgcgtcgccggctcccctcgagatcctgaagcgagcccacgtgctgttcccgcaggcagaactgctccatctctatggcaccaccgagaccgcgccgatcgcgacgaccttcgcccacgaggagctccatctcgacgatcgcctcgcaggttcggcgggccagcctgccttcggtgtcaccgtcgtcgcgctcgaccccgacggtcgccccgtgccgccgggcgagatcggggagatcgccgtccgaggcaacaacgtgatggctggctactggcaactccccgaccaatcagccgaggcgctccgaggcggctggtaccacaccggcgatctcggcttcctcaccgacgacggctacctcttcttggtcgatcggctcaaggacatggtcgtcaccggtggcgagaacgtctacaccgtcgaggtcgaagatgcgctctatcgacatccagccgtcgccgaggctgccgtcttcggcatccccgacgaacgctggggcgaagcggtctacgccgtcgtcgtgccccgctcgcctgtgaccgaggacgaactgcgctcgtacctgcgcaccctcatcgcgtcctacaaggtcccgaagcgcatccagttccagagcgacccactcccgaagtcaggcgccggcaagatcttgaagcgcaccctccgcgagcccttctgggcaggacgctcgacgcggatcggctcctagcctacgacccgttgtcatcagtcacctcggcgccgcacgccagcgctccaccgagccagaagggaggggtgcgtgatcatcagcaccatgaacgacctgccgggctacgacgtcaccgccgtcctgggcgaggtcttcggactcacggtacgctcgcgcaatgcagtctcccagtggggggcaggactcaagtcactcgtcggcggtgagctgaagggcatgaccaagaatctcgcgcgaagtcgcgaggaggccacccggcgcttggtagaagaggcggaggcgaagggggccaacgccatcctcgctttccgcttcgacaccagcgagctcggcgacatctggaccgagatctgcgcctacggcaccgccgtcacggtcgtcgcgaagagctgaaccctcgtccccgacgccgtcgggcgacccaccgcgggcattggggccggccgtggccccaacgccggacggacccgcaaacctaacgtgcgttgagcgagcgcgcgcgtcggccactcagtggccccccgagcagcgcggagaacgcgcagatgttgatgaggccggccaggatcggcacgagaccgacgatcgccaccacggttcgcgcggtgccatgggcgagggtaagcgcgagggcgatgatgacgagcccggcgacgacccgacccgcacgccccgctgggcgcgccatctggcatgccatctgggttccaaccttggttgccatgactcctccttgggttcgcctggccatcaaccaggctcacccatccttcggagccgtccacgtccgcggatggatcccgacgccacaccatcgccctagcgtcggcgaacatgccagcgcgcgaggcgagcgtcctcctcgcacggcacgacgtcaggggcgccggagcagggctgcgaccccctggccaacccccacgcacatcgtgacgagggcgtagcgaccgtcgcgagcacggagctcgtgtgccgccgtcagggccagacgagcaccgctcgcgcccagaggatggccgagggcaatggctccaccgttcggattgacgagatcgtcgtcgggatcggtcggcaagccaagttcaccgaggcaagccagcgactgcgccgcgaacgcctcgttcaactccaccacgtcgaggtcggcgacaccgaggccgaagcgctcgagcaagcgcctcgacgcagggaccgggccgatgcccatgatcctcggcggcacgccggccgtctggccgccgacgatctcgcaccacggctcgagtccgtaacgcgcgagggcggcgtcgctcgccacgaccacggcactcgcgccgtcgttgacgccactcgcgttgccggcggtcaccgtgccaccgacacgaaatgccggccgcagtcgtgcgagcgcctcgagcgatgtctcacgcggatgctcgtcgagctcgacgacctcctcggatcgaccgcgcaccacccgtaccggcacgatctcggccgcaaagcgaccagaacgctgcgccgcgagcgcgcgcgtgtgcgaccgcagcgcgaagcggtcttggtcctcgcgggtgaccttgaactcctcggcaacgttctccgccgtctcacccatggagtcgacaccgaagcgctcggcgaggcgcgggttgacgaagcgccacccgatggtggtgtcgtagaccgtggcagagcgggcaaaggccgcctcggccttgggcatcacgaacggtgcccgactcatcgactcgacaccgccagcgaccaccacgtcggcctctccgaccgcgatccgtcgcgccgcatccacgatcgcctcgaggcccgaggcgcagaggcgattgacggtgacggccggcacgccctcgccgaaacccgcgagcagcgtcgacatgcgcgcgacgttgcggttgtcctcacctgcttggttcgcacaccccgccacgacctcgtcgatcgcctcgaccggaatgccgacgcgctcgacggcccccgcgagaacagtcgcgagaaggtcgtccggtcggacggacgccaactgaccgccgtaacgaccaaagggggtacggaccccaccgaccaaccaggcactcattggacacctccacgtcgctcgaggagcggccgacccagcgaacgcgatcgaccccgaaacaccgccacgaccgagccatcacgcgtcacggtgacgtcgtagacaccgctacgccctcgacgcacgacctctcgagcctcggcaacgagacgatcaccgacgtaggcaggttccacgaaactgatgtccgcgccttgcgcgacggtgacgtcgtcgtaggtgttgcacgcgaacgcgaacgccgtgtcggcgagcaggaacaccacgccgccgtgggcgatcccgtgaccattcgtcatggcctcgtcgatctcgagcacgagccgcgcgtaccccggagccaccgcttcgagcgccatcccggccgagcgcgaggcggtgtcgtgctcccacagataggccgcacaggcctcggcgagctcgactggactcacgacctctcctccctgccatcggacccgctcgcgagatgcgccgtcccttggtgcgagcgcagaccggcgaggacgaagtccgccacccagttgccgtactcggcgcgtccgagacgaccatcggcttccttgaaccacgtggggtaccagttcacgatgccgaacacgctcatcgccgcgacgggaagctcgagggggtccatctcgggtgccagctcggcgacgagccgttccatgactcgcacgacgcgccgctcggcgtcgcgcaccgctcgacgctctgcgtcgtcgagacgctcgagatcgttgagctgcacccggtggacgtccgcctcgacctggtagcgctcgacgagccgacagatgagcgcacggaggcgggcctcggccgtaccttccttcgcgccgatcgcctcgacctcctcggcgagatcgagtgcgtagtccagcaggatcgccgcgaggatcgactccttcgtggagaagtaatggtagagcgccggcttggacagcccgaccgccttcgcgagcatcgccatggaggtgccacgaaaaccctcgcgcgcaaagaggatgctcgccgcacgcacgatctcactgcggcgatgctcgtcactcggcaccgtcatcgaccgatgaacctcggatcgcgtcgctcctggaacgcgcgcatcccctcatggaagtcatcggtgccggcgagctggccttgcaggtgcgcctcggcagccaagcctcggcggcgaccttcgccgccgagctcctcgaacagcgcccgggatgccagcagtgcctgcgtcgggccgctggcaacccgtgctgcgaggtcggcgacggcgcgctcgaaggtttcgtcgtcgaccacgagcgacacgagcggcgcaaccctcggatcgtcagccgggaggagttcgccggtcgcgatcaaccacatcgcccgccaacgtccgagcacgcgccagagcgcctcgtgcgcgccagagtcgggcgcggccccgagacgagcgaagggcgacccgaggcgacaggagcgagccgctacgaccaggtcacaggcgagcgcgatcccaagacccgtaccgagcgcagccccatgaatcgccgcgatggtcggtgccgagagtgagcgcagctgttcgaagagcggatggtacgtccctgccagcacaccctcggcatcgtcatggtccgggtcgatctcggtgagatcacgaccggccgagaacgtgcggccgacccctccgatcacgacggctctggccccctccgtccgtcggagcgcctcgccgagcgcctccacgagaggtcccgtggtcgcgttgcgctggcccgggcggttcagccacacccacgcaacgccgtcacggcgttcgtcgacgacgagctcctcgcgcccctcggccacagccggccatcgctcgaccacgacgctcacctcccccccggatcacccgcgccagggcccgtcgatccccgtcgctgtcgttgctcgaggaacgcccccatgcgcgcacgcttctcatcgctctcgaagagcaccgcctgtgcgaggatgtccaccgttcgcgtcgagggccgctcgacgctggcgaggaccagcttcgtgaactcgagtgcgcgcagcgactgggacgccatcgacctcgccagagcgacggcgctccccaccggatcgtcgtcgacgacgtcgacaaggccccactcgtaggcctcggccgcctcgacacgaacgcccgccaggagcatccggcgcgcgcgaccgagcccgacgagatcgaccagacgtcggtgcgcgcccgcaccggcgacaataccgagtccaacctcgggctgacgaaaccagcttcgcgtggaagcgacgcgaaggtcacaggccatcgccagctccaggccgccgccgaccgcagggccgtcgatggcggcgaccgtgggccaacgccacctggcgatccgatcgaacagatcgacgttgatggcccgaagggcatcctcctcgccgcgagcgaggagttctgcgatgtcggcccccgccacgaaccgaccgggcacggcgctcgtcaccacgagcaggtgcggggcatcacgcagatcatcgagcgcacgatggacctcgttgaccagctcgagcgagagggcgttcgccgcctctggtcgatcgatcgccagcgtggccacgagaccgtcgaccgcgacgtgcaggtgcgggtagtcccctaccactcgaagaacccgcgaccactcttacgcccgagctccccgcgcgccaccttgtcgatgaggatctgcggcggctcgaagcgcgaaccgaggtggaccgcaaggtagcgcgcgatctgcagccgcacgtcgaggccgacgaggtcgctgagccggagcggaccgacgggatggcggtagccgagctgcatgcctcgatcgatgtcctcggcgctcgcgacctcctcctcgagcatccgagcagcctcgaggccgagcaagaccccgagccgtgaggtcgcaaaacccggccgatcgcggaccacgatgggctccttcccgaagccccttgcggccgcgacgagggcgtccgtcgttgcctccgaagtcgcgccaccgacgacgacttcgatgagttggctcggcaagacggggttgaagaagtggagccccccgaaccgactcggatcctggacgctggaagcgagatcggcgacctggatcgaggacgtgttcgtcgcgaagatcgcatcgcgacgcgcgatcttcgatgcactgtggaggacctcgcgcttgagctcgacgacctccgggaccgactcgatcacgagatcggcagccacgaccgcatcgagacccgaacgagccgcaaccgcaccgaacgcgctccgctcggcgccatgagcgaccgcctggtcgaggagcctctcgacacgctcgaccgtctggcgagcagctgcgtcagagacctcgacgaccgtgacgtctcggcccgccacgaccgcctgggcggcgatgcccgaccccatggtgccgcccccgatcacgacgatcgtgcgaatggctggcggttgccctagaacaccgggatgatctcgtcccactcgacgtccgacacctcttcccccgtgatgcccacctccgggatcgccgggaacggaatcccgtagcgatcgagaacgcccttgacgttgagcatcgcctgccgccagttctcgcgcttctcatcgtagctcgcgatgccgagtccaccggagcgagcaacctcctcaatcacccgttggttgtcgatgaagtcggagggaagatcccagaagtcgtgcggcggttcgaacaaaacccccgagaggaacacgtaaccggcacggatctgcttcgtcacgatggcgcgatcttcgggcgcgatcttcgggtagtcgcgctccatgagcgcgaggcagatcgccatgtgacgaccctcgtcacgaccgatggcgcggaacgcctcacggaacactgggatacgcgtgtgcgtgtacatgtggtggaacagcgtcgaggaggccacctcccccatcaggaacgaactgaagagcaccgccatcgagtagcgcggtaccgccttttggtacccactccagtagcgcgctccgttgtgatagagccatgccacgttgcgcttggccaggcgcccgatctcggtcttcggctcgtagtcgagtggaccacctggggtgagccgactgatggcctcaccgcagacaatttcatggttctgctcgtcacgggtgatcgagaagaacgcacgccgcaccggatcttcctcgtggatctcgtaggcgtgaatgagcgccgtcgcgaacacgggtggtgcggaggcgtcgaagaccgacaggagcgagaaccagtacgcgatcgcctcgcgctcctcgtcgctcatgcgctcgggctggagcgtgtcccagggcagacgcgcaggatcccagtactctcgctgcgacgacgcccagatctcctcgagtttggccgtgtgacgttcccacgacaaggggaagatgttgggctgctcgatctcgggcggcatcgactgccgttcgtcggtcatggttccctccttgccaccgctggcaccgccatgctagcagatcttcgaccgaccggtcggtcggtcgtcggcctagactcacccttggtgtcgcaaaggagggaaggtggccaccatccgcctctacccgtcgggtcgtgaagtgccgtgcccagagggctcgacagtgctcgcggccctcgaggctgagggctgggccctcccgaacaactgccgcgccggcacctgcggtgagtgcaaggtcaaggtgcgccagggcgagttcgaccaaggtttcgtcctcgacatggcgctctccccggccgagcgagccgagggctacggcgccatgtgcatggccaagccgctgtccgacgtgctcgagatcgagtggggcacgatcgatgcacgtccgctcctcttcccaccccggcgcgacgttcccttcacgctcgtcgacgcgatcgagcgcacccccgccatcaccgaactcgtgctgcgacccgacgaggagccgctgcgttactggccgggccagtacgtgcacctcggcaaccccccggacgcgccgcggcgggcctactcgatcgccaacgccccgcgcgcggacggtgagctgcacttcttcgtcacgcgcgaacgcttcggccgcaccagcgcgtggctgctcgaccgtcggcccggcgacgagctccgcctcgatggaccctacggcgccttcatcggcgacccgtcgatcgccacgcccgtggtctgcctggcggccggctcgggactcgcaccgatcctcgcgctcaccgacgccgcgctccgtcgtgggttcgcccatccggtcacgctcgtgctctccgcacgcaccgaggccgacgtgtacccgcgtggcctgctcgcacacctcgagcggcgctatgggaacttccacttcgtgcgcaccttgacacgcgacgagggcccaccacctcgcggccgcatccctgccatcttggccgatctcgtcggcacgctcgccggggtcgcggtcttcatcgccggtccggaggccttcgtcgaggacacgcgccgggcatgtctcgcgctcggcgccgatccgtcgtcgctgtatcgagagccctacgtcccccaggacgacctcggttccttgtcggtccttgggccgtggtgagcacgtttggtaggctccggccatgactgtctcccaggcacgcatcgaggccatcggtcgtgagctcgcctccgtcgagggtgcgagcggtgtgttcggcatgcacggtctcgctggccggatcatggcccaagccctcgacgatcctggctttcgcgccaacctcttccaactcgtcgacgtgtttcctgccctcgccgacgccgacgacgtcgcagaccacgtccgcgattacctcgcagagcgtgcaccgatgtggatgcgcaccggacagcgcctcgccgaacgcgtcccttcgggccgctggctgctcgagcgcatcacccgcgagaacatcctccagatggcgaggcagttcatcgtggctgaagcgcccgacggcgtcgtcggcggcgtgggcgcgctcgccgccctcggctactcctcgaccgtggatctcctcggcgagaaggtgatcaccgccgaggagtcggcgcgctacctcgacaccatcggcgagatccacgaccacctcgtgcgcgcacgccccgtcctcgaagcccgcggaccgctcatcgggccgacggtctccatctcggtgaagccaagtgccctcagccctcgctggtcgccgctcgcccacgatctcgtcgtcgatgaggtcgtgagccgcctcgaaccgctcctcaagcgcgcccagaccgagggttcgctggtctttctcgacatggagcactacgacacctacgagacgacgctcgcggtcttccggcgcatcatcgccgacccagggctcgccgagctgcagatcgggatcgtcctccaggcctatctccgccgacacctcggcgagctcgagcgactgctcgccgagatcccgagcgccacgcacctgcgcgtctggatccgcctcgtcaagggcgcctactgggacaccgaggtctcccaagccgtcacggagagcgtcgagccgccggtcttcgtcgacaaggccgacaccgatcgcagctacgagcgctcggtggcgatgttgctcgacgccgccgatcgcgtccaccctgcgttcgcctcgcacaacctccgcagcctcgccgtcgtgctcgccgaggcagaggcgcgccgtctcgacccggaccgcttcgagatccagatgctctacggcatggccgaaccgctcgccaccgcggtacgccgctacggcgcagccgtgcgcatctacgctccggtcggctcgctcctgcccgggatgagctatctcgtgcgtcgcctcctcgagaacacctccaactcctcgttcgttcgccatcgcttcggcgatcgagaaggcctggacgagctgctcgctccgccgcgctcccgtccggccaccgtcgtgcccccgagcgtgccgcctggctatcgtcacaccccacagacgcagttccgtcacggcgacgtccgcgccgcccaacgagccacgctcgaagcgctcgccgcacagatcgcggcctcgccacgatcggtcccggctcgcctcggcgcagagcggctcctcggcacgcgcctcgcggggagtcgcaaccccgcccatcgggacgtggtcgtggcgcagtgggccgaccacgaccccaccatcgtcgaggctgcggtcgcaaccgcagagcgcgcggcccgggccctcggcgacctcggcctcgctgggcgcgccgccatctgcgaacgcgccgccgcctacctcgccgaccatcgacgcgagatcgtcgccaccgaagtcctcgaagcggccaagccgtgggtcgaggccgacaacgacgtgggcgaggcgatcgacttcttgcactactacgcccagatggcacggcgcctcgagcgggccgaccgcctcgactccccgccgggcgaacgcaaccgcctgcactatcgtccgcgcggcgtcaccgccgtcatcccgccgtggaactttccgctcgcgatcccgatgggcatgacggccgccgccctcgtgacgggcaacccgacgatcctgaagcccgccgaacagacgcctctcaccgccagcttcatcgccgatgccttcgaggctgcagggctgccgcccggagcgttggtcttcctccctggccgcggcgagaccatcggccaagccctcgtcgagcacccccaggtggcgaccatcgccttcaccggctccaaggccgtcggtctcgacatcgtggcgcgcgccgcaacgctgcgccccggtcagcgcgcgctgaagcgggtcatcgccgagctcggcggcaagaacgccatcatcgtcgatgccgatgcggatctcgaccaagcggttccgggcgtgctccagagcgcgttcggcttcgccggccagaagtgctcggccgcctcgcgggtcgtggtgcaccgacgcatccgtgacgcattcgtccagcgactgatcgaggccgccgcggagctccccatcggcgacccgcgctcctccgcgaccgtggtgcctcccgtgatcgacgatgaggcccaagcgcgcatccgcggcgtcatcgccgacgccgcggatgcggcgacgctcgcgtggcaggcaccgtcgaccccgagcgagggcagctacgtgccaccgaccatcttcgtcgatcccgaccaccgcgcgccgctctggagggacgagatcttcggtcccgtcctcgtcgtcgacaccgccgacgacctcgccgacgccatcgaccgcgcgaacgataccgactacgccctcacgcagggtgtctactcccgctcgccgagctccatccggcgcgtcgtcgaccacgctcgcgccggcaacgtctacgtcaaccgcccgatcaccggcgccatcccgggccgccatcccttcggcggcttcggacactcgggggtcggtttcaaggccggtggtccgagctatctgctccagttcctcgatcagcaggtggtgtcggagaacctgatccgccagggcttcagccccgacatcgcctgagggacgacccagcgcaccaatcgtcgcggtcgatcccgggggcggccggcacgggaagcttccagcggcacgagtggttgcattgtgcaactagcctgtgagcacgccccgctgcgtacgacgagaggaatgaccgtggccacgaagacccgtcagtggagcgagctcctccacaaccgagacgtggccatcatcttcatcgcacggctcgcgatgagcacgtcgcgcgcgatcgccggcatcgccgtgccgctctatctcgtcgcactcggcttcagcggcctcaaactcggtgttctctacctcgcggtcgcgctgtttgcggccatcctctcgcaagtcatcggcctgtccaccaatcgcgtcggcgccaaggtctggatgatcgtcgttcccgccatcaccgtgctggccgccgtggcctacgccgagagccacacgacctggatcttgttcgccttcgccgccgcaggatcgttcggccggggggcgggtgccggggccggcatggtcgggccctaccagccggccgaatccaagctcctcattcgcgcggtgacgccgaccgagcgcaaccgcgccttctccttcgtctccatcgcctccaccgcgggcgccctcgtcggcaccgcgctggcggcgctcctcggccacgcgcacgtcgtcgacagcgccgccaccgctctgtttcgaccatcgatgctggtcgcagcggccttcgccgccatcgcggcgatcgtcgcgctctggatccatgaacccgccacaccggtcgcgaccgaccagccacggcccaagctcttcaccttcccgcgtcgttccgcgtggctcctctggcggctctgggcaaccaacacactgaacggcctcgccgtcgggatgttcggaaccttcgtgacctactggctccatcgtcgctacggagcgagccaagtgacgatcggcgagctctacctcgtcatcaacatcatcacgctggcctccggactcgtcgcccccaggatcgctgcccggttcggcacggtacgcgcgaccgcgatcttgcgtgtcgcccagggactcctcctcgtgccgatggcgctcgcacccaccctggtgatcgcgggagccatctacctcgtccgcatgttcgcccagcgcatcgcccttccgctacgccagtcctacgcgctcgccatggccgaccccgaggagcagagccaggtcgccgcgctctcgaatctgccgagccagctcgcgatggccgccgccccgacactgacgggatacctcttcgacgaggtcagcctgtcgctgccgttcgtcatcggcggcctcatccagaccctgagcgcactcgtgttctgggcgttcttccgcaacctccatccacccgaagagcgccatgcggcgcgcacgagctcgctcccagggatgcacgatggtcctcccatgacctccacagctccgtgacgtagcgttggtcgcacccactcccccacccaccaaccaaggcccgcctctggcgggccttggttgtctgtgccgcgcattgtcgacggcgctcgttgcgtgaggccagcgtgaccaccgatcgtgacttgggcccgcgagccgtcaccatcgatggtggaccagcgccaagcgggtggtgggaggtcaccaactgttcaccatcggagcaccgaacgttctccagcgtgcgactgtcgcgtcaccttggcttcgtagcgtcctcgacgtcggatgacaacccagtcgaaagggacacgatgacacgaagcaagctcacgacgccccggctcttcgccggcgtcgctgcggccagcgccctgctcgccgcctgcggaagcgcgacgaccgcgtcgaccacctccgcccagacctcatcgcccgcctgctgggcaaccgcgaccacgattcaagcgtgcggcggcatgaacgccctcatcaaggccgcccgcgccgaagggcacctgaacgcgatcgccctgccgtcgaactgggccaactacggctcgatcatcgccgccttcgagaagcgctacggcatcaccgtgaacgtcgccaatcccgaaggatcgagcggcgaggagctcgcggcgctgaagacggagaaggggaccgcgaaggagcccgacgtcgtcgatgtcggattgtcgttcgccctccagggccaacaggagcatctcttcgcacccttcaaggtgcccacctggtccgagatcccggccaatcagaaggcagcgaacggcgactggttcgaggactacggcggcctgatcgcggttggctacaacgcaggtgccgtccctcgcccgacctcgctcgcctcgctcacgcagcctgcctacaagggcagcgtctgcctcgacggcaaccctgagagcgcaggcgccgccttctcgggcgtcttcgctgcggccctcgcgaacgggggctcctatgccaacatcgcaccgggcatcgcgtacttccagcgtctgcaccaagccggcaccttcgtgcccaccggcgccaccgccgccagcatcgaggccggccagtgccgcgtgaccctcgactggacctacctccaggcgcagtacgccagccagctggccggcaaggtcacctggaagtcgttcatcccctcgaacgcccacgtcgctgcctactacgtgcaggcgatctcggccaacgcgcccgatccagcggcagcgcgcctgtgggagacctacctctactctcccgctggccagaacggctggctcgagggctatgcctacccggtcgagctcaaggccatgatcgccaacggcacggtcaaccgcgcagcgctcgccaagctgccgccgctcccctcgaatcttgcgttcccaacggcgagcgaactcgcctcggccgcaaagacggtggtcgccgagtggccaacggtctagcggtcgcctccaccaccacccgagcagcgtcccccaccgctgctcgggtggcccgcctgacaccgctcgtcggcctcgtgccgatgatcgcctacctggccatcttcctcgtcgtgcccgctgccggcgtgctcgaaggcgccttcacgggcgcgcacggcgtgagcctggcggcgctcaagggggctaccagcggcgcctttctccacgcgctcgtcgtgagcgtcgaactctccgccaccgcgtccgtggtggccgcggtcctcggcaccgcagccgcggcggccatcgtctcgctcggctccgagcgcctcaaccgcatcaccgcctccgtcgctgcggtcctcgccaacaccggcggggtcccgctcgcgttcgcgttcgtggcgaccctcgggaacttcggggtcgtcacgctggcgctcgcccacctcggcttcgacccgtacgcgcatggcttcacgctctactcggtgacggggctcgtgatcgtctatcagtacttcctcctccccctcatggtgctgatcatggtccccgccattcgagggttgcggcgtgagtggtcggaggccacctggaccctcggcggacgtccgtcccacttctggcgccacgtcgcggccccgctgctggccccgaccgtcctcgccggcctcctcgtcctctttgccgacgcgttcgcggcctacgccaccgccgccgccctcgcaggcggcgtcatcccgctcatcccgctcgagatcggcaacctcatcgacgggaacgtcgtcgcgaaccaggccaacgtcggtgacgccctcggcctcgagatgatcgtgctcgtcgcgctggtctcggtggtctacgcgctcgcccaacgtcgccaaaccaggtgggcccggtgagccgcgcacgcctgctcgcgcttgccgtggtcgtgctggtcgcggcctacgtcctcgtgccactcgtcgcatcagggcgcttcagcctggacggaccccacggaaccctgaccatgtccgcgtacgcagccatcgtccgcaccggcgcattctggagctcgctctggctctccgtacgcgtgggcgtcgcgacggcgatcctcgagctgatcctcgtcacctggacctcgctctgggtgcgcctccgcgccccgcgcctcgccccgctcgtcgacacgctcgtgctgatcccgatcatggtgccggtcgtggtcatcgtgctcggtgtcacctcgtcgctgcggttcctgccgtcgctcatcaccgggaccccggcgatcctcgtcgccgagtacgtggtcctcgcgatgccctacagctaccgcatcgtcgatgcgggcgtcgccgccctcgacctgcgcaccctcaccgaggcggctggctccctcggagcgcgctggagcgcgacgatgcggctcgtcctcgtccccagccttcgagggcccctgctcgccgccgccgccatggcctttgctctctcgctcggggagtacgtcatggcgagtctgctctcgttcacgaccttccccgtgtggctccagaccatcggagccacccaagcaaccgaggcggtcgcggtgtcgacgctcgcgctggtcggcaccgtcgtcctgctcgcggtcgtcgtcgtcgccgctggccgcgagcgaacccgagtcgcggatcgacaagcctgaggagcgccatggacgttctcgaacccgttaccgacacccgcacgaccgtcgcgcgatcacacggcgtcgaggtacgcctcgagggcctcgtgcgcgcgttcggtccgacacgggcgctcgacgacgtctcgatcaccgtcaaccccggcgaactcgtcgccctcctcggcccgtcgggaagcgggaagaccaccgcactcagagtcctcgccggcctcgagcgccccgaccaggggagggtcgtcatcgacggcgaggacgtcactcgcgtgagcgcccatcgacgcggcatcggcatggtgttccaggcctacagcctcttccccaccatgaccgccctcgagaacgtcgccttcggcctccgcctccgcaggatgcgtcgccccgcccgcacggctcgcgcacacgagctcctcgagctcgtcgggctcggccaactcgccgatcgtcgaccccaccagctctcggggggtcaagcccaacgggtcgcgctcgctcgcgcactcgcgatcgagccccgcgtcctgctcctcgacgaaccgctgagcgcgctcgatgccgccgtgcgtgtgcgcctgcgcgaggagatccgtcgcattcagctcgaactcggcaccacgaccgtcttcgtcacgcacgaccaagaggaagccctcagcatcgccgaccgagtcgcggtgctgagggcgggccgactcgagcagctcgacaccccgacacagatctaccatcggccggcgacgcccttcgtcgcgtccttcatcggccgagccaatcgcatcccggcccagatgaccgagaacgggcggctcctcgtgctcggacacgagatcgacgcgcctaccgccgacctcgcccccggcacccggcacgtcgcactcatgcggcccgaatcgctcaccatcacacccgcaccggacggtacgggccgcatcctcggcctcgtgttccgaggtgcaagcaccgacgtcaccgtggcgtggccgacgctgcccgatccgctcgtcgtgaccctcgctggcgagccaaccgccgacctcgcccccggcgcccgcgtcgaggtcgtcccccgcggcacggtgctcttcgtcgagcgtgccgaggagcgtccatgacgaccgatcgcaccatcgcgacgacgggccccgagcccttcgtgacgactgctccggcgcccggtgagccgcaccgtcgcctcggcgagcgtggctccctccacgagcacgccaacggcgcaccgatcgttctcggcaccctctggcacctcaccgacctccacgtcaccgacccttcgagcccgatccgcgcgccattcctcaaccacctcggcgaaccgaacggtccgctgcgtacgcgcatcggccgcgtcggcacctatcgaccccacgaggcggcgagtgcccacgtcctcgccgcgatggtccgccaactcggatccatcacccgtgcgcccgtgttcggtggtgccgtcgacctcgtcgtcgcgagcggcgacctcgccgacaatgcccaggccaacgaggttgcagcggcgagcgcgctcctcagcggccgtgaggggacgcttagggctccgggcctcgccgatcccttcgaagggccgggcgggctcgacgacgatccgcactactggcacccagagggtgagcccttcgacgagtggcgcacgaggcgcggctttccgcagatcgaagggtggtggtcggcactggcggcgcccatcccgctcgccacgcacgatctgccggtcctcttcgtcgccggcaaccacgacctcctcctccaaggcaccgtcccagcatcgccccgccttgcccgagccgcgatgggggggctcgcacccactggcgtcgcagccgacctcgatctcgcgcacgccctcgccgaccacgagcggacggcaccggacccctggcgactcgtggtcggggctccacaccgttgcgtcgctccgctcgccgagcgcgcaccactcgccgccatcacgaacgactaccccttgcctcgcaggatcgacgtcggcgcgctccgtctgctggtactcgacacgaccaacccgtggggtggctggcaaggctcgctcgacgcggcgtcggttcgctggctcgtcgacgaactcgacagcgcccacgaacgacggctcgacgacgaaggccgctgggtacccgcaggaggctccgacgtcgcggtcgtgctcgtcacgcatcatccgatcgagactctggtcaacacgaccgtcccagaggaggagcggccacgagtcggcggatcgtccctcgctgcgctgctggatcactacccgaacgtcatcgcctggctggccgggcacacccaccgacaccgggtacggtgggtgcgatcgaggctcggcccctacgggatgctccacgtgacgacggcgtcactcatcgactggccccagcaaggcaggatcatcgaggtggccttcgaccctcgagcgcagcgcctcgtcgtcgcgacgacggtcgtcgaccacgctggtgccgtcggcataccagtgtcgacaccggcttcgatcaccgagatcgccgggatcgcccgcatgctcgccgcgaacgaccccgagcgcctcggagagcgcgaaccaccaggacgcggtaccccgaacgaccgtaacgccatctggacactcccgatccctccagggctcgcgcgccagctcgcgcgtcgcggcgacggatggaccgcgttcgccccggccacaccgagcatgccgccagcggctccctaactgccgagatctgcgaggctcgcccggagcgcgctacggagggtcgcgacgaagcgctcgtcgacggctcgagcctcctgccacaaccgatcgagtgtcgccggctcgagactcgagcgccgtcgctcgatcgccacgaggcgggtgtggagctcttcgtgcacctggcggaggagcgagcgcgcaccctcgtcaccgatcagtcgcttagcatcgctagccaaccaccgacccaggtggcagtcgtcgaggctcgcggccatccacgtcgcgccctcgtcgtcgcgctcgtcgacgacggcggcctcgaggcgacccatcagcgcgtggtggacgctgagcagcggaccgagcccagcgcgctggaagagcgggtcctctgctcgcgggcggtcgtgccaccgtgacccctcgaggtcgagccatcgggcaacggcctcggccggcatcggcctggcgagatggaagccctggagactcacctcgccgagggagcgtgccacgcgctcgaggtacgcatcctcgacgccctcgatgacgatccgacgaccgaggaacagggcggcttgcacgctggagacgacgatgccgaagtccgccgcggacgtcagcatgccgcgcacgaagctctggtcgatcttgaccgtctgcgcaggcagctcccgcaggtaccggagcgaggcatggccgaccccgaagtcgtcgatggcgatggtgagtccgagttcggcgatcgcctcgaggacgtcgtcgactgcacgggtgtcgccgagtgccgccgtctcggtgatctcgagttcgacgagcctcgtcggcaccggaccaaggcgctcgagcgcgctcgccacatcgtcgacgaagcgaggatcgagcaggtgctgcggcgagatgttcaccgagaccccgaaggtgaacccggactcgtgccacgtggcgagctgcgcgagggcctcctcgagcacccaccgaccgacacgacgcgccagcgccggatgatcgagcgccgctccgaagaccgccggcccgatacgtccacggtcggggtcgtcgatacggatgagcgcctccatcgcctccaccgccccatcggcgctcacgatgggctggtagtcgagtgagacccgtccgcgctcgagcgcgacgaccaccatggtgcgggcctcgtcggcacgccgagccgccacctccatcgccggaacgaacaccgaagctcgatcaccaccgtgggccttcgcgtcgtagagcgcgagctctgcatgacgcaccagcccctcgaccgtagcccggtcggctgggaagctcgtgatcccgacgctcccgctcagctggggcaccccgagacgatcccagtcgaggtcacggatcgcaccgatccagcgctccgcctccgccgcgagcgatgcccgacccgatcgccccggcagcaccagcgcgaactcgtcgccacccatccgcacgacgaggtcaccctcgcgcgcgacccctgcgagcgcgtgcgccaccactcgcaggacccgatcgcccgtctcgtgtccgacgaggtcgttcacctccttgaagcgatcgagatcgagcaaggcgaccgcaaccgggtcctcggtggatcgcgatgaccgacacagcgtctcgaggcgaggcgtcagcacgctgcggttcgcgagtccggtgagcagatctcgctcggcgacgtgcagcaagttcaacgcgagtacacctgcctcttggagcggttcgaagtagtcgagtccgacgcggcgcgcaaagcccgacgccgtgaccacgacaccgagaccgcgggccggacccgccgcaaaggggacgagcaccacctcgccgaacggaaggttccggacgctgtcccagcgcggtacgaggcgatcgcccacgtcgagcacgatcggctcagacgaccggcgcccctcgagcaccgactcgaggggcgcgtcgacgacggtcgtcggtagctcgcgtcgtagtgccgcagcgagcccccctcccgcggcagccagcgtccagtgcccgctcgccggatcacgcagcacataggccacgagcacgatctccctcgagcgctcagacacgagtcgacacaacgtttcgagcatcgcaccgaccagcgaattcgtctggtcgatcgcattcgcgctcccgacacgagccgcggcctccacgagcgcgtcgaagacggccacacgatctcgaaccgtcgccttggccgcgcgcgcgaagccctcgagctggagcatcagatcggcgatgacgatgcgtgccaacgcgtcgaggagggggacgcgatcggcgatgggcacctggtgttcgacgagcgtgccccagtgctgccagtagacgacgtagccggcggccaaccacgccggatcgacgtgccacgtgaagtgtcgtcggcccagctcctcggtgcctcggcgccaggcctcatcgaagcgacgatcgagaagctgggtcgcgtgttgggcctggaggtcgatgagacgctggatggtcggcaccgagaagcccgcgaagaccgcacgggtctcgggatgcgcgagcacgaggtcgtagaaagccgcagcgagtgccggagcctcggacgccaacagatcacggtagcgctcgacgagcctccaatcctcctcaccgagatcgatgagctcggtgagggtcgtgcgtcgtcgggtgtcggcgatgaaccgcctccgcgggatccgacggtcgccgagaccgccgaccacccaggcaccgtacgaacgtcgctctggcatgtaccacacctgcccgcgccgaaatccccacagcgcactcacgtgctgggggcatcgaccacctcgcggtcacccgtaccgttggcacgccccgcgccgcacgcggacgccacgcacacctcgtgctggagcctaccatgaacgtcgacgaaggctcggagacaccaccgcgcccagcgggagctgcacaatcctcggacgagcctcgtcgcaggccatggccgcaaccgacggacccgccccagcacaaccacgacggacgagaggacgggctcagcccggaacccgcagaaccgaccttcggtcgcacgccgacgacgtggcatcacgtcgcccaccgtgggccgccggggtctcgaaccccgcaccttgggattaaaagtcccctgctctaccggatgagctagcggcccatggccatcagcctacctgcgcagttgccgtgcgccaggaaccacgagcaccgcgagcgcgactcgagccctccgccaccgggccgacacgcatcgccgagatctcgaagggccgtcgcgttctcgacgtgcgagctagaatcccgtcggctcggacagaaggaacgacaccatgggcacgacgagaggacgcacgacgaccgtgcggccgagaggtaccacgatgcggatcgccgctctggcggcgaccgccgcggcgatgctcgctggctgtggtgccacgacggccacgtccacgacgtcgacggccgcatcctcgagccccaagccgcagcccatcgcggcgacgcacctccccgacccctgttcgctggtgacgaccagcgaagcgagtgcggctctccaggtgccccttcgccagacacaggacgaatccacggcgggataccgcagctgcgactgggtcaacacgacgagcagcctgagcgcgggtcgcggctcgacgatgaacctctacttctatccgggcccgacgatctcgcaggccagcgactaccgcgccctggaggcgcaagggcacttcgcccctaccgagatcgacggctatccggccatcgtggcgggcgccgagtacgaggtcgacctcggcagcgtgctcgtcaccggtgtcgcgttctcgacggtgtcgccgcaggcatcgagcggcgccgaacgcaccaccatcgcgacggcgatccgacgcctctgcacactcgtccgctgcgtggcctgagcgcgtctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttatctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagctcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagcagtcgcactgtcgatgtgttgatctgcttgtcgtcaacctcgagcgtccggccttcgacagcgagccctaagggcgttggcttcaggccgtagctcgacttcaccgacgcgagcgctagaacgtcgccgtgggagccgagaagaagcacggatcgggcggcggcggggaaggccctggagccgagcagacggtccagcggtgcggccccactcgccttggtcaagtgaccgatcccgacgatggttgccccggcgtcacaggcgatgctacgcaaccggccgagcaccgcccgaacgtccgcgtcacggtgcgtgtcaaccctcccaccgagcgcacccgacagcggctcgacgatgaccaagcgagcatgattgtcgagcactgtccgccgcagcctctcgaaatcggcagggaaactgacggggactgtcgtgaagccgagcatgcgcggatcgccgcccgccgccaggtaccggggccccagcacactcgtcgcgttatcttcgctggaagcgtcgagcgtgacggcgggctggccgaacagggcacccggcagttccccgcgacacagccgggccgccagctgcagcagagcctgttgcatgaacctccgcggcgatctgcaaactccctggtagcacgcgtgtgagatccaccatctcaacaggctcgatggcgaggattgggcccgtggcctacaacctgctcacctcagagcgccaccagctttacctgttgccggcgtcgatggcggactggctgcctgaggaccatttggcgtggttcgtgctggacgctttggaggagatggaccttttcgccttctacgccgattaccgagccgatggctggggcggcgcagcgcacgatacggccacgatggagacgctgttgctctacgcctactgcgtcggggtccgctcgtcgcgccaggtcgagcgtgcgtgccacgtcgacgtcgccttccgggtgatctgcgccgggctactcctcgaccacacgacgatcgcccggttctgccatcgtcacgaagaggccttggagacgatcttcaccgcctcgcttcgtctgtgtgcgaaggcagggatggcctgggtcggcctcgtggcgctcgatcggacgacgatggccgctctcgcatccctgcagcgcaacgtgatcaaggacacgatcgacgaggccgtcgagaagatgttcgccgaggcgaaggacatcgacgaagccgaagacgccacttttggcgaggcccgcggcgacgagccccctgccgttcttcgtggacgccgggaccggcgctgacgcttcaaggcggccaaggaggtcctcgacaaagaactggcagccgagcgcacggcccacgaggcccatctggccaagcgggtggacgaggaggaacgacggggcaagaagctgcggggccgaaagcccaagacgccgaaggacaaggccggcgcgaaggaggagaaggtcaacacgaccgacccgcagtccaaggtcatgtcgacgaagaacggcttcctccagggcttcaacgcgtaggcggtcgccaacaaagaccaggtcatcctcgcagcctcggtcaccgacgagcagaacgacaaggccccactccacccgatgatcgaggcgatcagcgagtcgctcgacaaggcagggatcgatgagcggcccggaaagctcctcgcggatgccagctacgcgtcggaggagaacttcgccgcccttgggccagacgaccccgacagctacgtggccgttcgcaacatgaggaagaacccaacccggcgcaccggccggcgcggaccgctcaggaggaacgcgaccttcctcgacaagatggaccccaaggtgtcgaacaactcggggcgggacctctacaagcgacgccaggcgatcatcgagccgatcttcggccagatcaaagacgtccgcaagattcgctcgttcatgcggaagggcaagtccgcagcggactcggagtaaaagctcatctgcggcacccacaacctcttgaagctctcccggcgcgcccttgccacgccgggcaccgtgccattcagccggctggcgatgacgacagccagatgaaggccaagtagcaagagctcagcggccctccgtggccatcattcccgcgttcaccaacgatcagccgtccctgccgtcgccctggtggaacctgccgaggcggagcccgccgagaggagcagagttcacgcaacagcctcatctgcccccaataggccgtttcagaaccctatgatgcgtgtcatgccttccaacaccatcacaagacgccgtgcgggggcgagccccggcggtttgcgccgtctcgtctccctccaacagcgtgttaccggcagccgccaggctgccgcggtccgcaaccagctggtcgccgagcttcacgcccaaggggtgcccacacgggtgctcgccgaacagttagggatgagcgtgccgggcgtgcagcgcatcatccacctccacacccgcgccggcggctaacctgcagcgtcggtgagcgaaaggttaccgcctgcccccccgcatggggggaacctccctgaccaagcagccccccgccgtaatggcggggggcctttccgcgtcaacagcagctcaacggcggctcaggcgtaacaccaggaacgtgacaccgaggatcacgtcgaccgccacccacaaagcgatcacgatccctgccccgatcgtcgtgcccacatcggcggcagcctggcaggtttgggtggtgagcgtcccgcagtgggtggcgtgcgaccccgagtggattcccaccaccaagcacacgatgaagatggcttagacggcgaggaacacccagcggaagattcgccgtcgccggcgcggggttgtcggcgtctcagactgttgcatcggtttgcctccccctccttcaccgggagcgtggcccccgcagcggtcactatagccccgcgacgctggcagcgcccgcatcgaggtaggatcggccctccatcgccaagcgcaaacgacgactggctctaccggtggttgcgacactccgaccatgatggtcggtggacaggtagcaaccaccggtggtgggttttagcatgccaggtcgacgcctcgggttggaagagtgggaggagatccgggtcgggttggtgcgaggcgagtcgctgcgggtgatcgcccggcggctcgggcggccggtgtcgacgatcgctcgcgcagtggaccgcaacggcggttggatacgctatgtggcggcttgtgcgcagcgtcgagcgaaacgctgtgctcgtcggcccaagccaccgcggctggtggaagacgctgcgctggctcggcgtgtcactcggcgcttggtggaggaccaggagtcgccgatgacgatcgctcgagccaaggacgtaagtcatgagacgatctaccaggcgagctacccaggagaccgcgggctcgatccagggctgtggcgtcatctgcaccaccagcgccgccctcgctggcggtgaggcttccctggggagcaaagacgcttcgtgctgggccagttccagccgatccaccagcgcccagcggccgccgctcgccgcacgcagatcgggcatctcgaaggtgacctgatcatcggcgcgaaaaacgcctcgccggtcgtcacgatcatcgaccgcaccacacgcttctgcctgcttggggcattgcccgacggctacgacgcagcatctttggcgtcgtgtgtcatacggctgctgcgctcgatccctgaggcaggccagcgcaccctcacttgggatcagggccgagagatgacgctgtgagcggacatcgaacatgttctcggcacccccctctacttcgctgatccccacgccccctggcagcgtcccgtcaacgagaacttcaacggcctcgtgcgccgctggctggcgaagagcaccgacctgtccatctactcccaagccgacgtcgacgccatcgcccgccgcatcaaccacatgccacgccgctccctcaactagggccacgcccatcgccactactacgatgccctcgtcgcgatgaccgattgaaccggccctgcgttggagcgaacgcttcactctcggataaatagatcatcaaccgaactcgctactttgtactgtgccgggttctcgcgatccttgagcgcctcgaaatgcgccttgccgcagtcaatcttcgccttttccttgccacgcaagtcgtcggcgaccacactgcccttggtctcaacgacaaagtaaaagtagaggcgctcctcgccttcctgctcgacgaccaccgcccagtcagggttgtatccgcccagcggcgtcggcacggtgaaccagcccgggagttttgcgtagaccttgatatcacggttgtactcgagctgctgggcaaacgttagctcggtgtcggagtcgtagaccacctgctcatagaccgacttcttggcctcgaagagattcttcaggtagccggtcagctcctcactttcgaacagctcccgcgcgtagtagtgctcgtcacccaggcgctggtatttgatgccatcaaccatcgccttccgcttgcagcggttaatagtctctgccgccagctcgatgaaccgctggggattgcgcttgaagtcggccagacgcctactttccgtcaggacgcggtaaatcgtgcggcgcgtgagttgggtccggtcttgaagctcggtaagcaggtccggcagatcgatgtccgtttcctcgagccctacgggcgccccacgctcgcgctcggcggctaccacgccggccttgccgatggcgatatccgcctttcgccactggaggctcaccttcgggatcgccggcatttctttgagcgctttgatgcacgcctccacgagcgcttcgttgtcgaatttcacccggtatgtggttttgtccttgatgcggtcccacagcgccttgaactcatcactgatatggacctccccgcgaacacgcacctgccgacgctcgtcggcgttcttgatctcaagccgcccggccgccttcttgaggacatccgtgatttggtcacgctgcgcggcgaactcctcgggcacttccacggtgccgtccctgagtgcccttctgagtgaatcctgcacccgtcctttggcgtcgatgtagccataggccttgaaggactcccacaacgccttcgaccgttcgatgccgagcggcgaggctttgccattcgcatcggtgaccacgatgtgagcgaactggtccgcctcgacaatgccgaaccggatgccggtatcctcctcgatttccttctgcaagttctcggcgaagtcctcgtagctctccgtagcgatcacggtcagtgtattgacatcgaagccccgcacacgctcgccgtactgattcacgcacaaacgcaagccgcgcccgatggtttgccgccgttcgcgctccgtacggatgtctcgcagggtgcagatttgaaagacgttggggttgtcccagccttcgcgcagcgccgagtgcgagaaaataaacttgatcggcgtctcgagggagaggagcttttccttgtccttcatgatgaggttgtaggcccgctcggcgttgtcgcggcccgcctcgttgttctcggcagtatccgtccagccgcctttcttgtcgatggaaaagtagccgttgtgaaccttctcggcttcgcggctcacatccacccctttgaagagcggttcatactctggcaggttggcagctcgtcggtactcttcctcgaagatgcgggcgtaatcacctttcacggggttcccggccgcgtcatactggcgatacttggcgacttcgtcgataaaaaagagcgacagcaccttgatgccctttggtagcaggcgcatctccttgtccaggtgctcgcgaatggttcggcgaatcagctggcgctgaacggccagcatgtccacgtctccccaggcctgccccggcttgaggaagtgctcgccgccggggacgcgcagctccatgtactcatttcccttttcgacccggatttcgccgatacggtagccggcgtagatcgcgcggccggcgatctcttccaggtcgtcgccgtcctgaaccttcacctcccgccgcttgaccccaccgctgtcggtcttcacgtccagctcgaccttcgctgaaatgatgccgcgcttgttcgacaccgaaaccaggcgcacgtagggcttgttgtgggcatgttcgaccgtggccgaggccacctcgatctgcttgaccagccgcttctcgtaggcgtccacagcgtccagccggtagaccatgtggtgcttatccacgtgggtggccgagtaacgcagggtgcaaagcggattcatggcgtcgagcgcttccttgccgcgcccctgaaggccgccgtccacgctctgaggctcatcgacgatcacaatgggccgggtggccttgatcaggtcgatgggcttttcaccgcctgtcttctcgctttccttgtagaggttgttgacgtctttcttgttgatggccccgacggtcatcaccatgatctggatgttcgcgctggtggcgaagttgcgcacctgcccgagtttggaggagtcgtagaggaaatagtcgaaaggcacgccggagtacaggctcttgaaatggtcttcggtgatctgaagcgtcttgtacacaccctccttgatggcaatcgacggcaccacgatgacgaacttggtaaagccgtagcgtttgttcagctcgaaaatggtgcgcagatacacataggtcttgccggtgccggtctccatctccacagtgaagtcacctgatgcgagtgattccgagggcggcaggccgttgcggagttggatgtcgttcaggttcttgagcagctcgtcgtcgagcaacatcagacggttgccgatgccaagctcgttctgcgcaacgccgaggcgcatctgggtgtccgcgggatcgcgcgtgaccgtgaactcggtgcggcagatctcctgcccgcggaacagatcgcacacagcctctatggcctgccactggtagtcgaggttcggttcaaagtgcagtttcatcacaagctccgcacgttagcgatgccgttctggttgaggatggcggcgaggttcgtcttggcctcgtcgtcggcaaaggcgctgtcccggaagacgcaggtggtctcgcccgccggggcgagttccttgcgccacccgacgatgccctggccaagcgcctccacgtcgtcgaccgcaatctcctcggacaggcaagcgatcagcacgccatagcctacggcataaaccgtgtatttcttcccttctgtcccctgactcttgacttctttctcctgtatcggcacgcacagatcgaggccaagcttgagcagcagttcgtaaaggatgtccgcctcgctgcggccttcgacaatgtgatcctggtgcgcaaacagctccgcctcaaggtcatcaggcttggggttccaggcgcggatgttggatgtgtccagcttgaacacgcgaaaaccgaggtcgcccgcaaactgcgggttctcatcctggatcttcctggcggcacggcggagacgttccttggtcagctcagcgatgttgcgcggctttccgagcttgtcgcagaagtctgcggcgaccttctgttccttgttctctgggtcgacaggctccgggagttggacaaggatatagcgacggttgccgccgtcggcggcgttctgtgccatgaccgcatggccggtggttccggagccggcgaagaaatccaggacaagttctttctccttcaccccagctgctgatgccaagtactcgattaacccccgcggctttggattgttgaagaccgttgcctcgaaaagttgctgaagctcttcagaccccttttcgttgtagcacgtattatcgtcaagaaggtcgttcagtaactttgcttgatctagctcctcagggagcattgttcgacggagccctaagttgcgcgttacaaagagcgtcctatcaagggtttcttgattgattctccacggacccctgatgcgcacatccctcgcgactctcccatccgtaaccttaaggtcgtcaagcaattcaaacgagaggctgcgggccgcgtaggtgcccgcattgtacgttccatcgccacacttggcaatagcaccggaacgtagcactcgcacgcttactgtgttgccttcgttgaacacggggcgtgtcccatcggatacttgacccgcactaagtggggcggcggcatctgagcgaacgtatgcgacaacgtaatcgcacatgtcggtcattcgcttcctcaggaaagcggtcttccttgccgcgcgacgcttgataacgccgcagaagttttccgcaccgaacacttcgtcacacagagtgcggaggtgtccgatttccccatcgtcaatgctgataaagagcactccatcttcccgcaataggttcctcgccagcttcagcctcggatacatcatgttcaaccagtcggtatgaaaccgcccgctggcttcggtgttgctgctgatcttccgcccgccctccacctgccccgtcagctcgaggtagttcttgatgctgtcctggaagttgtccggatacacgaagtccttccccgtgttgtacggcgggtcgatgtagatgagcttcaccttgcccgcgtagctcttttgcaggagcttgagcacttcgaggttgtcgccttcaatcacgaggttctgcgtggtgtcccagtccacgctgtcttcgggcgccgggcgcagcgtcccggtcgagggcgtgagcgcgagctgtcgagcctggcgtttgccgtgccagttgaggccgtacttttcatcgcagtcggtgacggtggcatcacccacgagctgcttgagcacgtcaacgttgaccgccgcgccgttgggtccctcggtgatgagctcagggaacaacgccttgagcttggcgacgttctccgccaccaggtcgtcggaacgggcttcggggtcggcgggcgtcagtttcttcattgtctcctcctttatagtctttcgcgagcggccgcgcgggccgcttcggcgcgcttgagttccaggttcagttccacccgccgggacatctgtttctccctggcggcagcagtgcccaggcgggcgatctcggcgtccagtcgggcgcattcgcgcaacgcctcctgccgcgcggcggcgtgatcggcatcagaggcaaggacgaagacgcccgtcacgcgggccgccttgagcgcgagcagggtatccatccagccctgatagagggcgtaaagggcggttctcggttgccgccccagcgccaacgcggcggaaaaggcgggccagggcccggcgtcgcgctcgggactcagttccgcgacaaccaactcgccgtcgagcaccgtcttgcccgcctcgttctgcgcccaacgcttgtgggcggcggaaaggtcggcctgcgcgccgagttcggtgatcagcagcaacggatagggcacggcccgatgcaccagctccaccaggcgctgcaccttggccccggcgcgcagggtcaagcgaagcacggcgatttccaggtactcgcgtatggcgtcccgatattcggccacgccgatggtcgcgggcttgagcgccgcaacccagaccaactcctcgatgctctcgttgatctgccgcttgtcggcgcccgtgggcgcgccgttttcaaggagcagcgtcttgggcacgcgccggtccacgcggcaactcgcgggaaggtcgagggcggccaggatcgcgtcagcgttcattcgcccgcctcgggcaagatcacaagataggccgccacctcgaagtcgttgatgccggcaaattcgcctttgagcgcgtgcgtcccgcccggagaaaaaaggctggcgacggcccgctcctcgttcttgcgcaccaccgaggcgacggcggcggccagcagccgttgcgcggagcgcatgtcttcgccttgcttggtggcccggtcgaaacgggcgcaggctccgacatcgggcagatcgcgcccggcgcagaggcgcttcagccgatcgaggatttgcttggcctgggtgtggggaagcagtacggtgccgtcctcgcccacgtgaacgaggtagtgcggagccagtggatagcccgcctcgaccgttcgcttcgccgcctcaccctcagcccgcaggcagaagatgatgccgggcggtatctcggcctcggtcgtcgtcgtgaccgcgtaggtgccgagcggcaggttctccagcacgccggggtgcgccttgcggaactccgcgaggtcgatgcgaaagtcggtcagcgtgagatcggcgatcgagacaccggtcgagaggtcctccaggtcgatgaccgcatcctggagcttgaggagctgcttgcggcggtactctaggtcgttcatctggttgccggactgctgctcgatgaggttttcctcgccggtcgccgagatgtcgaggagcaccatgcggccgctcacgcgctgctccaggttgatgtactcctctagctccatgttgggccagaagttgacgagctgaatgcgctcgttgggcgagccgatgcggtcgatccggccgaaccgctggataatgcgcaccgggttccagtggatgtcgtagttgatgagccagtcacagtcctggaggttctggccctcggagatacagtcggtggcgatcaggaggtcgagttcgccttcgtcggccaagtcttccggccgttccttggagcgcggcgaaaaggccgtgaggatggaggcgagatccttgcggagcttgggcagggtggtctggttgtagccggtgccggtgaccagggcggtgtcgatgtcgagccgctttttggcccacggggcgagctggtcgtagaggtagcgggccgtgtccgcgaaggccgtaaagacgatcaacttccggttgccggggttgatggggttttcggccttctgctcgatcattttccgaagcgcggcgagcttggcgtcacgcgaagcgtccacctgcccagcggcggtatggagtttgactagccggttgcggtcttcgatcaggtcctgcttccaacggataagatccaggtccttgaggaggaccttgaccttgcggccgaccaggagactctcgaaggcggggtcgtcgacatccaggtcttcgatgtcaatttcctccatctcctcggcgtggttctcgatccgttccagcgtcgcctccacgtctcggagctgccgctcgacggtcagggcgaacgacggcacggcgctttccatgcgcttaagtacgttcacgcgcaagagatggatcaggctctcttcgcggtccacctgccggaagaagcccgtgccacccttgacctcggtgctgtacttcttgtcgtaggcttcctgcttgtgcggaagcacgtaccgcaacggcgcgtaggcggacagattcaggcggcggatttcgaggttgatgtcgcggatgggcgggaacttgcccgccaggtccacgtcggccttgatgttgatcggcttcaagcggtccgggaatcgtcccgtctcggcgatgccgtagtatttttcgatgtgcttgcgcgaccgggcgatggtcagcaggtccaggagcgtgaagtagtcgaaacccagcatctcgatcaaccgcgacggcgtgcgctcggactcgtccaggttgagccagcggttgaactgttgctgcgccaggcgggtggtgctgtcgatgcttccgacaccgtggtcgcgcagggccgtgtcgtcgccctcggtggcaaaggcaatctggttgcgcaggtcggccatgcggttgttgaccggagtggcggaaagcatgaggacgcgggtcttcacgccctctttgatgatcttgcgcatgagtcggtcgtagcgcgtctcaccgcccttctgcggtgtgcgcttgttgcggaagttgtgcgactcgtcgatcacaacgaggtcgtagtttccccagttcacgtccgcgagatcgatatcgccggagagtccgctatcgcgcgacagatccgtgtggttcagaacgtcgtagttgaagcggtccggggccaggaagttgcggcggtcgttggccttgtagagcgtccagttgtcgcgcaggcgcttggggcagagcacgagcacgcgatcgttgcgcagctcgtggtacttgatgatcgctagtgcctcaaaggtcttcccaaggccgacactgtcggcgatgatgcagccgccgaaacggttgagcttgtcgatggctccgatcacgccgtcacgctgaaacttgaaaagcttcttccagaccaccgtgttgcggataccagtcgcggtcttgaccacgcgctcctcgtcgagttcttctcctcggtcccggaagatgtggtgcaggatcaaagcatagacgagaagcgggtcccggttcccggccagttctttcaagctgtcgatcaatgcggtcttcgaggcagggtcggccgcaagggcggaccactgtgcatcgaaccactcgcttagtaacgtggcctcttcgagtgtctcggatgcctggatcaggttcatcggattgcccggcgtcaggccgaggccgtccgtgctgaacgccagcgaaccgaggagcgcctgtacggggcggccgtttgagttgcggatgacgaacgcgccttgcgggatggggctcaacgcgcggcggacttccgccttgttctcgatccactggagcaagcgcttcgccagccagcgggattgcaggcggttgcgagcgggacggtcggcagccgtacccagcatcgcaagatcggaaccgttcggcggcaacaccaggcggcagccttccagttcccgcgcctcgcgattgacctccgcgaatgcgaagagcgacaaggcgggcgtgagcacgtcgagccgatgactgcgcccgatccccagacggatcagatcgatcacgcggtccgtgccggtgttgcggatgaacttcatgccgctcttacccctcgtccacaatagagtaactggctctaccggtggttgcgacactccgaccatgatggtcggtggacaggtagcaaccaccggtgggggttttagcatgccaggtcgacgcctcgggttggaagagtgggaggagatccgggtcgggttggtgcgaggcgagtcgctgcgggtgatcgcccggcggctcgggcggccggtgtcgacgatcgctcgcgcagtggaccgcaacggcggttggatacgctatgtggcggcttgtgcgcagcgtcgagcgaaacgctgtgctcgtcggcccaagccaccgcggctggtggaagacgctgcgctggctcggcgtgtcactcggcgcttggtggaggaccaggagtcgccgatgacgatcgctcgagccaaggacgtaagtcatgagacgatctaccaggcgagctacccaggagaccgcgggctcgatccagggctgtggcgtcatctgcaccaccagcgccgccgtcgctggcggtgaggcttccctggggagcaaagacgcttcgtgctgggccagttccagccgatccaccagcgcccagcggccgccgctcgccgcacgcagatcgggcatctcgaaggtgacctgatcatcggcgcgaaaaacgcctcggcggtcgtcacgatcatcgaccgcaccacacgcttctgcctgcttggggcattgcccgacggctacgacgcagcatctttggcgtcgtgtgtcatacggctgctgcgctcgatccctgaggcaggccagcgcaccctcacttgggatcagggccgagagatgacgttgtgagcggacatcgaacatgttctcggcacccccctctacttcgctgatccccacgccccctggcagcgtcccgtcaacgagaacttcaacggcctcgtgcgccgctggctggcgaagagcaccgacctgtccatctactcccaagccgacgtcgacgccatcgcccgccgcatcaaccacatgccacgccgctccctcaagtagggccacgcccatcgccactactacgatgccctcgtcgcaatgaccgatcgaaccggccgcctcacgcgcgttccccagcaccgcgcgcagcgctaccagcgccccctccaggcggtaaaccgtcgcagccggcgccaccagctcgccggccctgaccctcttgagcaagactgcaacctcatcggccagcttctcgacttcagccttcgtcacatcgccaccttcagggtcacttcactccaccgcggtcgtcgagtgccaacccacccccaccccagctgctacccatcagtagtcaacccaccccaccccagctgctacccatacgtagcaacacggctgaggggcgcaaaagttaccaacgagtaactatcagggtaactatcagggacgcgcttggtgcccgagatcgtgggtcgcgcgcacgggcctcgtcacggctccccggcgagggcgtggtacgcagcctggataataggagccgccccttggcccgctaccgccgccagcgggtcaggctgggcctcgcagtacggcctcggcctcatcgagcacctcgtcctcgctggcccactcgtcggggtcgaggtcccacggcgcgggctgcgggaacggctcgctcgggtcgggcggcggggccaggtcgagcacccggtcgggtacgtccggtggtccgtcgtcccacggctcggggggctccaactcgactggctcgccgccaagaggatcatccgcacttgatcctcttagagttgatcctcttagagttgatcctcttagagttgatcctcttagagttgatcctcttagagttgatcctcttagagttgcgtcagtcgcgggctcggggtcgccgccctcgccgtgaaggaccgacaaaacggggcgatcccgggcctcatcgaggccccaccaccactcgcccgcccggcggatcgagcgaacccggagggcgctcttggctcgctttaaggtgaccagcgagtaccccgcgtgcgcggccaggttggccacctcctgcgctcgcatcggcccctcggccagctggtctcggagccacatctcagccgaccgcagccggccgcccccgtgttcgccaccggccttcggcagaaggtcgaccgggtcaacgtcgaccggccctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagttcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagcccgctgctggtgtataggacgcgcttcccgtctgcggcaagacctccacccaggtgcggccaggatcgagcggaatgatcgatccgttcgaactccgcagcaccgtgggactcgcgagcgacgcccgcgaccacgttcctcggatcagctcgccgttgcgaaggacccagacgttgccgctcccgatgacctcggagtgaaccccgagcgagttcggaccgctctcgttgtagggccccggcaccgattgcacgaactgcaccacgacgttcgtcgcgctctgcacggcacccgacgcgccgtaggcaggtacgcctgcgtaggagcgatcgaagagcccagtcgcagcgttccacgtccactcgacaggctcgaccgccgagaacgtcaccgcgaccgacgacaccggaatgccaccgtgcggcacggtggacgagaaggtaaagatcggcgagggcgcggtcgtcggacccacgagcgaccagatccccgccgggttgccgtagaggttctcgggaggcacgcgcgtcgtggtgcgctcgaacggtgtcccgctgtagtccaaggcgtcgacgcgatgcagccaggtctgagccgccagttcctgccggtcggggatgatccctcccgcgtagacgaggatcggatggccgaactgcccgaggacgtgccagtcgacccagcgcagcgaccgaatcggacccacttcggcaggcgagccgcactggaagatggcgatgaatcgcgtgatcccaccctcggcctggacctcgtagaccatgtcggcttcgttgagaccgctctgaggacgagcgcccggatcgttgccgaccttgatcgccagtgccgcacgatcaggaacgacgccgccaggtgccgcacgaccggtcagcgggcatgtggctgacgcaggtgcggccgacgacgacaccggcgtctggctcgtgctcgtcgagtcggcgtgcgaggagggtgttcgggagtgatcgagggcgagcgccgcgcctgcgccaacgaccaccaccacgacggcggccccgagcaccacgcctcggcgtcgacggacacgcttcgaggtgcggtgcgccatcactcctcctcaaacgttgaacgcagcgagcttagggccctcatcgcccgaccccatcgtctccgagagcgtggggctcgcgtcccgaacgcgccgaggacgccggcgcatcggcgaggtcacggtagcgaacccagccgaccctgaggcgaccagcaacgacgacaccgagcgcatccggctcgacgagccccacgcggccgaagcgcgcccgcgccagtgcgagcgagctatcggcgtcgatgctcaccactggggccgcgggcggcgcgccgcgccggacgcgctcgagcaggccacccgccatcgtggcaccgagaccacgatgagccaggaagccctgccatgcatcgcagccaaggtcgcgagcccatcgaagctgatcgggccgctccacgcccaccgcgaccacgatcgcgccgagctcgtgggcggccgtcgtggtcacctcggcgatcaagcgcgcgcgctcgcgcgtcgaggcggcgacgatgctccggtcgaccttgaccacgtcgggctcgagtatcgcgaggcgctcgagaccggcgaaccccgcccccgcgtgatccagcgcgaccagcaagccagcgtgccggagcggttcgagcgcgcgcgctaccacctcgggcgatggaccgcccgcgagctcggagacctcgacgacgaggcgcgacgctcggggctccaagatgcgcagcacggcatcgaggaccaccaccgacggcgacaggttcacgctcagccgcacgcccgactcgaactccggggcgtcgagaagttcgagcacgcgagccagtgcgacgagctcgagatgcaggtcgagccccaatgcggtcgccgagctgaagagctcgtccgcctcacactcgtcgtctcgaaccaacccttcccacgcgatcggtcggttggtctcgatgccgcggatcgcctcgagacgaggggcgagccgttcagggcaccccaagacccgctcgatggcgccccgggacacgctcatcgccgatccgaacccgtgtcgtgatcgtcgaggacgacaccgaggacgtggcgccactcgtcgacgacgagcaccgcctcgaccccaccatcgagtgcgcgacgcacgccatcccagccctcgacgagatcgacctcggccgcgcgaagcggtgctcgatcctgatcggcgacccacacggctcgacccaagccgtcgacgcccactcgcagatcagtgccgagcaacgggctgcgcgcaggaacgatgcgcgcgacggccagtcgttgagcgagttcggcgccaaagagcacccgacgatccgaccgaacgactcccgcgatgcactccgggtcgacccgagggaagccctctgctggacgagccagccaatagccctgcgcggcatcgattcccaaccggacgcacgcgtcgagggtgaggcgatcctcgactccttctgcaatcacgcgggctccgagacgatgcgccgtctcgacgagcgtggtcacgacgccagctcgaccggcgtggtgagcgaggcccttgacgagtcgggcgtcgagcttgacgatgtcgggacgcacgcccatcagcagatcgagaccgccaaagcccgatcccgcgtcatccactgcgaccaacgctcccgcacatcgcaggtcagcgagtgatcgctcgagcacggcgacgtctcgcgccggcacgtgttccgtgagctcgatcacaacccgatcaagacgggcgtgcaggagcacgtcgcgcacgcagggcgcatcgatgacgctcggggcgacgttgacgtgcaggcgccagcctcgcgcaaggcgcctcgttgcagccagcgcacgctccagcacgcgagcctcgagatcggcgccgatcccgagcagctgaccatggaggaacactgcttgcgtggctcgtacaccctcgaaccgtgcgagcgcctcgtagccgacgacactgcccccgtcgagcccgacgattggctggtggaccatcgtcaagccgcgaccactccgcacgacctgcgctgcgcaggtcgtggcccgaagttcgtcgctcatcggatccacgctgatcggatccagctcggcaggatccgtcaccaccgcaatcccttcgctctccacgctcgttgacctcggcgcgttccggtcgcgacttgacgcactacgtccgatgatcgcggctcgatgcctgagccctgtcattgcgaacggtcgccggttccatgacgtggctcgagcctgcatggagagagcgaacctcggcgtgatcgacgatgcgcactctcgccagaggtgggcccgtgcgcaccacccgatgatcgacgggtgggcacaaccgcagctcggccgccggatccctgggtccaacagacgtcggtgcgcagccagcccgccacctcgccaagacccaagggttgtcgtcgccgcatcgcagttcatcgcgttcgccgcggccaacccgccaggtaacaacgacacgtcgtgaccaacgtcacctcccccagggaccattggctcctgcacgccacacgcgcccggcgtagcttcagaggtgtcgagagtctcgggcgaagggaggcacgatgaacgagacgaccatggagtcggcgggcgagaccagcgcaacgaccggcggcaagctcgccatcatcgcctacagcggcaccgcggacaagctcattccgctgggagtgctcgcgcaagcggccgcggcgatgggctttgccgtggagatcttcgtgacgggcttctcgctccttgccttcacgaaggaacgtcacgagctgccctttgccgcggagtacgcagcgatggctccccagctcgccgaaagcctctcggccaacaagatcgccccgtgggacgagatgctgcgccaggccaaggagctcggagctcgggtgcacgcatgctcgatgatgtcgacggtgatggggctcggtccggacgacttcggcgatctcgtcgatgacgtcgtcggagccgcaaccttcgttgctgcagctgaaggcgcagagacattcttcatctgagcccgttgcgaggcgaccatggcatccaaggagaccacatcgaggaggtgcacagcatgaccgaacagccatcggagcagacgacacgaacgatcgtcgattcgcggggatctgcttgccccggaccgatcacggacctcgcactcgcctaccgcaaagccaaggtcggcgacgagatcgagctgctcgcaacggatcccggcgtcaaggctgacgtgaccgcttgggcggccaagacacataacgaggttctcgctatcgaagagggggtcgatggtgtgatcacgacccggatcaagatcgtgagccggtgagatgacacgccgcgtgctgatcgtcggtggaggcgacgggggcacgatcctcgcaaactcgctcgatccccgccgcttcgacgtgaccgtgctgaccgcctcacttgaacatgtcttccagcgcggttacctcggcgtcgccttccaggggcggcgtcgcaacctcgtgcgcgacgagcacagcttgctgcgctcgcacatcacactgatccacgacaccgcagtgcgcatcgacctggttgaccacgaggtcgagaccgcgaccggcaggcgtctcggttacgacgacctcgtcatcgcgaccggtgtgcgcaccgatccgtcccagatccccggtctctgggagatcaatgagcgcatcggcgacttccactcgacgaccgcgaatgcgcgtcgcttgtggcgcaacctcaacgccttctccggaggcaccgtggcactcggacaagcgagcccgatcatcaagtgtccaccctcgcccgtggagggaatcctcggcgtcgacgcacgactacgggctcggagggtacgggaggcggcgaagctcgtgctgttcaccccgtacccacgcgcgtaccccgcagagcccatcaacgaggtgatcacgccgattctcgaggagcgaggtatcgaggtcatgccgttcttcgacgtggatcggatcgatcccgcgaccgggaccatcacttcgctcgagggcgacgaagtcaaggcagacctgcccatcgtcgtacccccgttcgttggagcgccgatcgtctacgagcccgcggacgtcgtcgacgacaatggactcgtgaagacgaacaaggagacgctcgccgtcgagggggtcgagcatgcgtggtgcatcggtgatgccaacaacgtgccgacgtccaaggcgggcgtgggcgcgcacctcgaggcgaaggtggtcgcgcggacactggcaggtcacccgacgcgcttcgatgggcgcaccaactgctccctcgagatcgtaggagatcggcgcttgaccttcgtcattggatctttcgacgctccggtcgagaagctccggccgacacgagtcaagtacctcgaggagtggttgctcggcgagacgttcttctggggccttcggggctggctggacccggtcttcgacgcctacttccgactgaccgagccaaaacctcggcgagtcgccgcctgagagccccgaggtctcgtcactcaccttctctcgtcaagggttactcctcggtctcgtcgtcgagccccttgacaggcccggctcgtgcattggcctgggacacacccgtcgaggaacgattggagaccacgatggtgcacgacctcggcatcgagacgagcaacgcctccgcggtcaccgaggatcgtgtgcgatcgatgtcgccccgacgcgcgagcggacaacaccacgaccatgcgtcgtcgcaggccacgggacccgggttcgtcgctgctcgggcgagaggccgatggcgcacggcacctgctcgagaggacttcagccaactgccacaccagtccacgatcgtcgtggcgacgaggggcagaggcgcatgacgctcaggacccagtcatcggccatgcgtcatctcatgccatcggtcgtgtcgggagcgccctgacaccggaaacttcagtcaggggccttccgtctcgaggaggccggtccacgaggaacccccgtcaaggaactccgccaaggcagccgtgcgcacggaggaccggatgcctcgaccgcgagccgctgggcgctcgcgcactcctcgaccgtgcgcagcatgcaatcccaactccacaggagacgaacccagcgggtgctcaacctggtgtgcactcgagcgcgatcgaagccccgtccgcgggtcgtacgccctcaccttgcgcgagctcagacagacgcttccacccggaggtcaccgcgccgagagcgactagggtgctccgcaccaggggcgcttagctcagtcggttagagcgcagccttcacacggctgaggtcggaggttcgagtcctctagcgcccaccggaaccgcgacgccgtggacccgacgcgatagacccgacgcgatggacagcgccaaggggctcggaccgcgctcgtccttcgcaaccacgacacggagcgcaacatcgaggcccgtctcgcccgcgcatcgcgacgcacggcctgacacgaccgcgtccctttggagcgagtgatcgagtccgcaacggaggcggtcgacaggcctgaccagacgaacacgtcgccactcgccgaccccactatcagctcgatcgatgcccagtgatcgatgcccagttcgggcgggggccatgttgactggcgctcggccacgcggaccgcactaccccgacggtggctcttggctgcagcacccgacgcgcacgcatcagcgtcgtgccctgtcacctcgaccaccaccactcgcacccgctcgcgtcgccgacgcacgaaggatgcgaggaactaccagtctcgtcaggactcacccgtcccggttcggccggaccaccacagtcgtcccgaccgcgtcggccaccaccgaagcgaggactgacgcgccagagcgctcgacgtcacgcgtcgcggtcaacacgaccagctcgtcatcgaccgcccaccggacgaggtcggcgaactgcgtgcccgtcatctgatgctcgagttcggccagatagcgacggcgaaactcgggccagcgctccggctcgtgaccgtaccaccgccgcagctcgtcggtgggagcgagctcgcggcaccagcaggcgaacggagcatccgcacgccggagcccacggggccagaggcggtcgacgagcacccaatggccaggcggccatgggcgctcgtagacacgccagagcacgactcccacgagagacccccgcgagcgggtctagccgtggtgatgacgctggcggatcatgttgagtgcgctccctgcgcggaaccaggcgatctggtcctccgagaacgtgtgacgcagttcgagatcgaagctggtgccgtctggtcgatggaccactgcgcgaatgggttggtcaggcgcgagctcatcgagaccgacgaggtccactcggtcatcacgctcgatgcgctcgtagtcggcaggatcggtgaacgtcagcgggagcatcccttgcttcttcagattggtctcgtggatcctcgcgaacgaacgcgcgatgatcgcacgggcgccgaggtagcgaggctccatcgccgcgtgctccctcgacgaaccctcgccgtagttctcgtctccgatcatgacccatccctggccggcgtctcggtagtggcgtgcgatctcgggcaacggctcgtcagcctggtggatctggcaccaaccatggccgggctccgcggcgaaggcgttctggaccccgaggaacaggttgcgtgagatgttgtcgaggtgaccgcggtagcggagccagggaccggccgccgaaatgtggtcggtggtgcacttgccgaccgccttggccaacacgacgagcccgacgagatcaccaccctcgaagggctcgaacggagtcagcacctggagacgctccgacgccggatcgatgcggacctcgatcgcagaaccgtcggcgggcggtgcgacgaagccgcgaacttcgcgcgcgaggccagcactcgggagttcgagcccctccggctccgggagccgctccccggcgagctcgtcggtgagggggttgaagtcgagggtacccgcgagcgcgtaggcaacgacgacctcgggcgaggcgatgaacgccaacgtcgccgcgttgccgtcgttacgacgcggaaagttgcggttgtaggacgtgatgatggagttggtcgtcccaggctcgatatccgtgcgatgccactgcccgatgcacggaccgcaggcgttcgcgagcacggtcgccccgatcgcctcgaggtcacgcaacaatccgtcacgctcgatggtcgcacggatgcgctcggagcccggggtcacgaggagcggcgtgcgcacccgtagacctctggcgctcgcccaacgagcgacgctcgccgcacgtgcgatgtcctcataggaggagttggtgcacgaaccgacgagggcgctcgagagctcgagcggccacccatgctcgcgcgcctctcgaccgatcgacccgaccccacgtccgagatccggagtcgcaggcccgacgatctggggctcgagcgtgtcgagatcgatctcgatcacctggtcgaagtagcgagccggatcctcctcgacctcggggtcggcctcgagcgacccgaggcgggcttcgacgagcgcagcgatctcgtcgcgacccgtggcccgaaggtaggcaaccgcatggtcgtcggcagggaacaacgagcacgtcgcgccgatctcggctcccatgttgcagatcgtcgctttgccggtcgtcgagagcgcacgggcgcctgggccgaagtactcgaccaccgcgcccgtaccgcccttcacggtgaggatctcggccacccggagaatcacgtccttcgcgctcgtccagccgttcgggcgtccggtgagccgcaccccgatgagacgcggcatgcgaaccgtgaacgggtcgccgaccatcacgtcaacggcgtcggcccctccgacgccgatcgcgaccatgccgagacctccggcgttcggggtgtgcgagtcggtcccgatgatcatgccgcccggaaacgcgtactgctcgagcacgacctgatggatgatgccggcaccaggctcccagaagccgatgccgtagcgagccgacaccgacgacaggaagtcgtagacctcacggttcgtgacgcgagcggccgcgaggtcgtcatcggcgccgcgctccgcctggatgagatggtcgcagtggaccgtcgtcggcacccgaacctcggggaggtcggcaaccatgaactgcagcagcgccatctgcgcggtcgcgtcctgcatggccacccgatccgggtcgagctcgatccagctcacaccgcgctcgagttcggcgcgctcagggtggcgtaggtgcgcgtagagcaccttctcggcgaaggtgagcggtcggcccaaccgctctcgcaggaccgacgcaacctcctcgtagcgtgcgagcgccttggcgacgagcgccgccggcgttgtatcgcgaacctctgccatggtggtacctctctccctctcgaatcccccgaagaggaccgatcgttgtcacgcagcgctagcgtagacaagcataggacaagttcgcattccccgctacctcgccatcgcagagcgcctccgcgcttcgatcggcgatggccgcacgagcgaaggtgacctccttccttcggaggccgagctgtgcgcacgctacggcgcgtcacgcatcaccattcgccgtgccctcgagacgctccgagacgaggggctcgtcgagtctcgccagggccttggctggatcgtgacgagggtgcccgtcgcgcagtcgctcgggcgctttacgaccatcgaacagcagctccgagaactcggacgcacacccgaacggcggatcctgtcgtcgatcatcaagcccgcgaccgggccgatcgaagccgttctcgggggcggtgacgtccgcgaagtccgacgtttgaacctcgccgaccaggagcccttcgcgaccgtgaccgtgtggatccccgcgcacctcgcagagcgcttcacggtcaccgaactcgaacgttcgtcgttctacgagctcctgtccgcgagcggccagctgctcagaccgctcgcctgggcgcaccaagtgatccgagcggccgctatcgacgagcacgacgctgcggtcctcaacgtgcccgcggaatccgtcggcttgaccgtggaacgcacgacctacgacaccgccgacgtcgccatcctccactcccggttcgtgttccccgcaagccgcgtgttcttcgaggtcgacctcgtcgatgaggtcagctccatcggtccgagcggcctccgcctcgtcacctgaaccgcttgacaggattcattcagagacctacgatgctgtatcgagctatgcagtagcacggctcgctgcacgtcgaggggggaccatgagctcggcaccgatgttcgaggcgcgttcgatcgagcagattcccgaccacgaacgccatggtcggccactgtcgctgctcacgctgtggttcgcctccaacttccagatcaacggcctggtcaccggcgcgatcgccatcgccgtcggcttgagcgtgccccaagcccttctcgccctcgtgatcggcaatctgctcggtggtctgttcatggcctaccactccgcccaaggccccaagctcggactcgcgcagatgatccagtctcgggcccagttcggcttcgtcggtgccatcgtgccctatgcggtcgtggtcatcatgtacctcggcttcgcggtcgcagggggcctcgtcgcgggaccggccatcgcgagtgcgctcggcaccacgagagatgtcggcatcgtcgtctacaacgtggtcgtcctcgcggtcgcggtgttcggctatcggctgatccacgcgatctcgcgagcgatctcgctcctctcgctcgtcgccttcgtggtgatcgcggtcgcggtgctcggtcgccttcacctccacgcggcgccgtcagcaggtgccggggccttcctcctggcggtctcgatcgccgcatcgtggcagatcacctgggccccgtacgtctccgactattcccgctacctgccggcgagcactcggacctcgacgacggtcgcgttcacctacgtcggctcggcgatcggtggcgcgctcatcatggcgatcggcgccctcgccgccgcgctcaacgcgaacgccgtgaacgccaacccgatcggctttctcgccggacaggtctcgccgatccacgaagcgctcgtcgccctcctcctgctcagcctcgtgccggcgagcgcggagagcccgtatggcgcattcctgaccgcgctcgcggccgtgacaccccggggactcgtctcctcgacacgcaccgcgcgcacgatcttcgtcgtggccttcacagtggtgagcctcgtcctcacgctcgccctcccagcgacgatcctcacggactttgagaacgtgatcttgttcctcctctatctcctcgtgccgtggacggccatcaacctgaccgactactacctcgttcggcgtgggcgctacgacgtcgccggcatcctcgacgcgaacggcccctatggccgcctgcaagctgggccgctcgccatctacgtcgtcacgatcctcgtcgagctccccttcgtgaactcggcgctctacgagggaccgatcgcccgagcgctcgacggcgccgacatctcgtggatcgtgggcctcgtcgtcgccacgatcgcctacctcgcctgggctcgcgcacgcggcctcctcgtcgccagggccccggggacggcgccggcgtgaccgcacgcgccgaccgtctcgccgcgctgcgcgacctcgtcgggacgaaccgcttgactccggttcagcgtcggatcgtccagaccatcgccgagcacctcgacgacgcggacacgttctcgagcgccgagcttgcggcgattgcgggggtctcgcaaccgtcggtcacgcgccttgcgtccgcactcggctttgcctcctatccagagctccgccaggcgctgcgcgctctcgtgcgcgacgactcccaacctgtcgagtcgacgccccgactcgacgcggtgcgcgacgagatcgccaacctgacctggatggagcgacagctcacctcagaaccccttctcgccgaggccggtcgtcgactggcgggctccgtaccgctcctcgtcatcggccttcgtgcctccgcgccactcgcggcgtacctgagcttctacgcccgcaaggtacaccctgccgtgatcacggtcgaccgcgccggctcagagggcatcgatgcgatcgccgaggcacacgcgcgtggcgccaacgcagcgctcgtcctcgcgctgcccaggtggccgagagaactcctcaccctcgtcgaggtcgctggcgacctcggcatcgacctcgtcaccatcgccgaccgcgcccacgggcccatccaggcgcgcgcacgcgtgtcgctcgtcgctccggtcggaacgagccttctctacgacacccacgcaagcgccttcgtgctcgcgcagctgctcgtgcaggcgatcgccgacgccgcgccgctcagcgcgaaggcatcgatggaggcattcgaagaacgtgcctcgcgctatcgctacttcctccgaggagaggcatgaccgcactgctcgtcgacctcttggagcgtgcacgcccgatcggtcggcacgccgacggtggctggacgcgtctcgggttcagccccgaggagaccgctctcggcgacctcgtcatcgccgaggcgagccggatcgggctcgacacctcccgcgaccgggctcagaacctctgggcatggctgggtgcgccgggccccgacgcactggtgctcggctcccacctcgactccgtcccccgtggcggcgaactcgacggtccgctcggcgtcttcactgcgatcgcagccctcgacgccctgctcgctcgcggctggcgcccacggcgcccgctcgccgtcgtcgcctttcgcgacgaggaaggcggtcgcttcggacgcgcctgtctcggctcgcgcctgctcgccggcgaacttgcgcccgccgatctcgcgaccctgcgcgatgggcacggacggagctttgccgaggtgctcagagacctcgagctcgagccggcgcgcgtcgggcccgatccccaacgcatcgcagcgatcggcacctacgtcgaactccacatcgaacagggtcgccagctcgcacccctcggcgcaccggtggggatcgccaccgggatctggccccacgcacgagcgctcgcgaccctgcccggtgaggcgaaccacgccggcacgacgcccctcgatgaccgtcgggatccggtggtcaccctggctcgcctcgtcctcgccacgcgagaccaggcagcactcaggggagcactcgccacgatcggccgcatcgacgtcgaccccaacgcccccaacgcggtagccggctccgccgcggcgtggctcgacgtacgggcaccccaggcgacgatcctcgatcagctcctcgacgatctcgcacgcctggtggtcgagctcggcgggacgttcgacctccgctcgatgacgccagcgaccatcttcgatacccagctcgccagcgagctctccgcgctcctcggtggtgccccacggatcgccaccggagcggggcacgacgcgggtatcctcgccgaccacggcgtacgagccgggatgctcttcgtgcgcaacccgaccggcgtgtcccacgcccccggggaacaggcaacacccgccgatcttgccgcagggcagcacgcactcgagcgagtcatcgaggcactcgcatgaggatcgcggccgacttcgcgctgctctcaccgaccgagctcgccaccgacgtggtcgtcgaggttcacggcgagcgcatcaccgcgatcgagcacggccgagcgggcgcgtgcgacagcgccgtcgagctcctcgtgcccgggttcgcgaacgtccacggtcacgcgttccaccgcgccctgcgcggtcgggccagcctcggcgctgacttctgggactggcgatcgagcatgctggccgtcgccgagatcctcgacccggatcgctaccgagacctcgcaaccctggtctaccgcgaactcctcctcggcggctacaccacggttggtgagtttcactaccttcaccacacacgagacggctccccctatcgagatccgaacgccatgggcgtcgccctcgtcgaggccgcccgggccgcggggtgccgctacaccctgatcgacgcggcctacctccaccaggctcccgaccacggcgagtgggcaccgaccgagggcgtccttcgtcgcttcgccgacgcaacggtcgatgcctacctcgcgcggaccgaagagctctccgagggcgcaacccatcgcgtgcaactcgccgggcattcgctgcgcacgtgcacgcccagcgagctcgtcaccattgcgcaggccgcacggcgtggctggcacctccacctcgccgagcaacacctggaggtggagatcgtcgaggcggcactcggcgcacgaccggtcgcgctcctcgagcacgccggcctcctcggccccgagctcgtggcggtgcacgcgaacgcggcgacggccgaggaactcggcacgctcgcacgccacgacgtggtcctctgcgcatgcccgagcaccgaggaggatctcggtgacggaccatcgcctgcggcgaacttccatgggctcggtggacgcctcgcgatcggctccgacgagcacgtactcgccgacgggctcgtcgaggcgtcgcgcctcgaggcccatgcccgactcgcgagccgccgacgtcgcggtctcgatgtcgccgcgctctggaccgcgctcaccgcccaccacgcccttggttggcccgaggcgggcaggatcgctcccggttggctggccgacctcgtcgccatcgacctccacgacgtctcgctcgctggggtcacgcccgaggcgatcatccagatcacgacgccggcacgggttgtgcgagtctgggttggcggcacggagatcgtgcacgacgccgccgtcgaacgtcgcgaactcgccccccgtctcgaccacctcatccgcaccatctggaaggagatcccatgagcacgcgtcacgacgagagccgaaccatccgtgcgccacgagggagcgagctctcctgccggagctggctcaccgaagccccgtaccgcatgatccagaacaacctcgatcgagaggtcgccgagcatccggaggacctcgtggtctacggcggaatcggccgagctgcccgcgactgggagagcttcgaccagatcctcgacaccctgcggaccctcggtgacgacgagacactcctcgtccaaagcggcaagccggtcgcggtcctgccgacgcatccggatgcacctcgcgtcctcatcgccaactccaacttggtcccgcactgggccacgtgggagcacttcgacgagctcgaccgtcgggggctcatgatgttcggtcagatgacggcggggtcgtggatctacatcggctcgcagggcatcgtccaggggacctacgagaccttcgccgcggtcgcgaagacgcacttcgacgacgacgtggctgggcgctgggtcctcaccgcgggtctcggaggcatgggcggtgcccagcccttggcggcgaccatggcagggttctccatcctcgccgtcgagtgcgacccgagtcgcatcgagctccgcctccagaccggctatctcgagcaccgcgcgctgtcgctcgacgatgccctcgcgatcctcgagcgggcccgtcgagacggacgaccgacctccgtcggcctgctcggcaacgccgccgaggtcctccccgatctcgtcgagcgcggcatcatccccgacgtcgtcaccgaccagacgagcgcccacgaccctctccggggttacctaccactcgactacagcctggaggagtggcgggcggcccgcgaacccgagcgccaggtcgcagacgccaaggcagccatggcccgtcacgtgcgcgccatcatcgccatgcgcgatcgtggtgcggtcgccttcgactacggcaacaacctccgccagggagcgctcgaggcgggcgtcgacgatgcgttctcgtatcccggcttcgttcctgcctacattcggccactgttctgccgtggctacggaccgttccgctgggttgcactctcgggcaaccccgaggacatctaccgcaccgacgaggtcgttgccgagctcgtcgacgatccgcacctgcaccactggctccagatggctcgcgagcgcatccacttccagggcctccctgcccgtatctgctggctcgggctcgcggatcgcgcccgagtcggactcgccttcaacgagctggttcgtcgaggagaggtaggcgccccgatcgtcatcggacgcgaccacctcgacacgggttctgtggcgagcccgtaccgcgagaccgaggcgatggccgatggctcggacgccgtcagcgactggcccttcctgaacgcgatggtcaacgtggcttccggagcgacctgggtctcgatccatcatggcggtggcgtaggcatgggcttctcgcagcacgccggccaggtcatcgtggccgacggcaccgatgctgccgcacgacggctcgcacgggtgctccacaacgatccggcgatcggcgtcgtgcgccacgcggacgcgggctatgcggacgccatcgacgaagcccgacggcgaggactgcagatcccgtggctcgcctaggggagggccccgtcgactggctgctcacgaacgccgtactcgccgacgtcgacggacacggcagccttcggatcgaggaaggctggctgcacgttcgaggcgagcgcatctgcgcgcgaggcaccggtcgacccccagccgacctcccacacgtggatgctggcggggcggtcgtcacgccggcgttcgtcgagtgccacagtcatctgctctttgcggggaaccgtctcggcgactggatgcgacgccagggactcgaacccgacgacccccgcctcggcaccggcggcatcgccgccaccgcgaaggccacgtcggcgctcgacgacgctcagctcgtcgcgacgacgctcgcacgccttgcacccctcgcgcgctccggcgtcggcacggtcgagatcaagaccggctatggcctgagcgcgcccgccgagcttcggctcgcacgcctcgccctcgaggtggccgagcgggcccgccacgacatcggactcgacgtcgtggtgacgttcctgggcctgcatgcactgccgacagcccctgcccacgagcgacgtcacatcgtcgacgacatgatcggtgccctcgacgaacttcccgctggcgtccgcaccgtcgatgctttcgtcgatccggctggggtgagtgccgaggaggcacgacccttcctggaagcagcgcgagcacgcgggttcgacctccgccttcacgtcgaccaattcgccgacgcgaacggtgcggccctcgcggcgtcactgggcgccctgagtgcggaccacctcgacgccacgggccccgagggcatcgcggccctcgcggctgctggcacggtgggcgtgctcacaccgatcgcgaccgtgctctcgggaacgcgactgcgccctccggtgatggccctgcgagacgccggggtcggcctcgcggtctccgccgacgccaatccgggcacctcgccatctgccgacctgcgcctcgcggcgctcctcgcggtcaccgagctcggccttcgacccgacgaagccttcgccggcatcacgctccacgcagcccgcgcgctcggcctcgcggaccgcggcaccctcgaagctggggcgcgcgccgacctcgtcgcctggcccgtttcccaccccttcgaactcgtcctgagccacctgccgctcgaaccatggcgcccgctgcctgactgagcgtgctccagctcggaaccggccccttcccacaacaagcccccacctgcccacgacccctgaatccatggagcgccacgcgcggcgacacgcctggccgctccgacccgcagcacaatgcgctcgcccatctcgagggcccgaaccgcaccatcacgctcgagctccgcgagcccgacgcccgatgggcatcgtgagctctcgagcgacgtcacgagccgttggccggccccacgcgtccggtgacggacgatcccgagtggacggccgatgttggcaaccacgtccgatcgaacgatccgtcaacgcgcaagggcctacgcggatgcgctgggccagatacgtcgcccagcgacctcgacctggaaggcgaccgacaccggcaactcatcgcgcacgagccgcacgaaatcggagtcatcgagccatcccgtggaggcgacctggatgcgaacgaacggagaggaggccggatcgtcctggtgtcggcgtacgccgccggtctcggtgaggatcacgggcccgccggtcaccgcctcgagaatggtcgtcagccctcgccgcgtcccgcgccaggccagcgcctccccgaggctacgaacggcccgccgctgcgtggcttccgggagcgaaccatcgagccaggacacgccgagccacgctcccaaccacgccagcatcggcaccggggtgacggtcgggtcgacgatgtgctcgatcgtgtcggcgtcctcgagcagtgtcgacgcgacctcctgaaagatcgacacgaatcgaacgaagaaatcatcgtccgtcatccccatcgggagttgctgcaggagccatccgtcacgtcgcatggtgagccctagcggacgacgacctggtgacggaacgagaggaacagcgacaacggatcgagcgccaagacctcccgtccgcgtccttgacgctcgccggtgcgcagatcagcctcgaacaggagcacctcctcgaccgcctcgatgccgtcgacggtctcgagtcgttcggccacaccggctgcggtcaaatctgcgtcgaacggccaaccgtcaccggcggggccaccgaccagcggatggacgtattgatagagcacatcgagggcacgctggcgcacgatggcactcgggcgcccggggatggcccgcacgagtgcagcgaccgtggcgccccgatagtacggggtggagacgtcgaccgtggtaccaatcagtcgtcgcggttcgaggtagccgatgacctgctcgacgagcgcgtccgagagttcgaagtcgtcgagctggtgatcctcgcagcgccctcggaccctcggcacgacgagcaagcgcaccggatcaccgacgaggttcggcgccacgcagcggacccgtgcgacctcgggcgaggcttcgagcgtgagccgctcgaaatccgatgcgctcacggcccgctgaccggagcgcaacgtcatcggcccgcgaagcttggcgttcgcgaccgattcgggatcgaccccgcccgaggcagggaatgggttcgtgactcgatcgatgtaggccaccgaactgcgcaagacggtgagcgtctcggcgccgacgttgccgacggaaccgcccccgtagcggtacgacgagagcatgatcgccgcaccgtcgggggggatcgcgccgtgctgacggacggtgccgtcggcgtaacgcacgcgcggaccgaagcgaaccgttccggtcgctccatcgagcacgaagtgtcggtcctcacccgtcgacgatgcaaagtccgcacgcggctcccacgtccagaccacgccgtctggggtcgtcgtcgtgagcacctcgtcgtcacggagagccaacaccggggcgtgactcagctgaaactcctgtccgggtgagccatcgctccgaccaagacgctcgggccctgtggtcgcagcgtgctcggcagccaccgttccgccgaggacgttcacggtcaccgacgacagggatggtgaggctcgatagggaggttggccagggcgtgccgcgagaagacggacgcgcagccacgtcgcgcgaacaccaccgagcgtcaggggcgagagcgcgcgcgggcacacgagcacgatctccccatcgcgattgagcccacccgttgtgtctcgatgcacgggcatcgctacccatgactctccgacgaacgcctcccacgcgagtggcggatcggtcggatcgacaccgatcccctcgatcgaggctcccacgttgaggcgaatgacggcacccggagcgagtccctcgaatccgaagtacgtcgcgtcaccgggtgcaagcgggtccgaggtgaagcatcgcacgaccccgccctcgaagcggaggtcatcccacacgtcgcgaacctggccaccgccgtcggctgtggcggtcatcgcgccaatcagggtcggggggcgaatgacgagatcgtcgatggtggagaagagcacctccggctgccccggtacgggggcggtggcgacctgggtcccctttggcacgacgacgtcgtgctcgagaacggtcgagagccaaaagaccaggtcggcatgggctggcgccggtgggaatgggctgatgccaacgaggtcgaggaacttcgtgtagagccggtctggcacctgattgatgcggtagagcacggtctcgctcatccaggcgaacagctcgatgagcgcaaccccgggatcggagacgttgtggttggtccactcgggacagtagcgcgggatcaaacgcttggcttcgtcgacgatgtcctgaaagcggcgatcgtcgagttcgggagtcggcagccccactacccctcctctcgtgggatggtgtagaacggatagacgagattgcggcgatcattcgtcgcacgaagacggtaggtcacggtgatgtgcaccaggctcgcatcgttgtcgtcctgcgccacggcgacgttctcgacgtcgatccgcggctcccactgtgccagtgcctcacgcaccgcctgagccatcaaccccatcgtgttggcgttcaccggctcgaacaacagatcccagatgcggcacccgaacgccggacgcatgacccgctcacccggcgccgtggagatcacgacccgaatcgcggtatcggtggagccggttccgtcggacagcgcgatgcctccgcggacatcgacccgcatcggaaacgcgaagccacggccgacgaagccggggtcgctgacgctggcgtccgtcggatgctcacgcgtcgccacggcgcaccgtcgatctcatcacgcgagcacctagaggacgtcgggtcggtgacgcaacccgcgcgcatcgagttcgcgcgcgagacgccgctcgacctgctcgaccaaccagtcgaggaactcctcggcctgaggagcgctcgacggtcgaaccggtcccgcctcctcgaccatgcgaccacctcctatctcgatccctgaaccctcgccacctcgccgccgtgtggaccccggggattcggacgcggccatcatcgccggcgcagctcgcgtcgcgactcgggcatccgacgacccttgggacactgatgacgaccctcggggcaacgacgtcgatcgtgcatagagcgcctgaaggtcagcgagcaccgcgtcatgctcccgagaagcgagtacgtcgccaccgggtcccatgggtggcgcgagtaccggggtcaaccccgtgcccgacggctcagggttgtgcgcacgagaaccacgcggtggcggcggcatcgccgcgagcagacgccgctcgtgctccccatcacccgcctcatcgccgaccagtgcacgcaccaagcttcccactcgcctcgcgtgccgctcctcgtcatcgaggtgcggatcgtcgaacagtcggggggcgcgtcccgtgtcacccgaggccacgtgcacaagttcgtgcgcaatgacgccgagtgcacccggcgagcggtccacggggcgctcgagaaagatcgtctgcccgaccgtcgcggcaaccgtcccgagggcgcgcaggctccgacgagtgagcgggccgctctgcacctccaccggtccgcggacgcccagcgcgctggcgaggggttccagcacggccggaagcggctgaacggcctctcccggctcctgcgaacgctcccgagggccctgccaattcgacctgaccggtctcgatcctcggcgcgacccgacatcggccatgaccgcgtcggatgcgctcgcgaagagccgaccgtcggactcgactccgcgccccgcgacctgcgatggtcgaagctcgcggccccgaggtcgtgacggccctgaccagccaaggcccctcgtcgcgaccaccccatcactgagcgcacgtggcatcgagccgagcactgagagtccctgcgcgacccatccactcgatgcaagcgtggccacaccacgttcccaccgacgacgaccgcgcgacgccatggtcggccacgacccgagcgctcggcgaaccccaccgtgccttcggacggcctcgtcgtcgccgacgaccgagccgtccccagtcggagcagctggctcgccgatcggcacatcgaccctcacgcccctcgaagcgtcgacgcgacgcagttggcctctcccgcggaccgcatcgattgcgtgtcgacgagcggcgagtccgccatcggacagcccgatccccgagctccccgcccgtcccgccgacgtgcgaacgtcgctccgtcgaccgccggactcaaccatcgaacgcctcgcgctcggcacgcgagcgcccgtgctcctcgcctgggactcctcgtcgaatccgatcgaacgcagccagggggtgcgccgacggaccgggcgcagcggccgaccgggaggcgcgccgcgctcgcggccccgacgaaactcagaccgaggaaaccgcgacgtgtactgccagagcggccctcgctcgcccgccctctcgctgccgtgccgagccagtgcggcgtaggtctcctggcgtacgagaccgtcgagaatgaccgcagccgcctcccaaccagccgccagcgactcgccgaacgtcatagcgtggctcgccccgtccgaggttgcccctcccgccccaacggcttctcgatccgtgacggtgcgaccagctgtcacggcgtccaggagcccgaccgccgatctcggcggccgatcgcctccttcacgtggtgccccaggagctccccgtccttccaggccaggctcagggggcgatgctccatcgcgatgctgctggcgttgtgccccctgttcggcctggtgtcgctgcggcgacgcccctgccggagtcgtggccgtcggcgtcgaaggatccgagctcgatgcgggctccgcggacgcgccactgcccgccccggcctccccatccctcgcgctcccccgcgatcctcctcgacgagagggtgccacacgcggcgcacggtacgcactgcgcgatggcgaaggcctcgccgccgcgcgcggacgtcctcgctcccgatccgacaccacggtaccgacagctgcgacatcgggcacgagccgaaccggcaagacctcgcgtcggagcctcgccaagcctccccctggtgcgtagggggtctgctgccgagccgtgacgcgaggaaggcggcccgcgtgcgccccaaccgcatccgccagcgccgacgcgtcgtcctggccctgaccagcaagccacagccgcaggaacggatggccgagcggacgaaccgggcgatcaccggtacccgccccaatcggcaacgaagggccaatcgccgaccgcagcgagagaggccgaccgacgatcgttgcgtggcgcaccgaccgcagtgcgagggcgccaaccgacggtcgaggccgacgcacgagcgaacgatgccacccgaaccgtcgctcaatgccggccacgaacgtcgacacggtggcgtcgtggccgctcatgatgcgaacgtcttcgacgtgaagccctggtgagcgacctcgatctcctccatggcaggaatcccatgcgcgtcgaccgccaacttcggaccgacccaccgcacggcgaatgcccccgtgatctcccaggagcgcagccgacgaccgtcggaagcgatcagcgtgatcgcagccgtcgatcgctgcagcttgttctggttcgccgcgaacgccggccccgaggaccgacgaacccaatcgaacagtgcgtccgagcgacaaatccctcgccgcagcacgatattcggccaatggatctggcccgggaacttgtgtgtgaagccgttctgtccgccttcggcgaactcggcgacctcgacggtcatctcgagtcccgacacctcagcgaacatgccgatctcggtgccatcgacctcaagaaggaagctggaggagtcgggaatatgcccatcaaagcctgactgcgtggtcacgagagctgtcgtacctcctcccatgctcgtgcgttcagcgcggcgaccccttggacgagcctcacacggtcctgatgctccagatcgagcagatcgtcaagatcccagtgcaggtggtacgccaggtagatcacctcttgccagaggacgtcgatcggatagtgcttcatcgcccgttctgcggcacctcctcgatcgctgcgcgccgcccaccagcaggtggtcgcggaggcgactccgatcccgcggcagccgtcggaggcgtcgtctcggacgccgtagtctcgggtcgaggactcgtctgcgactcggctcgctcctgcgcggccaagagcgcctcgatgtcctcttcggaaccaaagttgatcacgccgtagaagtcctgcaaatacgcgaggtcgaccgcgaagaggtcttggatctcgttgggtgtcacgagctcgagatccccaagccgctccaccacgcgcgccaagaccagaatggtcaggcgcggatcgtccgggccgctgatcgtgggatcacggagcggctcgagctcgtcgcgagccgtcgcaaggcgcatcacgccacggcgacgaacgaccccttggtcgtcgatgtagcctctcggcagaacaaactcgtagcgcgtccgcacggcctacttcttgcgctcgagcttctcgtactgcaaggtgatggtctcggtggcgacgtcgttcgccgaggcctcgaggctggcgaactcgatcttcgagggccaggcgtcgtagaagttccagcgggccgtctccgagagcgccgaatcgtagacgacgatggagccgtggcggcgaggcttgttgcggttctggacccccatgcccttcgtgcgcaggtcgttgaaccacttccagatgtcgtcgtcggcgacgttcagcggggcgacgcgcttcatggtgagctcgccgttccacttcggcttgctcatgaccttgtgctggacgagctgggcgcccttcgtacgctcgttgaagtcggcgacctcgatctcgacgctcaggccgtcgatgctcgtgacgttggtgacgtaggcaccgtcgatctcgacgaagaagttcgtcgtggtgagcggatcgttcttgatcaggttgaactgggccatggtgctcctttctccttagccagcgagctgcttgtgctggctgatgcggaagacgacgaactcggcgggcttcaccggggcgatgcccacctccacgacgagacgaccctcgtcgatgacggcgggagggttggtctcggcgtcgcacttgacgtagaacgcctcttcgggcgaggcgccaaagagtgccccgtcttgccagaggccgccgaggaaggcggtgagggttcgggtgatgccctcccagagggtgacgtcgttcggctcgaacaccgcgaactgcgtgccgtcgaggatggtggtctccaccatgttgaacagacgccgcacgttgatgtagcgccagtcgctgtcggaggagagggtgcgtgccccccagatgcggatcccgcgcgtgccgaaggggcggatgcagttgatcccgatggggttcaagagtgcctgctcgttcttcgtgatggagcgctcgacgtccaagcacccgcggatggtgtcgttggccggggccttccacacgccacgggtgtcgtcggtccgcgaccacaccccggcgatgtgaccgctcggcgggatgagcacctcgctctggccgttggtgccgacggggttctccactcggatccacgggtagtacatggccgcgaaggccgagtcgtacatggcgacgtcgctgcgccactcgcgcacctgctggggggtcatgccgggcggggcgtcgaggatcgccatgcggttgccctggcgctcgcagtggccgatgagggcggtctggacggccttccacatggcgaggtcgatggtgccgtcgggacgggtcgccgccgtcacgaggtcggggacgatcaccatggtgacgtcgtcggcgatggtgaggccattgatgccggtgcgggcactctcggagcctgcgaagcgcttggggctcacagggacggggtgcggggccggtgccacgaggggataggtcccgggacgcatcacctcgagcagcgacgagaggtcgacggcgtcggcgaggtccacgcgcacgcgcacggtgtgggaggcggcgttgacgaccgtggcgacgttgcgctcggagtcgtcgagggtgaggttggtgaacgactcgatggtcgtgccgtcagggccgacgatgtcgaggtcgaagggagccgggccgtcggcgtcggcgtccaccgtgcgcacgactacctggagcggagcgccttgttccaggctctcgacgtgcaccggggagccgagggcacgatcggccgcagggagggaggccgtcgagggggcgtcagcgggctcggtgttcgggatccgaacgatgtaggcgatcgtgccaccgttctggaagaagccgtagacgctgagcggcagcatggccccgggggtgaagctgccgtagagctcctcgaactgcgtccagctcgtgacgagacgagggcgggtgccctcgggatcgctcgggtcgtcgttcggggcacgctcggtgaagcccacgaaggccgcgatcgcggtcggggcaggcgtcaggctcttctgcgcagagggcatttcctccacgtagaccccaggagcggcgtacgtcggcacgatggttcccctttccctcgccctcgagctgtcctcgaggaggttcactcactccagacactcactcacagcactcgcgaacgacacggcacgcatgcccgggggccaccaccgcaggccatctgcgagctcgcgtcagagcgacctggtgacgtccggcccgcaccatccgacgtcaacgaaacgcttcgacgccatcggtccgacagggcgttgccacaagaccactcagcgtggccgataccctccacacacacgtacttgccacgtgacgttatcagagtgtgcgggggtggtcaacagggggttgtgaactgctccagcatgagtctgtcatacaccaagtacgtgtgtgttagtgatacagtggcgccgtgaacctcaccgagtgggcacgccgccagggtatccaccctcagaccgcctacaaccggttccatgcaggcacacttccggtgcctgcggtgagagtgaagcagcggaccatcctggcccagccagacgctgccaccactaccccgagggacatggtaggtctctctgcccgcgtctcttcgtatgaccagcgaggtgatctcgaccgtcaggtcgcacggctgaccgagtgggcagcgaaggtcggcctgccgagagcccgggtggaagcagaggtcggctcggggatgaacgggtctcgacccaagcttcgacgcctcctcgctgatccgcaggtcaccatcatcgtcgtggagcacctgaccgcctggctcgcatgaatgtagaactcgtcgaagcagcacgctcggcccatggccgcaggctcgtcgtgatcgacgacggcgaggtggacgacgacctggtgcgggacatgaccgaggtgctcacgagcttctgccccagactctacggacgcaggtccgctcgtagccgagcagagaaggccctgcgatgtgctacccaggacatggggccaaagccccctccaagaaggcaatgccatcgcgggcgtctcacctgaaggagcagagcaagccgtgagcaagcggcttcgcgcgatctctccgccgttcgtggtagcgccacccacaggtgttcgtgtgcgcaccaggcttcaggtgactgacgtcgatgcagcggtcctcatggcccttggtacctacctcggctcccttgcatcgaatgacctggctgagcgctgccgccaaggagagctcgatgccaagggcaagactgagtctcgtcgtgagcgcaaacgagcgctgacggccctcacgtcctctcggtgggcgggaacgatcaccagaacgagcgaggatgccttccaactcgccatgggcaacctcgaagccgaacaacggagcctccgggctcggatcgcccagattcgccgtcgtctcgcggtgcctgcgggaacacgacgtggacgttcttacgggtatcccactcaggccgagcggttccagaagcaacgccgtctccagatcctcgaacaccgcctcgaggtggtcgaggcccgcctggagagcgggcgggtgtccatctgtcgtggtgggaagcacctggccaacgtccatcaccacctggacgaagccggactgactgacgatgcctggcgagagcgctggcgagctgagcgctggtttctcaccgcggacggggagaaggacaagtaccttggcaacctcacgatccggtggcacccagatgagcagtggctcgacatcgcccttcctagggcgcttgcccacctcgccaaccggtcccgaaaccgctaccgactctcatgcccgatcagcttcccctacagaggggatgaggtcgcagctcaggccgtgaatggggccgtgcgctacgacattgtgttcctgccgcagaaggggcgatggtatctcgacgcatcctggagataccccgaccgtcagccactcaccatcgagcaggtccgagagcatcgggtcatggccgtcgatctgaacgccggacaccttgcaaccgtcctcctcgacccgtcgggcaaccctgtcgggcgaccggccaccatccccattgtcctcgacgggctgccagccaccacccgagacggccacctgcgtcaagcgatctctgacgtactcaccatggcgaagaccggcggtgctcgggccatcgtgatcgagaacctggacttcgccgagtccagggacataggtcgagaactgcatggcaaccgaccatcgcgtggcaagcggggcagacgctttcgccgcctcatcgcaggcatccctacggcgaagttccgtaacctgctcatccagatggccgcgaacaccggaatcacggttgtcgccgtcgatccggcctacaccagtaggtggggcgccgaacactggctcggcgccctccaggaaaccttcatcgatatctcgggccaccatgcggcggccctggtcatcggaagacgtggacttggacagcgagcacgacgaaagacgaggtgtgacttgacccgagcagagcatcgggaagagagagctacccgcccggtcgtgggggccacgggtgacgggggaccatcactcctgtccaggcagcgcatgaggggacttgggacccgagaggccagagggcagccacagacgtggcagaagacccgaagggccgaccggaccaccccggttacccaggtggcccaagaccgttcggggccacccacgaagcgggacagagtttcgctgagtgtctaggaacggtgaggagatgttcacgatgaacagcccgcactggcatcatcacagcaccacggtggggagcacactcgacggctttctcgtgactccacccccgcctgaaggcgggggcttcgggtgcgctgttcacgcacctgcggttcctaccatggcaggaaccttcgcggaaacgccgaccgccttgcgacgatcgcgaacactcgaaccttgctagagtcagtggtcactggccaccttggccgatgctgcggcgcgcggccgcagaagggggttggcgatgccttcctggtttccatggcttcggcgtcggcggcccgccgcaccgcaagtatccgcacagacatcccgtcctcagtggcagcgtgtgggcacaccctcaaccgatgggcgtgcctcgcgaccgtcaccacaacaggtgctcgccctccaacggcagctcggcaatcgcacgacgagcatgcttgtcgacaactccggatcggcgccgggtgggaactacaacaacaccgagaaccagcctctctacgaggacctacgccatgtggtcggcgaggggcaacagcacgaggcgccgggtgggaactacaacaacaccgagaaccagcctctctacgaggacctacgccatgtggtcggcgaggggcaacagcacgaggcgccgggtgggaactacaacaacacccaatcgtcaccttcgcagtcccgcgcaccaagctacggcaatgacatcaacgagttgctcgcaacagtatcaagcaggccgccgtcggtggaggcccaagagaaggcaacctccctatgggcccttgacgcacacctgcgtgccaagcacggcctcgcaccagctttcccctcgacgaagcagctcgccatgcgcgagttcaccacgacgaagtacctcacgccgctcgagtcgcagtcgaagaccctcgcgtttcgcggtggcctgctcatgcgccgtgtcgccccgggccccgaccagccaccgggtaagtggcaactcgagccctatgacaccacggacatccagaacacgatgcatggcaacgagtctgagcgaggccaagccctctacgtcctctcccaaggtggcacgctgctctcggcaccgggcaaggtacaggagacgcatcactccacgctcctcgcaggcactgaggtggcaggggctggcatgatgcgagtcgagaacggcaagatccgctcgatctccaacgcgagcgggcactaccgtcccacggccgactacttgcgcaacgttttcaaggtattcgagcgcaaccacgtcaatctcgacgagatcgaagtcgaggaagccctcaactccacctgcaatcgatctcacctgaacggtcatcgccgcaactgggcatcggcgacggaatggctcgccttccacgacgaaccggccgaggacacgcaaggtccaccgccacagtcgatcggttaccagtcgtccgcaccgccctcagacgagtagacccggctacagctcggggctgtcgccgtccacggtgcgcgagccgaagttacgcggccagagacgctcgcgttcgtcccgatgacggtgagcgctccgctgccagagctcgatccagctccgtccttctggaacgaacgtacccttcgtccggcgcgcttcccagaaatccgttgcagcctcgcgaccggcaagcgcgagagcatcggcgatccgagcggtgaacgcaccgggacgctctccctcgcgcgccgtgagtggttctccaacgacgatggtcgtcgagcccggtcgcaggcggcgttgtcccttgccgaggatctcccacgtgccatcgatgaacaacggcacgaccggtcgtcctgttcgcagcgccacttgtgctgctccagccttcggctcctgtggcaggccatcgggagttctcccgccctcggggaacagaaggagattccagccctcctcgacgagctgctcggcgagttcggctgagcgccgagagactcgctgccgctcgatggggatcgcaccgagcaccagggcggaggcgaacgccttcgagggacgatcgaagaagtagtccgctcccgcacccacgacggtccgatgccgcaccctcgccggcagaaccgacagcacgaccggggtgtcgaggtgactctggtggttcgccacgaacacgaccggctcatccaaggcgtcgagaacctcgcccgcaatgagacgaggacgcgcgatggctcgcaccccaggtaacaccaccccatcgagcaagacggcgcgagcgacccgcaccgagtcccgccgggcaaaggacgtgtcgaactccacgcccgtccgcgcagttcgatcaaacggaagctgcccaggcgggctcggagctcgtacgacgaagcggacggaagcgggcagcttcaccgctgtccctccgatacgtcggccatgaccagcggcggactgtgcaggtgggtgatcgatgggttggggccgacgatcgaccgcgccatctccagagcatcgtcgagggtgctcgccgcctggaaaccgaggcgacgagctgtcttcggatcaccgccgagaatgatcacgccgccaaggtggtcgagggcatgtgcgccccaataccacatgtagaacgggtgcacgccgtggtaggcgttctgcgtccgatacaaatggatgtaccaggggtcccgcgcaaagctctcctcgtactttgcctcgatcacgaggggatccgtcgtctcggagagcacctggtcatagaagtcgatgtagctcgggtggaacgctggatcgaactcgggcctcgtcggatgcgccatgatcaagactccgccacgacgaaccaagggacggcctcgatacatgttgaagagatagccaagtcctaggcagtagacgaggatggggttcatgatcgagttcacgttgtagggcccgacgaagggaaggcccatggtcaagatgtcagcctgcccctcgacgggcacgagctgctggcgatagacccgctcgatggtctgctcgtgcaccgcctcgacctcaccggcggcgacgcccgtcaaaccgtagggcgatcgaacgcgatggaagatctcccgcgcgagatgcggcggagtgcgtcgcaaggactcggcgacggcgacgtagctcgctcgatcgcgaaggtcccactcccactcccgtcgattgaggaaccgaaacgacgatggaaaggtgttggtgttcagcgtggtctcgatctggaaaatacgtatgccgctacgggcgatgagacggcccatgcgccagttggaggagtgcagctgggagttgtgtcggtccatgaacgaccgcgagtgcaccatcgtcgtgacgttgtgatgatggcggatggagtcgtagctcgcaagcccagttgcaacactcttgtggcccccatccatggagacgaggttgatattgacgtacacgagcaagtcgctctcgaccgcacggcgattgagctcgaccagctctccctcgtcggtatggccgacgacgaccatgttggccttgtcttcggcatcgtgctgggtgatcatcccacgcggtgcaagcgcatcgtagacccgacgaccgagggcatgtcgaagttccgactccgtcatacgccgatgcaaggccagagccgcgacgagctggatatcctcgacccccttggcggcggcgagctcgagaacctcctcaatgacgaggctgcggacatcgggggcagccatctgcggcagcgggagcgacacgtcgtcgaaggcgatcgtcagtcgcatccccggaaagagcagcgcttcgagcggctcggcatcgatcgggtgcgccagcgcatcgcgaatcgccgcacgagcgtctcgaactgccggcagcggatccggaggatacaccacccgtgatcccgcagggagccgctccagccggaaaccctccccataccagaacagggtcgggggcgtcgctcggtctacttcgagtacgaagccaggtcgatatgccacttagcgtgccttcctttggtgaagatcgaagacgaccttgattgcatcggcgcgacccccttcccgagccttcgcgatggccgtgacgtagtcgcgcaggccatagcgatgggtcacgagtcgtccgaggccaaggtccgcggcgagacccatcgccagatcgaacgtgcgtaccggaccggcgactcgtcccaaggactgggcgatgtcgggttcgagcacctcggtgccgtaggcgtatgcgccgatcagtcgcacctcccggtgccacaagggtgcgagatcgagacgttggggcgacggcatgcccgccacgatcacctcgccacccggtcggaccgactcgatcgcgagctggatcgaactggcagagcccaccgcatcgatgacggcatcgaaaccgtcgccgaggaagcgccctgctcgcagtgttcctcgcagacgacgtgcccgctctggtagctcgcgctcagtcacgacacgatccgcaccgaacgcgctcgcgagctcacgttggagcgggtagcgtgcgacgctcgtcacgctggcaaagctctgcagccgagcggcgacggccgtcgcgacaaggcccacggtgccagcaccgatcaccgccacatgcccgtcacgccgaccgacgctcaagacggtatggagaccacacgccagtggctcgaccatcacggcgtccgcatcgtcgacctcgtcaggaaccgcgtgcaacgtggcctcgtgcgccacgaactcgctcgcccaaccacccccggtcgaggcacagtagccggtctggatgcccggctcgagatcgccgaccgcgatcgacgcacagcgctgcgtttcacctcgttggcacgcgtcacacagcggcacgccccgcacggcacacgtcaacgccggctcgacgacccaccgacccgatcgaccctccgcgtcaacgacgacttcgtgccccgggatgaagggcagcgagacgagaggctcgaagtagcgcgacgtctcgaagaacaccgatgcgaggtctgacccacagatcccggcaagccggggccgtacgcgcacccagttgggcccaggaagctccggcgggtcgacgtcaaccaacgcgagtgggccgctctcgatcgcccgtcgcgtcgaggatccagcgagcagacgagccgccgcgaaccgcgctggccgacgttcgacctgcaacgccctcatcgacgacctccgatgggcagcatgagcgacgggaacccagaggcacgttcccactcctcgatgagccaaccccgccgcttggcaagcgcgcgcagcttcgcatccggattcaccgcgaccgccgtacccgctgcttcgagcatgggcagatcactggtggagtctgcgtaggcgatcgtgtcagcgagcgggatctcgtagcgggccgcgagctgacgcacgaggtcggctcgtgcctccccaatgggcagcgtcccgggcaccgtaccacttaagcggccgttcctctcaggcatgtccagggcgatgagctcgtcgaacagcgggcggaacggctccatcgcaaagcgcagcgcaccggtgacgccgaccgtcacatgaccggcggcacgatgttgccgcactctggcgaggccctccgggaacgtcttgcgcaggaggtagcccgtcatgagatccggagccagcttggcaagctcggcaggatccgcatcgcggtaacgacgatagaagtaccggaggaagtcggagcggtcgcggccgtcgagccgcaacagcttcggcgcctcggcgagcaggctcgcgacgagcccgaaccgatccacggggcgcagcgcactggtcgcgacgaaggcgaacgagtccaccacgttcgctgcgaccaaggtgttctcgagatcgaacacggccaggcgtcgcccgcgcagcagaccctcgcgtaggcggtcgtctcgggagcgtcgcggaccgcgccggggattcgtgcgcgcgcgagcgtgctcgaccacgctcggcaggtggacgtcgaggatgaagtgccgccaatcgatggccgccggatcgacgagcacgccgtcgtcagcgctcgcgagggagacgagttctacgagccgttcggacccgtacatcgcctcgcactcggcgtaggcaccgtagagctcgacgtaggaacgagcccgctcgagggcgtcctgcgtctcgacgagaccatcttgggccgagagcatgggaccgcgaagcggcagccgccccaggaggccgagcaccgccccgacggcccgcctggtgcgctcgagacggcgttcgacctcccctctggctgggtaggtccacgaaggtatcgcgatggcttggcccttgtcgtcgtagagcgggtgttcggcgaagtactgccggatgagcgagaccatcacctcgtaacgaagcgggttcctcgtgcccgaggccgcgtggtagtacgccatcgcccgggggggatgagcagcggcgacgagaaccgcgccgacgacgaagtccacggggatcacgtcgaccaccgtctcggccgacccagggaaatcgcgcagcagcccccgcgcgaacgagatgatgatgggctccgccatgcggaaccctcgaatccaacccggtcgcggctcggcgtagctcgactcgatgatcgaggggcgcacgaccgacaccggggtgcgctgacggcgctcctccaggacgcgttccccgagcgccttcgtcatggcgtaggcgtccggccatcccaggctctgcgctcgcgcccgacccagttcgaccatacgctcatggacccagtcgcgtcgaaagcgctcggtgcgttcggccacgatcgcgacccccgcagccccgagctccgccagcgccttgcgacggaacgtttcgagccgctccggctcgcgagaacgatgctccgtctctcgacgcagagccctggcagcctcgacctccgcacgccaatccacgtccggatagtgcggctgcgtgcggagcgacgcctcgggtgcgtcacccttgcgcgagccggcgacgtaggcggtcgagatggcgacgaagtggcctggcgcgagatcggcctcggcacgtgcctgctcgtacgcctcgagcactctcgccggcccgagcaggttgatctcgacggcagcatcgagtgtcgcgtcgaagctcaccgtcgccgcggagtggatcacgatgtcggctgcgccaagcaccgaccgtcccgcagggtcgagaccgagaccatcacggccaacgtcaccctcgacgagcacgacccgacgagcagccatgtccgcaaacgcatcccgaccgagctcggctcggagtcgatcgaagcagctgttgccaagcagctctcgacggaggcgctcctcggcgctcgtcgtacgaccgcgtcgaatcaagaccgcaacacgagtctccgggagcaaccgaagaacggactcgacgatggccgtcccgaggaagcccgtcgcgcccgtaaggaagatcaaccgacccgccaaggactcgcgcaacaccccgacctagcctcctcaagcccccaccgtggggctcatcaagcctaccttcgggcactcacgacgaggacgtgccccgacgacgcaccgtcgccctgcgcttgggcggggtgtagcgcttcgatgcggttgtcggccgatgcggcaacaaggtcccttctgtggcggcaccatcgccagtcttgcccttgccgctgcgtcgtgcttcacgagcagctcgacgagcagcgacgacctcgggattggccttgaagccgacgaagacgccccacgcgaggatcgggaatgcggcgatgacgaggttgccccaaccggcgccgatcgcgacgagcatcgcaaacccacccgcgatccgtcgccggtctcgctgaatcatgatggccgtgatcgccatcaagaccagcccctcggcaagaatgaactcagggttagcgaggatcccgtggcccgtgagcttcacgtggccatcgaggactgggatccacagcaccgtgtacaccacggcctcgatcagcacgagtgcgtagccgatctgtcgttctcgacgagagagtggcatggcacggcgaagggctgcggtcacgggaccagtgtagtgcttgctactgcccacacttggtccccgcgaccgcgggctaccgatccgtcaccgaagtgtggcccttccgtcgagcgcgagcaaccgcaccgtcacccagggctctcacgctggaagcgtccctggaagacgacaacgggaggtcactgtggacacgcatcaaccgccaagtccgtatgaaccggtcgacgaggctcgactgaaccgcttccactggcggtcgctcttcaccactgggatgggcgtgctcaccgacggctacgacctgtcctcggtcgggatcgtcttgccacttgcgctggcaagcttccatcagcactcactgaccggtgtcgagagctcgctgctcgccgggtcagcactcgtcggatctgccgttggcgcgctcgccttcggcttcgccgcgaaccggggccgcaagcgcttctatggtctcgacgtcacgatcatggccctcgcagcgctcgctcaggccttcgcaccctcgatcacctggctcatcgcgatccggttcatcctcggcatcggcgtcggagccgactacgtcctcagtccgatgatcctcggtgagcacgccaatcgccgagatcgcggcaagatcatggcgctgggcttcggccttacctggaccgtcggcgcggtgatcgcaagcatgctctacctcatcctcgagggagcgggcgtcgcgcctgatctcgtctggcggatcgtgctcgcggccggcgcactaccggcggcatccgtgatctacctgcgacgacgccttcccgaaacgccgcgctttctcctggccatccgccgcgaccccaccgcctatgcagccgtcgcacgcgaagccagcggcgatcgcgtcgcaccgcccacgcgcctcggcctgaacgaggacctcaagtcattcttcgcacgtcgttggcccgccgtcctcgcagcctgctcactctggttcttgttcgacatcgtcgcctacagcggcatcctcttcgggccctcgttgatcgcgaaggggatcggcctgacgcccggaacgttcaacttggccatggagctcgtcgcgacgatccccggcgccatcgtcgggctcagcctcgtcgatcgggtcggtcgtcgctggatgcaggcgctcggcttcgccggcatggcagccttcctcgtcatgttcgccgcagcgcacgctgcgatcgccgcagcaccgcttgtcggcgcattggtgtacggaggcgtcaacttctcccagcaagcaggtccaggatcgatctcggcttcggggcttctcggcgtcgaactctcctcgacacgagcacgcggactcgtccaagcgctcaccgtcgcctcgggtcgtctcggtgcctcgctgacgtcattcgtctttccagcactcttcgcgacctggggagaagatgccgcactcgtgttcctcgcgggggtcgcgatcctagcgctcgccatcacgctgctcgcggtccccgagacagcgcgacgcaccctcgaggagaacgcaggcgaactccttcccgccggcgcagcggactgatcagacccgccgaggcacgcaccgacacgctcagctaccgctcggcccgcccgagcggtagctcgtgtcgcggggcctcgatcgggacagcccgcgaagcgcgctcgaccgcgccccacgcgcgtgcacagcgtcacgatcgtcacccacgtgtgctcgtgtgtcgtaaggcttcggcttgcgccacgccgcggcccctccccgaccactcccacctcttcgagcaggcagaaccgggttggacccgcccgctaccgcgacaggcgtcccacgtcagggctcaagcgccaacgggccacccgatccgaccgagcgtggagcgaaggacccgtcgtggcgatcgaagcgcggttccaccgggtgtcgtcgcaccggtgacggcgaccgcccaccacgatcactcggcggctccgggcaagtcgagctcacgaagccgcaaacgggtccctggtcgggtccctgttcggctccaactccaacgtccgagccagctccatcgcggtctcatccccgcagagcgacgcaacgagcgcaaccgtcatgtcgagaccagccgcaatgccagatgacgtccagcgatcacgatcctccacccatcgagcctgggcctcccagcggacctgcggcgcttgctccatcacccacgccaacgctcgcttgttcgaggtagcccggtaaccatcgagcaaacccgccgcaccgaggagtgcagagcccgtgcagaccgagctgaccaacgttgccgccgacgcccacgtacgcagccatgcgaggaagtcatgatcgtcgaccagctcgcgagttcctctcccgcccggcacgagcacgatatcggcgactggagcatcagcgtaggtggtatcgacacagagtcgtggtccttgcgtgctccgtaccggtgcggtcgtcggaccgacgaccgcgatcgcgaactggtccgcgagcgcgccgaggagctccatcggtccacacgcatcgaggagctcgaaaccatcgaacaccaccacggccacctgctgcgacatgggatccccctcgactcgacacactgacgttaggccacggccgcctcctcgcggaccgaagagagctcgtcgccgacgcaagcctggcacccgagggccgacgacaggcagatcgtgtcggttcactcgacccagcgtgcgatggcgtggccgcctcggcgaggtccatgacgcggtggcgggcgacgagctcgcacgatgagctcgcgaggaaggtcccggcgacggcgttgtcgcaacaggccacgaccgtgcccacccatgccaacaccccgtctgccaccagagcgtccacacgttcgcgacgagccgtgcaaccttagtcccgaggaagatcgcacccgtgaggccaccgcgagtccgccgcgcagctccgatcacctcgatcgccagctcacatcgagcatgcgctgctcgagcaaccagcccttcgtccgcctcgagtcggctcaggtgcgattgcgaggcggctcgatccctcgccgcgtcggacgtcggtgaggccggtcgattccgagtcggcgcagatcacgctgacgggcatcacgtgctcgctatcctcgccccttgggcgatcgctggccgtcgcaggcctggcgtcagatgtcgatggatcgtgctgggcatcgtcgcggagagccgatcggccccgtcgtgcaaggcccagcgcccagagcccactgtcgcgctctcacgccgagtcgggcatcgctcgcttcgcacgctcccgctccgtgtcgagctgcttgcgctggcggcagaggcagatctcctcctcgcggtcggcgggctcgagcccaccgtccggccgtgcgtgatgtgctctgcggacccagctccaagagtctgccctcgcgccgagcccaccggaggcatcggcactgcgcggggttggtcgaggaccagtgccgcgacaagcgcgacggaactggtaggagcagcggcccgccgacgtcgagcggaaccgctgcccaggagtggttcgtcgtctgtgactccttcgttccgggcccagtacgtatcaacccggcagaggaacggcggcgaggcgagtgctctgtgactcgaggctcgcgaccgcgctgcctcgtgcatcaggcacactccccgtcgctcacgccagtggcgccgaggcccggtgaccactgcccacgcggacggccccgagcgcgagccccacgatcgcgccgacgatcgccacgccgatcgcgacgatcatggccacatgcagaccgctcatgaacgcagcgtgcgacccgttggtgacggcggtctgaacaagggccggtacttgtggaatccgcggtgcgagtccttccgcaatcaaggggcgcgctggtccgagtcgcgttgcgacgacgccaggcacacccgctgcctcgagcttggagatcagtacactgcccacccgattcgagagcaccgaaccgagcaccgccgttccaaggagcccaccgatctgcacggcggtcgactgcacacctccggccacgcccgcttcggcctcaggcacgttcgcgacgatggtatccgaggtcgtcggcatgacgaggccaatacccaatccgacgatgacgaacggaagtgcaaggtggacgagataggaggagctgaccccgagcgtcgtgagcagtgcgagcccaacggcgatggcagccataccgatcccgaccggcacgcgcggcccgaaccgaccgttcagcgcagcaccgagcggcgccccgaccacaaaggaagcggtcaagggcaaaactcgcacgccggccgctacggggctgtagccgtgtacctcttggagatagagggcgacgaagaacaccaccccgaagaaggcgaagaacgacaagatgaccaccacagcggacagcgagacctgtcggcgtccgaacatgccaagtggcaccaatgggaagcgagctcgcccttcaacgaacacgaagatcaccgcgccaacgattgccaacccgaagaagatccaggtgcgacccgcgagccatccccagctctgggccttgatcagcccgaagacgagggagaacaacgtaccggcaagcacgatggtccccggagcgtcgagtcggtcgggttcttgttcacgtgattcggcgaggacgaacaggccgaggaggatgccaatggctccgacgggcacattgaggtagaacaccgactgccacgagacgttctgcaccaacagcccagccacgatcggtccgccagcgatcgccaagccactggaagcgccccagataccgatggccgtgttcagccgctcgaccgggaaactcgcacgcaagatcgcaagcgtgctcggcatgatcagcgcaccgaaaccgccttggatggcgcggaaggcgatgacccacccaatggaccccgcgagccccacacctgctgacgcggcggcgaagcccagcatgcccaccaagaaggtggcccgtcgaccgatccgatcggcgagcttgccagccgggatcagcagcaccgcagtggtgagcaggtacgcgttcgtaacccactgcagatcagcgaggttggcgtgcaggtctctcgcgatgaagggattcgcgatcgccacgacggtcgcgtcgagaccgaccatgatcaccccgaaggccacgctggccagggcccaccaggggttcgcgcgaatcgtgcgcttctcttgtgtctccatgagcttgcctcctcaccggccgtcgacctgcgccattctggcagccgctgccagtctagcaattctgacagtcactgacacttccaacccgatgctcccgcgatgcattccgccgcgcgtacactgatgattccggaggagccatgacccgcgagcagacgaaggcgcgcacggaggcagagcttgctcgggcagccgccgaactcttcgcacgccagggcgttgcccagacaaccgtggagcagatcgccgagcgagcaggcgtgtcggagcgaacgttctttcgctacttcccgaccaaggaagatgcagtcctctcgtacatctggttgaaggcagacgacctgcgcagtgccttcctcgctcgacctgcgtccgagtcactcgccgaagcgttcctggcgtccgttcgagccaccaagacggacgacgaggcccaagcgaccctcgaccgcgagctccttcgcctccttcgcaacaccccgaccctacgggcgcgctggctcgtcgccggatgggaaaccgcggcagccttcacgccgctcgtcgccgagcgactcgcctgcgagcccgacgcgctcatagctcggctcgcgacgaatgcgctactcgttgccatccagacagcgctggacgtggtcggagagcatggcgcagattttctcgaggtgctcacggacgccatcggccggctcgccgatggagcgggactcgctacgagaccgctcgagcgcccatcagactcgcaacgatctggctgaagtggcgagctgcgatcgccgcaccgctctcgacgaggaacgccacctcgggatcgcgcaggcggtagcgccgctgacgaccatcgcgctccgtcgagagcaacccggcgtcgaccagacacgacaggtgcaccgacgttcgcccctgcgacagtccagtgatctgtcgacactccagcgaggtcaactcgccccgttccaacagggttcgcaccagccgcacccgcgtcggatctgcgagcgccgcaaacaaacgtgccagcacggcgtcgacgtcggcatccggacgctcgtccagtgcgacgccacctgtgagcgctatctccctcatgacacacccatccccaccagtcgatcgagcatctctgcgaggacctccggctccgtcgccacgttcacacgcatccagtccgaacgtccctggagatcgaaggtctcacccgctgagacgacgacgccagcgcgacgggcccacgcagccgcactctctgccccaagaccgagcacctgcacccagagcaggtaggtgccggcgggaacggacgtgcgcatccgaccggtgcgaacgagtgcctccgcagctgtctcgaggttgtcctggatgcggtcaagggtggactccaaccactcgccgccctgctcccatgcgacggcggcagcgagcagccccagcgacgtcggcgaactgcgaaagtgtgcatcgacctcaccgagcatctgcgcaacgcgtgtcgagccggcctccacgtgagccgccttgaggcctgcgatgttgaacgtcttcgttgccgcggacagaccgactgaccgctcggttgcggcatgatccagcgagagccagggcacgtggcgcacgcccgtgcgcacgatatcctgatggatctcgtcggcgatcacgaccacgtgatgtcgctcgacgacgtcggcgatggcggtgagttcctcgcgtgtcgccacccgtcccgtcggattgtgcgggttgcagaggatcagtgccttcgcccccgacgcgatcaaggtccgctcgaggcgctctgggtcgagtcgatagtcatcctcttcgcgaagcggaaccgtcacgacgcgacgcccgagcgacaccggcgtcgagaggaatgggggggtacgacggcgtcggcaccaccacgccactcccgggctccgtgagtgtccagagtgccaaggcgaggccgcccaggacgtcgccgaccaggagcacgtcccgtggctcgtagccggtgcgcgccttggaccagcgtgccagtgccgatcgataccgctcgtcgagggctcccgaggcgtagccgacgtcgccacgcgtcaccgcatccgccaccgttcgccgcacgacctccggagggagcaagtccatgtccgcgacccacgccggtaggagcggcgagggtgccagctcccacttcacgctcaggggacgacgggcacggagcgcgtcgatgactcgccctcgcgccgccccggtatcgatcggacgaccattcgagccgtcctgagggagatcgaactgctggtgagccacagcatcatgctacgcatcgacgatccgcccgcgagagtggcaggtcccccaaagggatgatgcgaatgtgctatccggatgcgcgggactgcagcgcagctcgaatccgcgcatcggcgagctcgcgccatgccgtcgagggttcgacccgcggcacatgcgcgcgctcgagcagccaagcggcgaggtatggattgcgtgcaaggaccgggccatgcaggtaggtgccgaccacgctgcctgcgacgaccccgtccacgcccccaacgccgttcccgacaccgacgagcacccgaccgagcgggacggcatcaccttcgagcgtggtgacgccgcggtggttctcgaagcctgtcagataggccccgaccgagatcacgggactcgtcagaacctcgccgaccgcacggcgctcgccgctcgccgaccgaaccggcaagagcccgagtccttcgtgctccgctccctccgcggcaaacgagcgtcctaggagctgcaggcctgcgcacaccgcgagaaccgggcgcccctcctcgacgacggcacgcagcgtgccatcgcgcgcaagcagccgagcggccagcacctgcgggccgtcctcaccgccgcccaagaggtagaaggcgccatcatgtggcaagggacgatccgatgacgcatcgacgacctcagcctcgtgaccagctcggcgaacagcagcggccaacaccaacgcgttgccacggtctccataggtcccgagcaggtcggggtagacgacgacgatgcgcaccatcatggcacggccctcgccgaagcactcgcagccaaggtggtatcgcggagcgcaccgagcgcacgcagcgacgcattggcctcccaaaacgctgtgtagttgccgacgaaggcgatgggcttggaagcgtcggcacggcgaagcgcctcacggagcgaggaggcctgccaaggctcgtgcccggccacctccagacgcaaggcgagatcttcgacccgtcgcccacacacgatgacgcgtcggggcgcgattcgctcccagggcgcatcccaaatccacgaggtgtcacgaccatcggcgatctcggcattgagttgcgcaatcacgtcaccgtcccaatctgcgagcagctcgacgagagcatcgaaccccgctggattcttcgcgagcatcgtcatcacacgaggcgtaccgggcagctcgaggacccgccagtactcgaagcgtccctcgacctcgagccgtcgacggccaaggccgcgcagcacgtcggcgaccggccgacgttcgagcgccccgatcgcaaccgccgcagccagcgcattgaaacgattgaacgtcccaggtggcgcctcggccaggctgagcatcccctcgggaccatgggcgttcccgtcgtctccgatccaccaatccggatccggcgacgcgaggccgcacccctcgcaccaccatcggccgtcctggaacgacacgtggccaccacagcggggacacgcgtgggcgtcgtcggtccaggtcgacgtcgggcgaatccaaatctgacgtcgaaatcgcgacgcgccgagcaccacgatggggtccagtgcgttcgccacgacgagctcgatcgaactcgccgcttcggcgatgcgctcggacagccggcggacctcgagggctcgatcgagttggtcgcgagtgaggttgagccagacgagaagcgagggccgaagcgcctccgccacgctcggcacgaacgcctcgtcgacctcgaagaccccgaccgtcgcctctcgtcgagctcgagccagtgccccagcgatgccgaaactcatgttcgcaccacggttggtgaccaccgcgcccgcggccatggctaccgcaagcgcggtcgtcgtcgacttcccattcgtgcccgtcacgaggatcgagcggagttgtcgccccgcacgttcgaggatgtgcgggtcaatcgccaacgccagtcgaccactcaacgcgccaccagcgccgactcccaacatccgagacaacgccgacgcggcctgcgcggcgcccctcgccgcacgctgacgagcactctccacgggcgtgaggctatcgaccgggtgggcgcccttgcgctcatgcccgacgcgcggccgactccttcggacacgcggcagaacgtagaaggagccggctggggggtagccggctccttaagtgtgcaacggtgttgtgttggggggaaccatgccgttgctgtatgccagactaccccaccagtccgcgaaaatccaactatggtgatgatatcgtgtatcactttttccgatagcctcggtggctcgccatggagttgcgccaacttcgatcactcatcgccgtccaagaggcaggcagtttctccgcggcagcggaggcgctcgccacggttcagtccaacgtctccgcccacatctcgaagctcgagcgtgagctccaggtcgtgctggtcgaccgcagaacgggccagctcaccaccgagggcgagatcgtagccaagcgggctcgccatctcctcggagagatcgccgagatctacgaggatctctcgctccatggctccgacgccacgggcaaggttcgcctcggcatgatcgcgacggtggcgagttggctcctaccgccgctcctcgaccggctcgccaaggaacatccgcgagtcgagctcgaagtcgccgagggcaccgcggcctcgctgcagcggcggctccagagtggcagtatcgaccttgcggtactgacgacgccgattcgctacgaggaactggtctttcgcgttctgctcgaagagcgctacgtcctggtcgcaccgcgctcccatcccctggccagcgaatcgacgctcaccatcgcccaagccgcttccgtgccgatgctggtcccgcccgtccacgtcgggttccgcgacgaactcgaggcgatcgcggcgagccggggcgtgcgcctgcgcgtcattgcggagatcgacggtctcaacgtcatcgccgccatcgcacttcgcggctttgcacctgcgatcctccccgcgagcgccgtcgaggtgctcgcccatcacgccgacacggtcgccgtccaactcaccgacgtccctcctcgccagatcggactcgcacgccaccgcaaccacctccagagcgcagcagctcgagcggtcaccacactcctcatgagcctcccgactcggatggcggcccatgccctgccggcaggcgtcaccgcccctcgaccacgaggagcggaggcccgacgctagcgcacgcttctatcaccatcgttataggagtatcgacttctacgcactcttccggggtgccatgtccggcccgtggcgtcgtggcaggatggagcggttcgttcctcggaggaggaacgctcgctgggaaggagcaccatggctgggatctgtgaaggccgggtcgtgatcgtgaccggcgcgggccgagggattggacgtgcccacgcgctcgcgttcgctgaacagggcgcacgagtggtcgtcaacgacctcggcgccgaggtcgacggatccggctcgtcgacagggcccgctggcgaggtggtcgatcacatccgaagccaggggggtgcggccatcgccaacggcgacgacgtcgccagttgggagggcgcgcagcgcctcatcaacgcggccatcgagtcgttcggtcgcctcgatgtggtcgtgaacaacgcgggcatcctgcgcgaccgcatgctggtcaacatgaccgagtccgaatgggatgacgtgattcgggtgcacctcaagggcaccttcgccatgacccgctgggccgccgcctactttcgggagcaagcgaaggcgggtgtcgcgcaagacgcccgaatcatcaacaccacgagcgcatcagggatctacggcaacgtcggccaagccaactatggcgccgcgaaggcaggcatcgcgtcgttgaccatcatcgcagcgatggaactcgcgcgctacggcgtcacggtcaacgcgatcgcccccgtagcgctgacccgcatgactgagaaccttggcatcgtcgccccggacgaccgtgcagcacaggccgaactcgcgccggagaacatcgcacccctcgtggtctggctcggatcgacgcactcggccggcatcactggacgagtgttcgacgtcgccggccaccatatcgacgtcgccgaaggctggcacgcgggcccaagcgcggaggcgcgcggccaacgtttcaccgtcgacgagctcgacgacgtcgtcccggccctcgtccgcgcggcacggcgcaacgccgacatgagcgggcacgaaccacccgaggcgcccaacgcctaagctccatgcatcgtgaccacgccccctgagcctgtgtatcgctcacggtcgatcgacttcgcggtgctcgagcttttcgccctcgtgagcgacgcgttctcgggtgcaaaggaggcgttcctccacgaagacaagggcatcatcgcccacctcgtcgagcgcgaacgcattatcgacggtcgatacctcgcactcgagcgtgaggtgcacgagcggctcttggccccggaccgcaccccggcgatggtccactacctcgtcaccattgtccgcatcatcccagagctggagcgctcgggcgacctcgccgagcacatcgcgcgcaagggtgcactcggcctcgtgcgcgagctccgaccccgtgcgcgaggtcttctcgaatcgatggccgagctcgcgctgtcgatgtggtccgagaccgcggtggcgttcgagcacatcgacccaaccgtggcgcgtcgagtcaacgacctcgacgagtccctcgacgacctccacgtcaccttcacggccgagatcgcgtcgacgtgccaatccatcgcgaccgcgatggatttggcgctcgttgctcggttcgtcgaacgcttcggcgatcacgccgtcaacttggctcggtcgacggcggcactcgccacactcgagagccctatccccaagggcgacttgtcgtccgcgtcgtgagcagccgctaacgaacgtcgagatcggctgacgagcgcgatcggcggcgctcttcgagtcgggcgcccagcgccgcgatctcacttcgatggtgcatgccgagcttcgacaggatgttcgatacgtagttcttgacggtcttctcggcgagaaagactgactcggcgatctcgcggttggtcttgccatcgacgatcagatcgaagatccggcgctcctgcggcgagagttccgcgagcggatcgtcccccgcatcctggggatgccggatgcgctcgaggagccgtaccgtcaacgcggggtcgatgagcgactcccctttggcaacgcggcgcagcgcatcgagcagctcgtcgacccggacccgcttgagcagatagccagatgcgcccgccatgatcgaggcgaacagcgcctcgtcgtcagcgtacgacgtcaacatcaggcaacgcagctctggtcgtgcggcgcgaagctcgcgacacagctccacaccactgccatccgggaggcgcacatcgagcacggcgacatcgggagcagccaaggggattctcgcccgcgcctcctcaagagagccggcctcgcccacgacctcaaagccgtcgtcctcagcgacgaggcgagcaatgcctcgacgcacgacctcgtggtcctccacgaggaatacgcgcaccacgccatctagcttatcgcgtggcgcggtcgtcggattggcacgcggccccgagcggctaggcccgacgtcgaacgacgaccaccgggatcggcgcgtggtggacgagttggtcactcacgctgccgagcagcaacgaggtgaagcccccatgaccacgcgcgccgacgaccaagagatcggcagtctcacactgctcgatcagacgtgaggccgggttgccctcctcgagcacggtctccaggtcaagatcgggttccagggcgcgcacctgcgcggtcgcgtcgtcgagcagcgcgcgaccggcggcctcgagctcttccacggcggagggagttggaccgtagccaaactccggcaccgtccacgagtacacgatcacgagcgtcgaccggcgtcgcttcgcctcgtcgacggcgaactgcagcgccgtgcgacccgactcggagccgtcatacccaaccacgacgcgccgatgctctgtgaatcctgcctccaccatcgtgtgcacctcctcgagctcagcctacgcaacggtcctggccaccgcatcggacgatagtcccaagtcgcagcaggccttggcactagcatcgaaccgtgagcatgcgggcacgactgcgagaccacgtcgcaagctcgcagcaagcccttgctcgggtcttcgacgagtcgagcgcgctcggatcgctgcggcgggcccatctcctgtccatgaccgccgacgccatgatgacggtcgcgttggctggttctctgttcttctccgtgtcacccaccgaagcgcgaagccgcattgccctctatctcctcatcacgatggcgcccttcgcagcgctctcgccgctcgtggctcccatcgtcgaccggtctcgtcagctccgccgatcgatggtgaccatctccgccgtcgtccgcattgcggcggtcctgctgatggcggcgttcctcaggactctgctgctgttcccactggcactgattgcgctcatcgcatccaaggcgtacctcatcacgaaatcatccctggtgcccgaggtggtcggcgacccgcaacctcgaacactcgtcgcgaccaacgcatcgctgaccctgttggcatccgtcgggggcgcactcggggtggtcgcaggtgggatcctcgccaagacgcctcacctcggtcccgcgtgggcgctcatcgccgaacccgtcgcgctgctctacatggttgcggccggtcttcgtcttcatcggatgctgccccaggcggtagccggagcgtcgcaggctcgcgagcggctacgcagccgccccaccggacccggatacgcgagaaccttgctcgcgtccctccttgtcgccgtacttcgaggtcagatcggcttctttgccttcgtcatcgcgttcgcgctcaagggcagatcggctccgacctgggcctacggagcagcactcgcagccagcgccatcggtgcgatggccgccacgcaggttgctccccgcctccgacgccgactctccgaaatccccatcaccctcggcgcggcgacactcgtctccctcgtggccatcgcggcaaccaccgcacatccagcgatcgtctgggccatcgtggtcatggggatcctctcactcgcagccgggtccgcgaagatcgccttcgacgcaaccgtgcagcagggtctgcgcgaagagcactacgggaggaccttcgctcgctacgagacggagttccagctggcatgggtcgtgggggctgccgcagcaaccttcgctcgcacgccgttggccagcggtgagagcctgatcgcgaccacggcagtggtcgcgctcgccgcctacgcgctcgcgaccactgcactgcgtcacgcccgcgagcctgagttgccaggcgaggggacatgacattcacctatcctcgcgtgcgaattggcggctgcgtgcatcgctaggatcgtgtcgtggatcgcggcctcgagagctccgtagcgagcccatggaggccagccctcatcgcggcgatcggcgcactgctggaaatcgccgtacaagtcatcggggtcgggcacggcaacccaggaatcttggcgctcgtcggaaccctgttcggatcgcgcgcccacctccccgcctggattccacaggttcgcgggcctggctacgacggacagttcttcttgcgcctcgcgctcgacccattcgacatccaccgccgagccttcggcatcacctttgacacgccgtaccgtgcccagcgcatcggactgcccttcctcgcctggctcatcgccggtggtcagcagcacctcgttgtgtggacactcccactgatcgaagtcctggcggctgcgtgcatcgccggatcggtcactgtcttggccggatccgaaagccgagccgccctcactggtgtcgctgccgccctctacgaaggctacgcgttcagctacggacgagatctcgccgagccggtcgcggcggcactcatgttgctcgcgattctctccatcgaacactgggaccggccaatcgttggcaccgtcctcctgcttgcatcgacactgaccctcgagaccgaactcatggcggttggcgcgctcggactcgtagggcttgcccgatcgctgcgcatgaggcgggttgaccatcgcctcatcgtggcaacggccgcggcgatcagttggatcggctgggacgcctttgtgtcgcacgaggtcggccacgtcaccgccgctgccgatctcaacgctaacttgggtgtccctctgctcacacaggtcaaggctgtcgccctgcacctccacccctccgctgccgacctggcgtggctcctccagctcgggctcctagtccttgccgtcgcaatcacgatcccgaggatctcgcgttcgcgtgcgccctcggtgatcaaggttctgttcatcgccatgatcgtgctcgcactgctggtgggtcccgctgactgggacgtcgaaagcgggtttcgccagttcgatctcgtctggatttcgagcctgatcgtcatcggcaccaccgacaatccgccggcctggcttccagcgctcggcatcgcggcgtggatcggcacggttcacctcgcggtcaacaccactgccttcctgcgccgtctctagcgagtacacgagaggcggcccgccggtcttgcctgaggcatgaccaattcggtagagtcacaccattcgcaccagcggtcgactagcgagtccgaggtgcggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccgaagaaggcgaagactgcttgcaagttctcgcagacgctcggccgcctgagcttcgtgagagaggacgccgcgcccgtggcgctcgacgagggcatgtgcaagcgcctcggcaacgcgcgggcgcgggccaaccaaccagcgcggatccgaaccttccaacaccgcgctgacgagcgcagtcatggacgaggagtcggcccaggcagcatcaccgagatcagcgatgaatcgacgctcgtcgcccggcgaaccttgtggtcccaatgcgagggtggccgcaaccgtcgcgccccgcccgcgggccagctctgccgcgatcttgagcgcatctcccgggtccaccgcatacgtcaggagaaggccaactggcgccctcagattggccggtagtgcctcgagcaaacgacgcataccctcgctgggccgttgcccgaccaccagcgccccgtcaacccagccggcgacaacgatcagatcggcgtcgacgaggtcctcggtttcgaactgatcggcggggatgcagcgcacgcttggcgcaaaattcgcgagcgtctctcccagggaaagtgccgccgcgcgggtgtggccacccttggagtcgtaggcaatgagcacccgtggcggagccagtcgtcgaccgggcaacaccgcgttgcgaccgcctgcggcgagcatctcctccccgacccggcgcccgtgagccatcgcctccaccaccgttgacggtccgacgaggacatcaccaatggcccaggtgcgggcctgccgccacgctgccgctcgcctccgggcccgatcccggctccaggcgagatcaccgacacgcaaccctcggagcggctcacccgcgaagatccctgaggccaaccagtgtcggctcggcagatctccaacttccttgcgttcagcgagcccaggcaccgaagcgatccaggacggatcgacgcgatagcccatcgcagctaccactcgatcgaccacgagctcctcggcgatctcactggtcaccgtaggccgctcactcgcgcgctcctgcttcgtccgaacgaggagacagtggatcccgtcgtcgcgttcggcgaccgactggagcgtcacgccaaatcgcacctgtacgccctcggcctccgcttcggcaagttcgtcaggccgcacaaggctgaagcgctgatccatccaatcgatacagactgcagagccaccgcgccgtcgcaccaggcgcgcgacgtccatcgccgtgttgcccgccccaaccacgagcacacgatcatccaccggcggcaaaccagcttgaatcgccgcctcggccacggcgatctcgtcgagtgcgttgccgacagagatggtctcgatgccatcggcgcgtacgggcaacggagcgccagcaccaacggccagcaccacggcgtcgtagcggttacgcgccgccaccacatcgtccggagacagcgcggtgttcatctggaaagccacgcctcgccgctcgagacgctcgatgacccgatcgagaacgtccgagggcagcgtgaaccgcgggatcccgttgcgcagcaagcctccaggttggtcggcagcgtcgaccacggtgacctcgaccccggctcccgacaggacatctgcggcaccgagcccggccggaccgctcccaacgatcagtacgcggccctccttggcagccggcgtcgggtcgaccgcatcagcatggtcagcgatgtagcgctcgatggcgtggatcgccaccggcctcgctccggcaagccgccaggaacagctcccctcgcattggatcgccgcatcacagacgcgtgagcagatctcgggcaacgatgtatgtgcgctcagcacgtcacgggcaccggcgagatcgccactacgcagctgagcgatgaactcggggatgtcgttgtgcgtcgggcagcctcgcacacacgtcgggtccggacacgccaagcagcgattggcctcttcgagcacgtccgcaaagctcgcgaatccgccgcgtacctcgtcaaggccgcccagggccacgtctggatccaactctggcaagacagcgcccggcgcaacctgcggatcacccgcgacgacgatcgcatcgaacggacagacccgctcgcactggcggcacccgacacaccgtgcgctgtcgacagtgacgacgtaacgatcgaggtcgagatcgatcgcctccaccggacaacgaatcagacactcttgacacccggcacaccggtcggtgagcacctcaacgacaacagcgctcatgttcaaccctcctaggacgctccgtgcatgatgacgtacagccatccagccacggccccgaacacgacgacgagcgcaagagcagagagcttggcgacggcacgatgacgcacgatcgacgcgagatcagcgtcgaagatgcgcgccatggcccagaggccaccgacgactccgagcgccatcacgccgacctggacctcgacaatttgcgggatcgccagcaggtggtccgacagcaagctccagtgctgcgtgttgacaccgaagatgccgacgatggctgggatgaggctcgggatgtgcttgaagaacttcggcagctggcgtgcgaagtagtccatcccgacaactgggatgaggccgtaggtgagcggcaggaacacctgacggaacggagtgacgcggtcgagccgactctctgcggtgaccgtccgccgtgcagccggatcgagaaaggctcgaccccacgcccagatgatccctgcagttgcgagagccaccgcggcgatgatgcccaggtagtcaatcgggttcgggtaggccggccacccagtcgcgcgattgagcgtggcatcgatggagctgtagacgtcggtcgcgttgaactgctggaagatcacgaggccccacaagatcgcgatggcccaggcaaggtcccaacggcgacgcttcggcgcgaccacggaggtgagtggcgcctgcaggaagagtcccacattgttcgaggggcatgccttgtagcactccgtgcacagtccgcaggcggcattcgactcagccgatcccggccacgtgaaccatggacagccataaccggacgcaccgccacgcatgcaatccttggtggtgcactcgaggcacgtctcgcggtcgaccgttcgaaagcccgcgaccgagcccatcgacccgacggtgccgatcaacgccgagagtggacacaggtaccggcagaagctccgccgctcgaagacgaggaacaccgagaccgccgtggcgacgataccgagcaccatgatggctgtgtagcgaggcacccccggacctgcgatgttgaagtactcctcgatgaaggtcagcagcacgaaggtcgcgacagatcccaagaagccgtactcggccagccacggaggcaccgggcgcccgagaccgatcgccgagtgcagtcggcgaaagaaggtacgacgctggatccactccgcgaagccgccgaaggggcacatggagcaccacgcgcgcccgaccacggccatgagcacgaagacaacgcagaaccacaggtaccacgtgatcgcggtcgcaaagttcgtctggggatcgacgacgccgacgaagcccaggacgatcaccagccagaagatgatctggttcggcagaatcaagaggaattgggtggtccgattcgcggcgaggcgggcgatgataccccgacgtgccacgttggcacgtggcgacggatctgatcgctcgaatcgatcctggcccggccgatgcggcggtcgcaatcgcacgaccacctgatcatcgagcacggtctgcacatgcgggggcttggtcgtagccatctcgctcctcctttggcaccgcgccaatgattagtcattgactaatcgttactgtagccatgcccatacgtggtgtcaagtcgcgactacgatcggacacgtggacctctcgctgtctcggcgtggcgactatgcggtacgtgcagcgctctaccttgcgcgccaggagtcgaacgaggccgtcggcgtgcgcgagatcacggccgcaatggcgattccaccgagcttcgcaggccagatcctcgcggacctgacccgcgcaggcatcctcggtgcgcggccgggccgcggaggcggctattggctccaacacgacccgaaggacatcaccctcctcaccatcgtcgaagcagccgagggcaccctccgcgcggaacggtgcgcgctcggggatggaccatgccgttgggacagcgtgtgtccactccacaccttctggcagggagccgttcgagccgttcgcgatcagctcgccaccgtgacgctcgccgacgtccgagacgcggacgtcgccctcgaacatggggttgccccgccgcccgatgcccaccgccacgccacggtcaccaaccttgccgagacgatcgacgtcgaggcacccgcagacgaggtcgaacgacgcttgcgcacgctgacgtccgacgatctcgccaaggcgatcgcgcatcgcctgaaggccgcactcgacctcgacctcactctctgcgaactcgcccatccaggccgtcgcctcgtcgtcgaggtgaacgaccccatcggccagacggcgagagcagagttcgatctcaccaccgagccggcggatcccctgcgcaccacgctcactgcggcgatcctctggcgcggtcggctcgaggacccacgccctagcgttcgcgcgatcctgacggcgacggcaagactcctcgaggacgcgcgctgatgcaccgctcacagacgccgtaggcctcgacctggtgatacaagactgggccaggcgcgtcgtcgatcgtgatcgcctgacacgaggccacccgaacctcgaagatctccccgcacgacacgcagtggaagtggtggtggtgcgacgcgtagggcggcaggagctcataggcgatgtcgtcaccgatggtcaccggttggacgatgccagcctcggcaaacgccgcgatggttcggtaggccgtcgccgacccaacgcccgcttctgcgagaacgtcgaccaactcggccctcgtcagcggacgccccgcctccgccaacacgcgaaacaccgcacgtcgctcatcggtgacccgcaacccgcgttgtctgagtgcaccctcgaactgcgtctcagccatcgagctgctccgtccgaccgggctcggcactcggagccgcatcctgctcgccagcgcgcgagagcgagcgggcccgacgcgcagcgtgacgagtctcacggacgagcgtcccgatcccgacgacgacgacggcgaagatgacgagcacctgagcgatgccgatgttgtgaaggttgtgcacgtggagcggtgtcaccaggtgaaaggagagaaggttcgggaatgcgagtccgacgacaccggcgaccacgaacgccacacctccccacaacagcgtgcgcccagcggtgaccagtgcgacggcgcgaatctgcgcctccgtcaacgacaggtgtcgagcgacggcaccgaagaggccgcccgcgaccgcctggaccaccgtggtgcccaggccgaaggctgcaccaggcgcccaaccgagccacacgggcatcgctggcgcgagcacggtgtagaggatgagagcaaacgccccgataccccagcctgcgatgaaaccgtgcaccgcgggcatccatggcttcatggtgacgtcgggtacaccgtcctcgacgtgatgggccggcgagagcagatgccagtgctcaccgcggaacaagtaacgtgccgccagcgccatcgccagcccgacggcgacgtagacggcatagtccagccagggcgtgtcaacgaagaccttggcgagcgccaggttcgcaagttcggacgcgatcgcacgctgcacggtgaacgcagccgagaacgtcaggccggcgacgagaccgcgtcgactcgagtagctgccgatggcgtacgagaacgtgatcggccacgtgtgctcgtcgggggtgatgccatgcacgatgccgagcgcgaacgcgagtaccagcgcaccgccgatcgtcgccaccccagccgggttccacaagttcagcaccgcgagcagatccacgacgacctcctgtccgtgctacacatgatagcaattctcacttagtgttgacacgcattctcaacaacgaggcggccgtcccattccctgaccgcgcgcgctagccttcccctgggacgatgtgtgcacgtgcaatcgtgggcgcggcgctcgactcggctccccacgcaccccggatcgtcaacggaaaggatccatgatgcgctatcgccatctcggccgaaccggtctcaaggtctccgaactcggcttcggctcctgggtcaccttcggaacccagctcgacgtcgggcgcgcggccgacatcctcgccgccgccagggaagccggcatcaatctgttcgacaacgccgaggcctacgccggaggcgagtccgaacgcatcatgggacaggccatcgcgcgactcggatggccacggtggagctacgtcgtcacctccaagttcttctgggggatccacgacgacgtgaacacgcaccacaccctcaaccgcaagtacctcgtcgaggccgtcgacgcgtcactcgagcgcttcggcctggaccacctcgacatcatctactgccaccgaccggaccccacgacgcccatcgccgagacggtcttcgcgatgagcgaactcgtcagcgcacacaaggcgcactactgggggaccagcgagtggagcgccgaggaaattcgccacgccatcgacgtcgcaaccgccaatcacctccacgctccggtcgtggagcaacctcagtacaacctgctcgagcgccagcgcgtcgagcacgaatacgcccgcctgctcgacgaggaaggcatcggcctcaccacctggagtccgcttgcgtccggcttgctcaccggcaagtacgtcaatggggtgcccgcgggatcacgagccacgctccacgggtacgagtggctccgtgatctgctcaccgacccgggacgccaagccgtcgtgcgcagcctgctcccgctcgcgtcacggctcgaggtctcgctcgcccagctcgccatcggctggtgcctcctgaatccgcacgtatcctccgtcctcctcggtgccacctccatcgatcaactcaacgagaacctcggagcactcgaggcccgagaccgtctgaccccagcggtcgtggacgagatcaacgcgatcctggcggagcacgcctgagcggaccaccacgtctcggacgtgcggtcgctgcggcggccctgttcgcaaccgcacccgcgctcacgcaacgcgcagacgcgctggcgggaccgggtgcggtcctcggtatgcgagccatcgtctcggtcgcggccctcgtcgtgatcgggctgccgcgggtcaggcacctcgctcctaccgtcgcagccggtgtcgccatcgtcctcggctactacggcgcgaccaccctcggctatgccatcgccccggcgacaatcgcgtcgctgggtttggcgagcgaaccgctcgtcgtcggtctcctcaatccccactggttgcgctcgccgcgcaccctcgcaacggtgacgctcgcagtggcggccatggtgctgccggtcaccgcggcccacgcagggacccatcatgtggtagctgggatcggactggtggcgctcggcggcgcatgcttcgtcatcggagctcgtctcctcccggcaagcgcgacgccgcgcgacgccgtgcggacgaccaccttcgcccaagccctcggtgcgatcgtcctggctgctgtgctcgccggaaccggtcgctttgccgtcgcgaccacgatcgagccctggctgctcgtcgcggtgctcgtcgccggctcctccctggtcgggatcgccctctacgtcggggcggctcgcgacgcacctgccatcgcggcctcgagcctcagcctcgtgccaccgctcggagccgcccttgcctggggcgcgcttggcgatccgatgacctggcaactcgccctgagtgccatcgtggccgcgttggctgtctacctgggcgcacgtagcccgaccgttccgtagtacctggcggtaggatcgcaggtgtgtccaccgcgtggaccttcggagcagccgccctccgctacgacactctacgaccgccgtaccccgcggcgaccttctcaacgctcgagcgcgcgatcggatcctacgagggctctcgagtggtggaggtcggtgccggaaccggcatcgccacccaggggctcgtcgctgcaggcgcggacgtcctcgccctcgagcccgatccaggcatggggcgcatcctgcgtcgacgcctcccgaccgtacgcatggtccccgccaggctggaggacgtcgacctcgagggcgtccacctcctcgtcggctttcagtcgctccattggataccggtgcgagccttgtggcgcgctgcccgtcgagccctggctcccggcggcgttctcgccggcgtctggcagctcgccacgctctccgatgtccgagcggcccacgcgatcggcgaggtgctcgcgagattcggcgtggaacgctccaggggatccgaccagcgcgtcagcgacaccatcgaggcactgagcgaccaggcggtgcacgggttcgcacccgcgatgcgctgcgagctcccttggcacacgcagcgcagtgcgacaagctttgcaggcctgctcgcaaccatgagcgacctgcttgcactcggtcacgaaggcgccgactgcgaggcgcaactcgctgaggccctgaggccgtacgagccgatcgacgtgcgctacgactgcgtcgtgatcatgcgtcagcggatgccctaaggtgacggacgtgctctccccgttcacccccgtcacgatcgatcgaacccgaaccgagttccccggtatcggagcggcctggcgcgcgcacgcgctccggatcgacgatcgcctcggcctccatgcgctcgctgcaatcgccgacgacccgcagccagctgcgcacggaccactcgcaggcgtgccggttctcgtcaaggacaccatcgacactgccgatctctccacgacggccggctccctcgtcctacccgaagagccccctgctactgacgcctggatcgtggatgcgctgcgcgccgctggtgcgaccatcgccgccaagaccacctgttcagagtgggcgaactttcgcggcgagggatccatatccgggtggaatgcgcgctacggactcgcccgtaacccctacgacccgacgcgctcggctgggggctcgtcgagcggctcggccatcgccgtcgcggctggcatgagcccgatcgcgatcggtaccgagactgatgggtcgatgctctgcccggcatcgctcaatggtgtcatcgggttcaagactgctccgaagcgcctcgaccggagcggcgtcatcccgatctcgtcgacacaggactccctcggcatcttcgccacgagtgccgacgacctcctcgtcgtcgcgagcgtcctcggcatcgaagccaccaccctgacagaacctgtccgactctgcgtggtcgaggagtccctcaacggcttccatcctcgtacgctcgcacgctttcacgacgtcctcgagctgctctcgcgcgcgggcgtcgacgtcgtgacgctgagcgcaccgccgcgcggaacgctcgagccctccgatgaggacgagctcatcgtgttgcgcaccgagctgcatgtcgagctcgatcgctacctcgatcgtcgcgccatccccggccttcgctccctggccgacgtggtcgcggcgaacgacgcgctcgccgaccgagagctcgcctacttcggccaagagcacttcgtggcggcactcgaggccgacccggccgatcccgcctaccgggccgcgcgccaacgcaacctcgagcgcacgaccgaaggaatcgagtcctcgctcgccgcgacggacgcactcgcgatcctcgcaccaaccatggacgtcgcgtggcccatcgatctgctccgcggcgaccccaactccccagctggctatcgagccgccgcagtcgccggcgggacttcggtctccgtcccggcaggtcgcatcgggcacctccccgtcggcgtgtgtctcagcgcgccggcaggtcacgaggaaacgatcctcgagctgacggcgctcctcgagcgcgctctggccccactcgcgggcctcgcgggacgcgagaggcccacgacgctgttgcccgaagcgtgagcgccaccatctcgatcagtcgccaagttcccttccgtgccgatcgcgtgttccgggaactcgccgcgctggaacgacaccacacctggatggcggatgcagaagcggtcgagatcgtgagcgcccaacgccgcggcgtcggcgtcgagatgatcgcccatactcgcatcggcccgctgcgcacagccgaccgaatggtggtcgtcgactgggacgaaggccgtgccatcggcgtccgccacgtcggactcgttcgcggagtcgggcgtctcagcgtccaagccgacggtcccgaccgtgcgcgagttcgctgggacgaagagctcgtcttcccaggcgggcatctcggtgagctggcagcacacgccgcacgaccagtcctcgagtggatctggcgaggcaacctcgcccgcctcgaggccgcgatcgcctcggcagggcccattacgctgggcgctccgtgagtacgacggcctcgaactccatcgccgcacgctttggcgcgctcgcgcgccacgccgtggccgacacgccgtcacgttccgaggacgtccacctcgaccgtgacgtgatcgcggccatgctcggcctggaggatgagccggaagcgctggttgcaaccgttcgactcgagggccacactgcacgtttcgcaacgcctcgcaccccgctccccccgcgtctcagccgcctcctcgccgagaacccgggtcagctctacacgcaccaagccgccgtcaccgaccacgccctggcgggccaccacgtggtgctcgccaccccgaccgcgtccggcaagtccctcgcattcctcgtccccgccctcgctcgcctcgagcgcgatcccgcagccaccgttctcgccctctatcccacgaaagcactcgcgcacgatcaactggcgcgcctcgtcgagctcgagcgagcgctcggcatcgacatcgcccctgccgtctatgacggcgacaccccggccccggaacgcgctcgcatcaaggaccgatcgcggttcgtcgtcaccaacccccatggcctgaacctctacctcggatggcacgaaggctgggagcgcatcctcgccaacctggcactcgtcatcgtcgacgagacacacgcctacacgggagcgaccggcggtgcggtgggctggttgctccgtcgactccagcgtctcgccgaggcgcacggtgcggcaccggtctacgtgggggcatccgggaccatcgccaatccggccgagcacttcgcacgactcatcggcgatgacgtcgtcctcgtcgatgacgatgggtcggcccagccgacacgcacgatcgccatcgtggatgcaacacgatctcccgatcacgccccgatcgctcaggccgcgctcctcgtgcgtcggctcgtccgccaccgccgccacgtcatcgccttctcgaactcacgatcgcacgccgagctgctcgcgagactcgcgaccgatcgcgcggtccgcgtcgaaccctacagggcagggtacgcggcccaacggcggcgggcactcgaagccgacctccgagccgggcgccttcgcgccatctcagcgacgagcgccctcgaactcggcatcgacgtcggcgtcatcgacacggtcgtgctcaacggattcccgggctcgatcgcctccctcttccaacgcatcggtcgagccggacgatcgggccaggacgcactgggcgtcgtcgtgctgggggccgaacccgccgcccgagcgctcatcgccgatccagaggagttcctcgtccgcccgcccgagctcgcggtcgccaacgtcgaccagccctccgtggtccggcgtgcgctcgagctcgctgcggccgaacgacccgtcacccccgacgaactccgtcactggggcgcgcccgcacgcgacgctgccgccgcactcgtcgaggctggcacgattcggcacgacgccgacggccttcgagtcccgggccgccgcccgcatcgcttccgaccactggtcgagatggagccgacgtggcgcctccagttcgaggggacgcgcaccaccatcgcgccagagagcctgtcggagagtcaggcactgcgcgaggcctatcgcggtgccatcgtgctgcatggctcgcagccctaccgcgtcgtccgggtcgactacgctgcgcgcgtcgcggtcgcacgaccagaacccgaccgaggccaccacacccaagcagcctggtatcgcgcgatcgctccgacgcgcgtacggtctcatgcgatcgcggggtcgctcacgttggacctggccgatgccgtgctcgtcgagcaggtcacctcagccaaggagttccggggatcagtgctcgtccaccaacgcaaggtcactgccccctcacgttcggtcgcgggcgaggccttgatcctctcgaccaaccaactcgtcgatcccgccgaacttccagccctccacggcgtcgagcacctcctcgtcaaggcgctcgcgccgcttgccgtcggcgcaagcgatctcaccacgctgacccaggccacgccggcaccgcagatcctcttcttcgcgcccgatgcgctgggcggcggcacgatgcttgcgacggtggctcgccagctcgatcgtgcgctcgccgtgtccgagcgcatcctcacgacgtgccgctgcaacgatggctgccccttctgcaccctggacgctcgctgcgacggcgacgttgccgccaagtcgctcgtcctggacgtgctcgtgcgcctgcgcgaccaccacgcgcggcacgcttagcacaatccggcgcgatgcgcctcgcacaggtccgcgagccggcagccggcgcacagtggccgcctcgccgtgcacgtctcccgaccgtgcaggatcatgcgcaacgagaaggtcccccagcgcttcggtgccaagaccgcacagagctcctgttcgatcccctccggggtcgacgatcgggcgatcccgaggcgacgactcacccgtttgacgtgcgtgtcgacggggagccctggcaacgagaagccgaccgaacgaacgacattggccgtcttgcgtccaaccccgggcaagctggtcagctcctcgagtccttggggaacctctcctccgaagcgctcgacgatcgcagctgccagcgcgacgatgtgacgagccttcgttcgatagaaaccggtcggacgcaccagcgcctccacctgctcgatcggagctcgggcgagagtctcggcgtccgggtagcgagcgaacagtcctggcgtcacgaggttcaccgcagcgtcggtggtctgcgccgacaagaccgtcgccacgaggagctgaaacggggtctcgaagcgcagggcacacagcgacaccgccgtccctggatagagctcttcgagtcgttcgtcgaccgcgagagcccgtcgggtttcgtcctgcaccgccaacctccccaccgctagcctagagacgtgcacgcgctcacgacggtcgagaacccgtctgcgcgcctgctcccgggggtgcttgcactcatacgcgatgtcgaggcagccgacggccacgaggtactcgaggctcatcgctggatcgacctcgccaacgcggacgccgagagcctgcacgggatcgcggtgacgctcgacgacgacaccgtcgtcggctacgtccacctgcggcggcaccaccgtcacgggatcgagctcgagctcttggtcgcgccagaccaccgcgacgaggccgcgagcatcgtcggcgcgctcgtcgaggccgcgagcgcgagtctcgagaccctcggcccccacgagatcttcgcctgggtacccagacactctcgacaggtcatcgatgccctcgagggcctcgggttccgtgccgaccgcgcggtacggcagctccgacgtcccctcccactcgagtcagaccacccggcacggccgattgactgcccgccgtttcggacctttcgtcccggcgaggacgaggatgcgtggctcgaggtcaacaatcgcgccttcgcatggcatcccgatcaaggcgactgggatctcgagaccctgctcgctcgtgagcgcgagagctggttcgacccagctggtttcctcctggccgaacaggacgggcgcctcgtgggcttttgctggacgaaggtgcatgcgccgcgctcgtcgtcagcgctcggcgagatctacgtcatcgccaccgatccagaacgcgcgcctcgcggacttggctcatgcctgctcgtcgccgggttggactacctcgcccaccacgacatccccaccgcctcgctctacgtggaggacacgaacgaacgtgcactccgcctctatgaccgcttcgggttcgtggtcgatcacgaagacgtccggctcgtgtggcgtctcccagcagcgtcgtagactcctcgacgaggaggatcaatggatctgaaggaagcgttcgtcggtggccccaggttcctcgacaccgcgagctacggattgccaccccgtcgcgaggtggccgcactcgaacaggcgctcgctcggtggtcgagcggcacggccgattggtacgacgagtggctgcgcgcgacggatgtcgcgcggggccaccttgcgcgcctgctcggcaccgattcgaccgcggtgaccaccggtccgaccacctcggtgctcgtcgccctcctcgcaaccaccgtggagccgggcagtcgcgtcgtcgtgccggacatcgagttcacctccaatgtgttcccctggcttgtgatcgctcaacgcaggcagctcgatctgcgtttcgttcccgtcggatcgctggcacgtgcaacggctgagggggccgacgtcgtgagcttctccctcgtgcagtcggcgacgggtgaggtcgccgatctcgacgccatcgtcgatgccgcggagtccgtggacgcacgcgtcttcgtggacgccacgcaagcgctcgggtggcttcccgtcgacgccacccgcgtcgacgcggtggtcgtctcgggctacaagtggctcctcgctccgcgcggcgtcgcggccatggctacgagcgaccgtgtccgtgcttccatgcggatcgttgccggcttttcccatcaggcctcccgagcggaaatggggaagaggcggacctccgtccccaccgcctcggccagtacacggcgagagaagtgctcgatcgcggcggtgtcggcttcctgcaggatgtcgatcttgttcaacaccaaaaagatacggccggcgtacttccggacctctcatggaggaactccagttcggcctcactcaccgcctggtcggcggagaggacgaacagggcggcatcgcactgcggcacgcgcgcccaggcggtgtcggtgttgtggcggaacaccgagccgacgccgggtgtgtccacgatgcgcacgccattccccaggagcggcgagggcgtccggatcagacttcccgcacgcccttcgcgttgcccgggttgcccggctcggtgatgtaatccgcgagcatatccggacggatgtcgaaggggctgccttccagcggctggacggtgatccgggggggatagccgtaggcgagcacggtcaccaccgaggtcagcggcaccgcccgcgtgggcagcaggttctcacccagcagcgcgttgatcaggctggtcttgccccgtttgaactggccgaccgtcaggacgtcgaaatggccggcctgcagcttgtcacgcagggcgagggcggggcgcagagcggcggggaggcgtccgccagctcgtcgatcaggctcaggagttcggttttgagatccgcatagccggtcgttggcgcctcaccggcgatcggccaacgggggatcgcgttcattccgcagtggtcggatcgatgacggtgcggatttcgttgatcgcatcggcgggaaagccgccttccagtgcgtgctgtaccagcgtggcggcgtcgggggcaatgtagacgcagtacaccttgtcgtcggtgacatagctctcgatccactgaacctgcggtcccatggcgttgaggatcgaacaggattacgggagatctgccgcagttcgtcgcgcgacaggtttccggcggccgcgaatcgtgcgctctatgacatatttgggcatggttatcagccttacggttctggtaaggaaaaaataggcttgtattgtgcttatccgaagataagcgctttccgcgcagcccgattctttcatggatcacgattccattgaatgcggcgaaagtctcagggtccggtcatgaatgaagagttatggcggcccagtacgtcaccgttatgtccgatggctgtatcaaacaaagacacgtgtagtgatatcggacaactcgtccatccccgtcggagcattcggataacgtgctcatcgttccaaaatattgatatacggtatacgtatccgaagaataaagttggcacgatccctgtaactaggttgtcacgacctcgtcggaggttgtatgtccggtgttccgtgacgtcatcgggcattcatcattcatagaatgtgttacggaggaagagccgctgtacgccaattggtacgccggcgaacccattccgacctcgctctacggaccaccgctgcgactggctccggatgcgcggcgcttcgacccctcgcctgcgtggttctcctgggtcggcgcggtcgccgcgctggaactcctcgacgaggtcggcatcgacgcgatctgggcgcacgacaccgacctcgccgccgccttccgcaccatgctgggtcttcccgagcccacggtcccaagcgcgatcgtctcggtggcgctcgatcgagcaccctacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcgagaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtgggaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggcgagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgccgacctcacgacgaagatctcgttccgcgacggccgcgctcgcgtctccttccacctctacaacgacctcgccgacgccgagacgctcgcagccgagcttgcccccttcggcgtccagcgcccacgtcggagctgatcggccggctcgaccgtgccacgaccgagccaacaccagcgcatacgagcacgcacgggcatcgtgcactgccttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcgcgatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgatggatcgggttgccccgttgcgatcccagcaccacgagagaggtccgcgatctcggcccggcaggtccgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctccccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcggacgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttctcactcccgaggaggaatgggagctcaagcgaccatggacttccgcgaccgggaactggtgtggatctggtcccgtctcaggcgggcccgaacctcccgcgccaatgccggggaggcctatatcgccagctgtcgccggcgccgcgaaaaaacgaacaatcctgaaacggagtcgacgggtatcgttgggaaaaaggttatctgtcgccctattttgtaacgttccgagcccatcgcctggcgccctgtgcgacaaccgttgcaccgtgactcaggcgagcgactcgagttgtttgccctcatgtggtcgggccatgctcgccaacagacaatcgtcggaaggtgcggctcgccctgggagcatgaggccgatgtccccgcacgactcctgggagcccgggacgagctccgtcacggcaccgagccagggctcgcagcaagacccgcgcgagcgctccgatccgatcgtcgcatcgagcgcacgagtcggagcgcagacgatctgctctgcccgtcactcatcgagccgcggtgctgccgcgacgattccacgccagcgtgacctcgacccgctgcgtggcggggatgcgcgcgccggggcgtcgctgtgcccgaacagccggggcacacccgagccatcggtccaccaaaccgccctcccatggtgatcgacgccgccacgctcagacgcccacccaaaggcgcccacgcctggccctggccatcaccggctcggcgctgcgctgcaggctggtgcgcactagcgaacgagcagatgccagccgagccatgcccacccgagccacgccacgacgcgccacagccgcgagcgacgcaggcctcccacgaactgtgccgggcccgcgccgacacggttcagcaccacccacgccccgatcacggctccgacgaggacccaagccgcccacgcgctcgtcacgacgacaccatcatggcgcgaggagccaccgaccgagcacgacccacgcggccgccagcacgctccgaccgagtccgaagccatcgaccttcgaccgcagcacgaccgcctcgaccatcgacgagaaggtcgggtagtgcccgcgcggtccgtggaccaactccaccagttcgaccgccgtgaacacggtcgcgacgaccaacgccgccaccaccgcagaccgcacgacgcgggcgatcccgtcggtcgtcgtccagggacgagcgacaccgagaccccacgcgatcagcgctccggtcgcaaggcgggcaggccacgtgaacggagtgctcacgccctcgacgacgatccctgcggcgacgagcgcggcccctaggagccagatggcgcgccgaggcgcgcgaacgtccataggccccccatcacccccgcaagcgcgagcgccccgaccgaggccacagcgacgacgaggctgcgcggacccgtgctcgccgcaacgccgatgccgagcgcaacgagaaccgcgctcacgacgacgacaccccggcttgccgatgcggctcgcgcgatgcgagcagcatcgaactcggccgcacgagccgccagctccgcctcgagacggcttgcgcatccccctccacggccctcgcacgcctcgcacgcttgggcgcagccaggctcgggtggcgccggacgtggtgcgctcgatctgacgactaccgcgccgacgacgacccatgcaaccaccaagcccccgatggccacgctggacccgacgccggcaagtgcgcccccaacgatggccgcaaggacacctccgaagccgaagccaagcagccaacgaccgctacgaacaccgcgctcgagcgcacgaaacccggaggtcgtcatgccaggcagtctaggcaggtgattcgccagtgcccaaggcgggagcttccggtgcgcacgaggcgcagctcgtaggccgacgaccgtgtgcgccagcgtcgactgtccgaccctgtccggggctcaccgtaggatcatgctcgtggagcagctcggcctcgacgacgacgggaccgatctgcgaaccgtgcgcttcgccatcctcgacgtcgagacgaccggagccgcatccggtgcggacgagctcaccgaggtcgccatgatggtcgtccaagagggccgtgcgctcgctcacctccaaagcctggtacacaccgaccgccccattcccccggcgatcgtggcactcaccgggatctccaacgagctggtcgccgacgcaccgagcgcccgcaccgtcatcgagcgcacggctcgactgctcgagggcaccgtcatggtcggacacaacgtccgcttcgaccgcagcttcctcggcgccgctgccgatgccgccggcatcacactgcccgaggtaccggtcctcgacacgctcacgctctcgcgcgtcctcctcgacggagaggtgccgaaccaccgtctcgccaccctcgctcactaccttcagctcccaccgccgagccatcgggcgatggcggacgtcgtcaccactgtggcgctcctccaccgtctcatcgagcgggccggtgcgctcggcgtcaccaccctcgagggactcctcgcactgcgacgcccacgtcgcagtggcgccgacctcgagcgccaggccagacgtctcccgcatcgacccggcgtctactacttccacgacgcgggccgggtgctctacgtcggtgtcgcgaccgatctccacgatcgcgtgcggtcgtacttcagcgccgacacacgcacgagcgtgcggcgcctgctgcgacgcgcctccagcatcagtgcccggccggtgccctgcgacatcgctcggcctctcaccgagttggccgagatccagacactgcgaccgcccttcaaccaagtcggcgtccgacgcccgcgcacgcgatcattcgtgacgcccgagggacgcgtcatcgcgccatggcccctcaaccaacccgatccgcccccgtcgatctcgacgtgcttcgatggcgacgcccacacggttgcgagagcgctcgaggaggccatcaggcaccttcaggccgagatgatccaagcgagcgacgacggtgagtacgaacgggccgcggcgcttcgcgacctcggcgccctcgtcgcaacccgtgtaccgacgagcctgctccacgaagtccaccgggagggtcgcaggctcgggctcttcgacccccgctgcgacgcccgacacgagttgacgggccccgagggactcctcgatctcggcccggacgatcctgagcttcgaagctaccgagcgctcctcgtgctgcgtacgatcgccgaacgtcgtgacctcatcctcgacgacgagctcgcccccctcgtcgccctcgttcgtgagagcgtcaggttccgccgcggctcagtcggcgccgcctcggatccgagcaagggtctcgcccgctcgtcctgagctgatcgcgtcgaccgccagctcgaagccgtcgacgatcgtcgccgaccgcccgtcgacccacaaggccaccgcggcgttcagcacgatgatgtcgcgcaccggaccgcgtacccgcccctcgagcacgccctcgagcaccttggcgttctcctccgcgctgccaccacgcacagctcctgccgccgcagtcgcacaaccgagcgacgttggatcgagcacgccagcctcgagctcgacggcgcccttgccatcggaacggagttccacgaagcgcgtcggcgccgacaccgacacctcgtcgagtccatcgtcggagtggaccacgagagcatggcgcacgccgatcgcggccagcacgtgcgcgaccggctcgagcagcgacggactccacacgcccacgagctgcgctcgagcacggccgggattgaccagcggtccgagcacattgaacgcggtcgggacgccgagggctcgccggacgggcgcgacctgggccatcgctggatggaagcgtggcgcgaacgcgaaaccaaagccggttcgttcgagctcccgacggagctcgtccgctccgagctgcgtcgggacgccaagggcctcgagcacgtcggccgagcctgctcgcgacgacgaggcgcggcccccgtgcttgagcacgagcgcaccacaggcggcagccaggagcgccgcgccggtcgacacgttgatcgtgaacgcgcgatcgccacccgttccgcaggtgtcgaggaccgggcccggggtcgtcaccggaaccatgtggtcgaccatggcctcggcgaaacctgcgagctcctccggcccctcgcccttggcgcgcagcgccaccagcacgccggcgatcacgaccggctcgacctggccgtcgaggaccgcgtcgagaaagtcgcgcgcgctgcctcggtcgagactgcgcccagcgaggaggtctccgaggagatccgaccaggagtgcgaatctggcgtcacgccccccaggctagcgaagggcacgtcggcgctgacggagcactcgtgcaaggccgcccggactgagcggacgaaagaagtagaacccctgcgccttcggcacgccaagctccaggagacgcgcggcggtgctggcgtcttggacgccctcggccaccagctcgacaccgagacgccgcgcgagcgagacgagcccgtcgagcatgctcgagccgttcttcgtacccacgttggccacgaagcttcgatcgatcttgacctcgtgcacggcgagcgtcgcgaggtggcgaaacgacgaggtgccgacgccgaagtcgtcgagggccaccttgatgcctgctcccgcgagtgcctcgagggtgcgtcgtagctgctcgagggccgaggcagcgatctcggactccgtgagctccacgacgacctggttcgcggcgatgcccgatcgttcgacgagttcgatcaggcgtgacgcgatgccgcgccggcgcgcactctcggccgacaggttgaacgagacccgaagccctcgtgccaccccggtgcgctcgagctcgacgacctgacggagcgcgagcgcgcgcaccagttcgtcgacgcgctcgacgaggcgaagatggacggcgatcgggaggaaacggcccgggagcaccgtaccgagcctcggatgctcccaccgagccaacgcctcgacgccggcgatctggccggtcgcaagctcgacgaccggttggaacacgacgccgaaggtgcccgcctcgcgatcaccctcgagcgcgcgtaccagttcgggcgcgagcgcgatgtcggccggctcgagcggcgcggtgacgcgctcgacacgagccaccccccgacgctcgagatcggccacgaggtcgcgctcggcgcgttgcacggctgcgagcacgtccccgtcctgaatactggccgcgccgagcgacaccgcgaccccccttgccccgagtacctcgagcatgtcacggcggatcgtgccgaaatcacgcgaactcgtcgtgccgacgatgagagccgcaaactcatcgccaccgatacgcccgacgaccgcctccggaccgagagcctcgaggaccccagtgacggcccgtaccaggtagcgatcacccgctgcgattccctcccgttcgttgacgtcccacagctggtcgagatcgatcagcagcacgtacgcgcccgaacggggcccttcggcttccagtcgctcgctcgccctggccaggaaggcctgccgatgccagacaccggtgaggggatcgcggtcggcgctctctcggagtgcgtcggtggccgctcgacggaccgctgcactcccagccacgacaagacaccgatccaggccgagatcgatcacccactccggatccctcgcggcagcggtcgcgatctcgatgcgccgttgctccgtctccagcacgatcgacatgccaaggctgttggcgagaggcagatgctcctcggcaccgaggtgtgcgccaagaagacgtccacgatcgcggacgtcccagagcgcgacgagtcgggcgaggcgctcgagcgccaacacgtcgccgacgtcgaagcgatacggcaccgcatccagggcggcgagcacgcccacaggcccatcggcaccgacgagcggcacgacgagcgcactctcggccgagacgacgccccgaatggcccgcacggcctcgctggggacgcccacgccagcctcggcagagccgacgaggacgctcagctgattccgaagcacccatccggcgaccccggcgcccacgtccagctcctccagcaagccgaagtcacccgtccccgccgcggctcgcacgacgaggctccgcccggcgacttcactcacgaccacctgcgatgcgccgagcaccgacgcgccagcgcgaccaaggaggcggaggcgatcctcccgagactgatccgagactcgttcccctatccggagcgcccggcggagccgatcggcccgccgccgctcatgatctgccatgaagcttgccgcagcgatccgaacggccggtgcaagccgctcgacgagggccaacccagccggatcgacgccctccgcagcgcccgcaaggaacagtcgctctccgagcgcgaggacccagaaggacgcagcgtcaaccccgacctcgacaaccgtgccatcagcaaccgctgcgagcgccgcccactccagaccgacgaggccacccatcgccgtgggaccacggaccacgcgcaggcgcgagaatccttgatgcacgccgagcaccgcgcacggcacaccgagcgctgcggacaggactccgaggagctggtcgagcacgccgtgcggtgatgacggcgcggcgagcacgcgcgagatggcaccgtagagctcaccttggcgctcgcctggagatggtggtgccggcagctcgggccgagtcacccgaacctcggccacgctgcccctttggcatcaacgctcgttcaatatcccgaccgttcgcaacgttacacggtgctaccatcccggtgtgcgcgacatggcagcgaccgacaccacctctcgcgagctgttcgcccgcatctccgccatcgtcggcgcaccggaccctccctacgcccgcctcgccaggctcggcgagctcgccgagcaggtcggggcccgactgatcgttcgtgacggcctcggcccaggaacagcctccgtccgcgcggccccctcgccagagctggggagggccatgggtgacgccgccaacctgctcctgcgcctcgactaccgggcacgtgctgccgagcgcgccaacgagcacctcgccgagaccgtgaccgcactcgagctcgcgatcgatgcggcgacgagggaaccgccgatcgagacccacgcaccggcgttggcactgtggcatctgccggtcgcgctactcgtcgtggacgagcagcagcggatctgcttcctcaatccgcaggcggctcgcctgctccagctcgacggtgccgacgtcctcggctcggtgtggacccgagcgctcgcgagtctcggcgaggcccagctcgatcggatccgaggtcactttcgtgcctccggacactttcgcggcgtggccaccgtgccatcaggcgatgacggccgtcggtacctggccatcgacgcagcgacggtccacgcaacgtcgtcgcacgcggcacgtcccctcgtgcgtgtcatgctctgggatgcgacgcacgcggccgtggaggcgagctggctgcagtggaccgcgacccacgaccctctgaccggcctgttgaaccgagcgggcctgaccgaacacctgcgaacgtggggagagcgacccctgcccggcctcatctggctcgacatcgccggcttcagcgacctgaaccgagcgctcggccatcgtgtcgccgacgagatcctccggcatgtcgccgacagcatcatgaccgaactcggacccgacgacctcgcggcacgcgtcggcagcgacgagttcgccatcctcgtggccgacggggccgccgccaagcaacggcggtgggccatcagccagagcgcaagcagcctggggagagccgcgatcactgcggacatcgcggtctcgctccggagcgccgtcgcgacccatccacgtcccggcatcgagcgatcggcggcagacgccgtgtgggaagaactcgggcgcctcgcgaggatctcgcgggagatcagccatccggccgctcgcggccgtcgacggttcgcgccacggggaagccaccaacccgccgacgagctcgaccatcccagcgtgcggtggatccgcctcatcgacgttgcgacctcctctccgagagggcacgaactcgtgctcaccgatcggaccggtcgcccactacgcgacgacgcccgacgcgaccacgcggccggtcgctacgaccgcgccctcctcggtgcgttggcgaggaccgcgcatccaggtggggtggtcgcggtgcgtctcctcgagccctcccacgagctcctccgcgctctgaagaccagtgaccgcgggtccacggtgcaggtcaccctcgaggcagacgacctcgtcgcgaccccggagcgccggcgcgttgccgcgaccatcgctcgcgaggcccatgcgctcgcgctccgggtgggcctcgacctcggcgaacgccacggcggtgaactccagctcatcgctgcgctcgagcccgagcagatcgtcatgccgctccaccctcgccgaacccgcccacgaggaccgctcgcagaacccacgactcgactcgtggagggtctggccgccttctcggctggtctcggctgcgagttcgtcgtgaccaacgcacgagtccaggacctcgtcgtgctgcgcgagatcgctgagcgtgcagggggcaccatcatcgccgcgctggcgtcgacctttgctaccagcccgtcgtgaatgccccctcgggatcatcccaccacaggtgctgatcgagcacgccacgggcgatcaggttcaactgcacctgcgaggtaccctcgacgatggtgagctgcttcgcgtcgcggtagtagagctcggtcggatgatcgctcatgtaaccggccgcgccgagcagctgcagcgccacggagctcgcacgcaccgcaagttcggtggcgtagtacttcgccatcgacaggaagggcacccactcgcgggtgaaccgcccctggtcggcgagccaggctgcccggtaggtcagcaacctcgccgcctcgatctcggtcgcgagcttcgcgagctcccactggatgccctggaagtccgcgatccgaccaccgaaggctggacggtttcgcacgtacgtcgtcgcgtacatgagcgcgccctcggcgagcccgatcccccgcgcagccaccaccggacgcatcgcgttcagtccgagcatcgcgaggcggaaccctcccacctcgccgatcacgttctccggaggcacacggacctcgtcgagcagcagctcaccggtgtcgacgccgtgcacacccatcttgtggtcgaccctcggcacatccacccccggccaggaccgttcgacgatgaacgcagtgatcgcatcgtgccgacgcgatgtcggatcccctgtcttcgcgaacaccgtgtaccagtcggcctgccgcacgccagagatccacgacttccgccccgacaggatccaaccgcccggacgatcggggtcgggtactgcccgcgtccgcatgccgaccacatcggagcccgcctccgcctccgagaggccgaacgaggcccgctgggttccatcggcgatgccgggcaagtagcggcgcttctgctcctcggatccagcgatcatcaccggacccgtcggcaggcgcgacagcaacagcatcaagcccgcggtctgcgagaacttcgcgacctcttcgatcgcgatcgtcagtccgaggatcccagcgccagaccctccgtactcctcggggatgcacaggccaaacagacccgcggaacgaaagacctcgaacagatcgtccgggtacgtcccctcggcgtcgatcgcccgcgcgcgcggtgcaacgtggtcgcgtgcgatccgacgcacggtcgcctggaggtcttgatagacgtcgtccaactcgaagttcacctgcgactcctcgctcggatgccgggagcagcgtagccgacaccatgtggtggcgccagctcaccgacgtccccagcgccgtcggcgacaggcgcgggcagcgagcagcccggacccttgcgctgggactaccctgggtcgcatgctcgtcgcggtcctcgatgccggcaccacgacgcttcgcgccagcttggtcgacgacgacctgcgcatcctcgccaccctcgaggacatcacgcccatgctccgaagccgctcgggtgaggcgtcgttcgacgccaacgaactggcacgccgtgcacgccacctcctcgacggtctcgcacgccgcggtcgagcagatctcgtggcgctcaccaaccagcgcgcgagcgccgtcgtgttcgacccgacgcaccgggtggctctggccccggggatcggttgggaagatgctcgaaccgctgcgcgctgtctcgaactcgcacgccacggcgtcgtggtctcaccgagcgaatcggcgaccaagttcgagcgcctgctcgccatcgccgaactacccgaccacgcccaggtgggcaccgtcgacgcctggttggtcgtgacgctcacagggtccgcctcgaccgacccgacgaacgccgcggtcaccggcctcagcgacaccgaggcactcgcctgggacggtgagcgactcgcactgcttggcatcgcgcctgagcgactcgtcccgatcgagccgagcgtggggccccggggccacgtgcgcctcgggggtcgcgacgtcccgcttgtcgtcgtcatcggggaccagcaagccgcgcatgcgggccatccggagctgacgaaactgaccatcggcacctcggcggtcgccgatcactggctgggcgcagcaagtccaccattcgcacgacgtggcggcgccgggagcttccccgtcgtgctcgtcgacaccaccgagccacggacgttcggcctcgaggcgttctggcctgcagcgggctcgacggtcggctggctcgttcgccgcggcatccttgccgacgcagccgaggccactcggctcgccgagcgagctggctcggccgtaccgctggtcgtacccacgttccagggcgcgggcgcacccctctgggacctcggtgcccgaggtcgcatcgagggtctctccgcggcgagcggcccggcagaactgacggccggcgtcctcgagggtctcgcccacgtgggggtcacgctgttctcggtgctcgcagccgaccgagcagccgcggggtacgctccagatcttggcgacgtcgcgctcgatgggcgcgcaggccacaacccccgagtcgcaggcgtgctcgcgagcctgctcggcagaccggtcgcgctcggtgtccagccggaggccaccacgatcggggctgcgcgactcgcactcggtctaccccgtgaggcggttccgcgtgggcctctggtcgaaccaggtcgcatccggccggtccacgaccacgacagctggcgagcagccctcgaacgatcccggggcgccgtacctgccctctcagcggtcgccttctaggccctcggacaacgccgtcagcgggccgacgagtccgacgagcgcacagccggccgcctcccggtcgttcgcaccttacgcagcgtgaaggctcggaaggtgccgagggcatcgatcacgccgtcctgctcggcggtgaggaaatcgcgcagcgtcacgacgcccgcgatgaaccaaggaaccgctccaaagacccacaagatgcctgccgcgatctgttggtcagcctcgagcgagagcgtgcggagcgtccccatccattgctcataggcgctgtaccagggttgcgtcgacaacccgaggacgatcgcgaggatcatgcacgacatcgacacgatcaccatgtgcgcaaagcgcacgatgggcgactcgtgctggcgccgaggattcggatcgaccgcgacgtaccacatccagatccccgaggtgaagaagctgaacatcatgagctccatgcgcccgcccgaggccatggcccaatcgaagggcccagggagatgccagatccacatcgcagcgtcgaaggccacgaccgcagaccacggcgacgacaccacgccccacacgcgggcgatcggcgcatgtgctccgagccggccccacagacgacgcacggcttcccgaggtccctcgggcaccccggcgacgatctcaccccaggggtccgcgcggacgatgagcggtggcgcgaggatcatgagatcgaggtgccagatcatgtggacccactgatagaccatcgaccacgccgcgatcggcgagaacagcccgatggcgagcgcggccatcccacccagcatgagcagcgctcgccgctcgtagcccctgcgaagctccggatcgtcgagggtgcgcatcacgatgaggtgaccacgccaatagagcgcgatgggcagaccgaagatgatcaatccccaccagtcgacggaccagttctccaggacgtacgcaaccagaccatgtgccggctggatggccatgctcatgccaacgatccccacgtccacctcccaagcccgacggccgtggccccagtcctcaaggctagcgcagctaggctcagagcagctgagcgacgagtggcgcgcaggaggatcgggtgacccggacgatcggcgtcgtggggggcggccagctgggccgtatgctcctcgaggctgccctggccctcgatctccgcctcgccttctacatccgccccggcgagcagggagtcagcggctgggcgacgtcggtcgtcgaggggccactcgaggcaagaccactcgcgagcttcgcgaacagcgtggacgtgctcaccttcgagcacgagctcgtcgatccagccatcctcgcagcactcgaggcccaaggggtccagctcgcgcccggggctgtcgccatggcgaccggctcgaacaaggaacggcaacgagctctcttcacgacactcggcttgcccaccatcccggcccagctcgtcgaccgcgacgtgggtgaggtgcccacgctcgaacccccgtacctgctcaaggccgtccgaggcgggtatgacggacgagggctactgcgcgtcgacgcgacggttgagctcccgcgcaccgggcggtggcttgccgaaccgctcctgcccatcgcgtccgagtgcgcggtcgtcgtcgcccgagcggccaacggcgaggtcgcgacctgggatccggtcgccctcgtgcatcgggagggcatctgtgtcgaggcggcctggcccagcggtctcgaacctcgactcgagcgagacgtcgtccgtgcagcacgaaccatcgccgatgcgctggactacgtcggcgtcatggccgtcgagttcttcatcgtcgacgacgccatcgtcgtcaacgaaatggctccgcgagtccacaactccggccacctcactatcgaaggagcagtcacgtcacagttcgagaaccacctgcgcgccgtcgccggtctgccgctcggctcgacggagtcgatcggaccggccgtcatggtcaacctcatcggcgcccgacacctcgagcgggtcccgacggccgcacgcgtgcatcgctacgggaagacaccccggaccggccgcaaggttggccacgtcaccgccgtcgccgcctcgctcgacgacgcgcgtcggcgcgcctgggccgcagcgcgcgacctcggaggcgagctcctcgatgcgccctgggagcttccatgacaccccccgtcgcgatcgtcatgggttccccgtccgactggcccgtcctcgggcacgcagcgaccatcctcaccgaactcgaggtggagtgggacgcacgggtcctgtcggctcaccggacccccgacgacatgctcgccttcgcccgcgacgctcgcgacctgggattccacgtcatcgtcgcgggcgcaggtggcgcggcacacctccccggcatgatcgcggctgcgacaacgctcccggtcatcggggtgcctgtccgcctcgccgccctcgaggggctcgactcgctgctgtcgatcgtgcagatgccacggggcgttcccgtcgcgaccgtgggcatcgacaacgcgacgaacgcaggcctgctcgccgcacgaatactcgcgatcggtgaaccggggctcgccgatcgcctccaggcgtaccaggccgccaacgcggagcgctcgcgaggtgcggtactgcccccaccctcaccacactgaggaccaactacccaccagatggtcggtgtcctcgagcggctccggcgactggccgaccgatcgtcggcgcactgcgacgacgcacggcacccatacgcgctcctcgtcgagagaggaacgctcacgagcgttggctctatcaccgtcggtcggcacgacggatgcgggcaggtgcgtcgagccttcccggagatcgtcgaccgatggagcgctgtggtgcgaagcgatccacagctcgcacgcgccgagtgggcgcggggagccctcgctctcgagagcgccacgggcgcaaacgatcgatcggccatcgcgacaccgatcggctcctcaccagcgtggttcgctgtcgtttcggtcctcagcactcgaggacctcgcctcccaatcgagcggggacgaggcccccgcgaccgaaccgaccgccgccgaggccatcgtcaacgcctcgcgcgctgctcgcgagcgatataaccccatggcaactcgccggcccgatgaggcgtccgctcgcgccaaggaacaacgcctccgagtcaaggaccgcgccacacgggctcatggccgatggggccagacggccccacgcccagactcagcccccgatcgacgggcgcccgctcgaggcgtagccagcttgcaggtagagctgagaaccgacaggcgcacccgcataaccgttcaccgtttggccaaccgctggctgctgccacgaccgtgagccgatactcagctgctcgacgagagcgcctgcggccatcgtgatcaccagcgccacgacagccacgagcaaccacgccgtgactggggggatgcgatggatgggccgatcgtcgcttccacgacgcatcccgacacgccttcgcccgatcgccgccaacctgacctcctcagcacccagacaccctcaggctgcacgacgccgatgcctgcgccgtcgcacaaaccccgctggacacgaactcgttgcttccagcagccggctgccacgatcagcggacaggatcaccgacgagactcacaacctcgtgccgaggctaccaaacacgctcgtcgacgaccaagtccacagctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtgaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagttcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagaacgtcaacctgcacgtcgacagcggcgacctcgtcgagctcgcgttggccaaccgactaggacgatcctctcgatcgcgatcccctgtcagcatgcacgcctcgctaccgtaggacagcacccggggaggtgctagcgcgactcccttgcgtgcatcgtggtccttcgccgtctctgtctggctcgggttgcgaaacgcgcgactcgagacgagacaactcgtgacggttccgcctgggctccgcgaccccctcgagcccagccgtagtcgcactacgcgcagccgcctcgttctcggttgcgatggctttcaggagttcgtctcgcacgatgcgcacgtcacgtggcgcgacgatgccaaggcgcacgccgccatatggatcgatcgcaagcacggtcacgacgatgtcgtcaccgatgacgatcgattggccgagcttccgagccaagacaagcactagcgagacgtgccacgcatgagaccaacgacgtcacgagtggtcgcgacgaagatcccggcactgatccccaccaggaggacgccgatcgctccgaggaagagcatggccaagccgagggcccattgaccaacgagtcgttcgcggatcaccttgtcgacgccagcacctgcaacgaacgcgaggaggcagcctgcgagtgttccaccagcaagcgtcgccatcacgatgaggagcatgggaacgagccacgccgccgccactatgaccacgaactagggtgactgaagacgtcaataatgcaaagccaatgaaccacggccaactatgccgaagccacgaacggcgtgcgaggcgacgccggcgtcgcacgcctgtcggaatcacacttacccgcacacgcgaccccacttcggaaatggaggattacccgaccctccatactggccgttcatataccagtagagatcgccgttgggactttctaatggctgatcagcaacagcatgcgcggtagggaagctgaaatagtctgcccatgtcggcgtcgcgagcgtgacgttgagcttgccattcaccatgacccaagacgacgacgatttacacaccacgacgtcgattgcgttcttcgtcggatgcaccgcgaactgcttgttggagatactctgctgataaaacgtcttcggtgaaggcagataggtctgattggtcggcgtgatgctggcaaagaacgatgcagtcggtgcgacattggcgttcgcggtcgagaggtactgcgacagcatcgtcgacgccgggattggtccgttacccgcatacgggtcgaagagctgcgccacatccggcagcacggtgacctgaccgttctgctcggtggtggcatagctcgagctgtagagcccgcccatcaccccgagggtgcgcgccgtgtagaccgcatcgcgctcgagcggcgtgagcttcgtgccgacgtagaccgggccgacatacggcacgctggtgtcgttcacccatgcgccgagcacgctcggcttcggcacgcgcaacggcaccgggatggccgggtccttgggcggaatgagcaggttcgacagcggcaccgagttcggatcgccctggtagatgggcagatcgttcgcggcgtcgaacggatactccttctcgagctgcgcgagggtgaggttggtcggcgcaggggccgtctggctcgagctgctcgacgaggcgttcagcgagctcggcacactgggctgtgacgatgagccacacgcagcgagcaggatggcgctcgtgccgatgactgcgccggctgttgccgtccgcaagcgagtctttctgtgcatcactcccctccttgacttgcactcagtataacgcgctgaccatagtgcgtgagaagcaccgcatgatccgagtgtgacacacgagacttgcgaacgcaagggccggaggtccgtgcgtcatccctcctaccgagagatatgcgtgtgcaacgaccgttgcccgtagtaaccacaaccgatgccatcgacctactgtccgagcaggtgcagcgcgttcgagaggccagcgttgccgaggaacagaccaacgatgacagtccccacgaagacgaccatgtacgggagcaggagcaacgaagcggtattctgtcgcgagcgaagcgtctgatccacgagatctgtggtctgacgccaggtttggtcgatgagcgaccgcaggaccggcaccagaggtgcgccggtgcgctgagcctgcgcgagcgcagagcccagcgtgaccatgatcccgacctggtaggtgcgtccccagtcactccagacctcagccagtgtgcgcttggcaagaccggtcatccagtcgttcagccaaacacgcccacgagggttggcatacgtgccgtagacgcgaaagtactcgctcatagccgactccattgtgccggcgccggcggtgagagccagccggaggtaggacaggatcggtgcgatgagcagggcgctctcagcacgagcagccttggcctgactgcgaaggtatgtctcggcgaagacgaggcccccagggaacgcaatgatgatgccgacgatgccaccgatcaacgcgaggttcatggacatgagcttgatgaagacgagtaccccgagcgtcgcaacgatgagcagtaagagcatgagcgacatgcgcatgacgaaggacgcgaactcgtcggtatccatcccgagcaagtgaagatcgacctggagcagctcagaggtcgtacgccgttcgagggcgttcatcacgaagcggacggtcgccgagccgctgcgagtacgcgaggggtggtcatgccatcgcgtgaggcgtcgagatcggcggtatccaatcaagccacgtacgccggcgacgagcgcgatcgcgaacaggccagcgagaatcgagatcccgagtggtgacgagaaccaagccattgacgtctcccgaactcaaacaaaccacgtcgacagcgcgaacggcctgcgagagaagccgacgacgacgatcgtgatgaccagcaggatgccgaacgcaagctgcatgagtaggctcgcaaagagatggtgctggtagacgctggcgtagtaggcaccggcaccaagcgacgtcaagatgccaaaaccgagcaggatgcgcgccaccgtgatgttgggcacgatgtaggtgcggtaggccatctcgaacgtcgtgagctgaggcgtgatggcctcgaggaggtcctgcacgagcggcgccacactcacaatgcgcgatccagccgtgaggatgacgacctgatcgatgacgcgactcggtggatcgtcagcggtggcgatgagctgctcgatgttgcgctcgtgatcctcggggtcggtcgcatcgaagatcgcctcgtagatgcgctgacgactgcgtacgaagaggttctccgggttcgcagcaagtgccatgcgaacgatcgagaccagcgagacgttaccaccgctcgtcgcggtcgacgcgagtgatgccgcgaaggtctggaggtcgcgcagtcgttcgatctgacgttgcgcgaatgtcggcgtgacgtaggtgtcgacgaagatccacgccgctaccccaccggcgatcgcgaggatcaggtagtgcaagagaccaaaaacaacgccaaccacggcagcgatcgcgagacgaatgtcgatgctaggggatccaaaggtctgataccaagcaaccttgacctgaccaaccgtaactgaggcggccttgatcggttcctcgagcttggggtcggtgggatctgcgcgaaacacgaggagcatgccgaccacgatgacgacaacgccaaccacggcagcgacgacgagtgctccggttggggtcatggtcgaacctccgtggactcggtgagctcggtctcgagaagccgggcggtcacgaggagttgctcgagtgcgccgtggcgccgacgccggcgccggtcacgggagtcgaagacgagtgactggatatccgggatcaagacgtcgccagagagcggtggcgtcacgagcagagggatctgactcgcgccgagcgacgcacgaaccgcatcgacgaaaccgagggcccggtcagcaaggagcacgatcgctgagggcgtgagcccgtcgcgcacgagctgagtgagacgaccgaggtcgctcggcgtgggagccgtgacgaggaccaagcgctcacaactgctgagccacttgagcggtgctgacgtctcgtcaaagatgtaacctgcgtcaacgacgctgtggacacgacggtcttgaccagcaagccaatcggccatcgcggtgagcaccgtcgcgagatgagaccgcgtcaagatcccggccatgggatcggccaggagcgtcggaagagatcgggcctcttcccaccgttcgagggaatcgagcacgacaccactggcaaggtccaccgtggcagcaaggacgatgccggcggacagcgatgaggcgtgttcactgatcgcggcagcgatcgcacgctgacctggcggctgaggagcatgctcgcgatcacggatcgcccatgtcgattccatgccggcgatctcgatgagcaggcgtcgtccaggaacgctgtcagcaagcatcgttgcaaggacgcccgtcgggagatcggtgctcgtggcgacgacggcagtacgcatagccctagttgaccgtatgcgtgtggaccgacggctgaagctgcacgatggggacgggctttgcgttcggcggagcgaaggcgatgaccaggttcgaagtgtcagcgacggcagcgatgtcgctcgcctcgttcggtgggacctcgatctcgagctgcgacgaaccaccgttgctcgacgggatgacagcaaggacgggaatcgctgtggcgaccggaatgtacggtgcaggggcggtgtaggacatgggcgcgttcgacgacccacttgacgaccccgacgcctgggcctggagcggagcgtaaatgtccaccgtgtcgccagccgtgagattcggggggatgacagaaggcgtcaacacaaagacccggtagttgccacgcaggtgcggcgcgagctcgctcacgagcacgggagcgttctgtggaatcgtcgtcgtcacgacttgattgttgagcacacgcacgttggcgaccgggatcatccccggcgtgaccgactgctgtggcaccgcctcgacagcgaggtctgacttcgtcggcacttcccctgggacgagtggcttggctgccacgacgatgtcgaccgtctgcgactgcttggagaagaacgagtagaccccaagagtaacggcggcaccgagcgcgacggtaccggcaatcttgagagctacagaccgacgctggcgagcaagtgtcatgcgggtctcctttgttggtgtgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagtgagttgcgctcagcctaatcgcaagggacatgtcgtgagttgcagtgatgtgcgtgtgcctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtgaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagttcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagcatggagtgcggaggtggccgggcggccgcgggtgacctcggtcacctgaggaaggtcggggctccagagggcagggtgctcgcgagaggcgagtcggggtgacccgcaggacagtgcaacagagagcagaccgccgatggatcgacgatcgatcacaggcaagggtgaaacggtgcggtaagagcgcaccagcgacttcggcgacgaggtcggcttggcaaaccccacccggagcaaggccgcagtggagcagggtggcccgcccgtcacgctcctggtaggccgcagagatggatggccgcacaggcggccgtttgggccgctggacagaaccccgcctataggccacctcccgccaatccttcgcccacgagccaggcgccacacgattcgcaatcgacgtcccgccctgccgcgaccgcgccaaggaccgcacccgagagctccatgtgacaggccgaacaacgaccagcgatgctgagcgccaacgcgcgcccacgcttggcccgagcttcgatacgcgccctgagaccagggtcgagtcctgcgagcgcctcggcccacgccgcctccgccgtgcgcacagcctctcgacgctgctcgcgctcgacgtcaagggccgcccggagttcggcaacggtcccaccgacggcgtcacgctgggcagttacctcatcgagggaggccacgaccgagtcgcgctcctccatcgcctcgagctcggcctcgtcgagttcctcgagcctggagcgcaccatggtcgactcggcctcgagcctggattgatcgcggaagccggcatggtcgccctgtccacggaggcgagccaggcgttcaccgagttcgtcgcgttgcgactcgagcgcagcgatgcgtccctcgacctcacgacgttcggcttcgagagccgccacgcgctggacgagctcagcgtgttcggcttcagcagcacgcagtgcggcagatggccggaccgcctcgagcgccgctcgcgcacgcgagagtcgttcctcgacggtagcgatctcgatcagctcctggcccatgggcaccatcctacgccaggcagcaagagctgcccccgaacgcgcgacagactcggtcgtgccgatcgcagcgcatgcgtcacgccgccacggctctcgaggccagcgcggcggacggcctcgccaccttgagtgcacggtcagtggggcaaggcgctagctcccctcacgagggaggaccgcctccacgacgacccgggtaccagcaacgcggtcgtggagggtctggcgagaaggatcgagaaatgcgacgagatagcccgtgaagagcatgacgaacgacagcagtgagacaacgaagcgaatgctcgcgcgtcgcatgccgaccgggccaccgtcttgagcctcgacccgaaggtgcgcagccgcctggccgagcgtttgggaacgcagtccgatcagcacgacgaagtaggcggcgatggcgagtgcgttcaggacgtagtcgaacaccggcagctcgaagcggtcgacctggaagatggggttcgacaggccagcaagcccgccgaggatcagttcgaagatcaccgagccgagaaacaccacgatcaggtcgacgatgagtccccacaaccgtcgccacggcgacgcgagccgcgatccgccatcagccgcactcataccctcgacctcccgcaccacatccgtccgccacgtcgaaccgcacagctcgaccacgagcccgggaaaccacgaccgcgccagtcgatgcaccatccgggagcgcgaagtactcggcacccgtcgacctaggccacctcatcaagcctagcgacgccaccctcgggagttcctgaggtccccgtcgctcgcgcccgttcgcgccagcgtcgctcggcgaacccagctgccgccatgatcacaagaccgaggacgccgacgacgacacctgcgaccgcaacggttcggaacccgcccaccccatagaggagcgatgcgctcgacgatccagcgacgccgccgaggaagtagcacaccatgtacaccatggtcacgcgcccctgggcgcccggtgcgagcaggtagatcgccgcttgattggagagctgagccccttggatcccggcgtccagcgtcgccgtgagcaccacgaaccagagcaacgacgaccgatcgaccgccaaggcgagccacgagagcgcgatcaggctgaacgaagcgaccgtggtgaccccggcgcgtcctcgatctgcctggtggccaacgacgcgggccgccagcacgcctgccaggcctgcgaagccgaacagcccgatgacgccggtcgagaggtggaacgggggccccgagagtgcgagtgccatcgtcgtccagaacatcgagaacgcagcaaagctcaagaacccgagtccggcccgcagtcgcagcaacggctcgcgccgcaacaacgccatggccgtccgatacaacacgacgagcgatcgctccttcgcaacccgctcgtgcggcaaccatcgggcgatcgcgagcgcgagcacgatacaggcgacgcctgcgacgacgaacaccgctcgcacgcccgccacctgcgcaagccatcccgcgtaggtgcgcgcgaggacgatcccggagagcaggccagccatcaccgccgcgaccgagcgtgcgcgacgagccggctcggctgccgcagctgcgtaggtcaccgcgagctgggccaccgacgagaagaccccaagtccgagcaggccgatggcgaacacgacgacgttgccggcgaaggcgaccaggagatcgaacgcggcgctgacgacgatcgtgatcagcatgagcctgcgacgatcgaagcgatccccgagtgggaggagcgtgccaagcccgatgacgtagccggcctgcgtgacggtgacgagcagccccgggctcccgccgcgaagaccgaaggtgtccgcgatcacgtgcagcaacggctgcaggtagtacgtgttcgcgaccgtgacgcccgcgacgagggcgagcaggacgagcggaagccgaggagcgcgttgccgtggaatagttgcagtctacgaggacttcatcgccctccggaggtctctacactgaggtggcccgagcttggaggtgtccatggacgcactgcactgcgtgatcgagatcccgcgtcactcccgcaacaagtacgaggtcgaccatgagacggggaccgtctggctcgatcgcacgctgttcacgccgatgggctacccgcttgactacggctacatcgattcgacattgggcgaggacggtgacccactcgacgtgctgctgtatctggatgtgccgacgtttccagggtgccatgtgaagggtcgtccggttgctgcgttcgtgatgagcgacgaggccggtcgcgacgtcaagatcctctgcgtgccccatggggatcctcgctacgaccacattcgtgacctcggcgacgtccacacgcacctccaacgggaagtcgctcacttcttcgagcactacaaggacctcgaaccgggcaagtcggtcgcgatcgaagggtgggcccccctcgagcaagcccagcgtgagatcgatgcagcgctggcgcgcttcgagcacgcccacggcaacgcctcgccgagccactagcctggcaggtgacgtccacccactggtcgcgccagcgaccgcgagctgggaaggaggcctgcccatggactcgccgaacgacgaacgcgatcccgaggccgtccgcgacctgatcgagcagctgcggccggcggtacagtacgacggtggcgatctcgaactcgtcgacgtgaacaccgagaccggcgtggttcgcgtcaggctgaccggcgcctgctcgagctgcgccatctcgacgtcgacgattcaactcggtgtcgagcggatcgtcaagggtcgcttctcgtgggtcaccgcggtggagggcgaactcgacgaggagttcgacttcgccgcctcggcagccctcggacgcggcggctgggtaccgcttcggccccccaccaccgcgtgaggtgcacgcccactcctcgcactcggtgacgcgcgaggcgtcggccgcgctggtagagatcacgcggcccgagcgcgccaatgcgttacgcgtcgacgacgccgaggcgctcgccgcgaccctggtcgcactcgacgacgaccccggcgttcgggccatcatcctcctcggatctcccaggtacttttcggccggcgcggacctcgcagacctcgcagacgaggatgcactcgcccatatcgaccgcatccaccgcctgcttcgacaggttctcgcactgcggaccccgacgatcgccgccgtacggggcgcagccgtgggcgccggactgaacctggcccttgcgtgcgacctcgtcgtcgccggcaccagcacgcgcgcgagcgagatgttcatccaccgaggcctcacgctcgactttgccggctccgccatcttgagcgcgcggatcggtccgcatcgggccaaggcgctcgccttcttcggcggcacgctgaccctcgacgagctcgccatgctcgtcaatcgcgtcgtgcccgacgacgaggtgctcgacgtggcccgtggctgggctcacgatctcgccgagcgctcgccacgcgccctgaccttgagcaagcgcctcatcgaccaagccgcgccgtcactcggatcggcgctcgatcgcgagatcatcgcccagctcgccgcagccagcgatccagcaacacgcgcagagctcgagcgatggcgctagccccacgttggatcgaagacccgctgacaggcctcgaggccgagctcacggtcgtccagccgtaccaggcccacaagtggtatcgctgcccgggatgcaacggcgacatcgcaccgggaaccggacacctcgtggtcgtcccgaccgacgcaaacgacctgcgccgtcattggcaccgcagctgcctcgactgggagctccgccacggccatcgccgccggcaccgacgaacgtgagcagtgtcctcctagagacccgctctcgtgagcgctcggtcgagatcgccccagagatcctcgacgtcctcgagaccgaccgacagtcgcacgaggccctctccgatacggtcctctccggggtagcgtccccggcgctcggccaggctctcgacaccccccaacgacgtcgcgtggtggaagaggctcagaccatcgagcatggcgtcggcttgctgggcactctcgagttcgagggccaccaacgccccaccagccgactgctgccgtccggggccgacgagctcggagtcgaagccgggatagcgcaccgtgtcgccaaggcgatcgcgaagccgcatcgccaaggtggtcgccgtcgcgctggctcgttccactcgcacggcaagggtgcgcagaccccggaaacacaggtacgcctccacgggaccgatgatggcccccgtgagctcgcgcacctctcccacgcgcgcaacgaggtcctcgtcgctcgccacgagcacacctccgaggacatcggaatggcccgagaggaacttcgatgccgagtgcaccacgacgtcggcacccagcgtgagcggccgctgcagcaccggcgtcgcgagggtcgagtccacggcgagcagacctccgcgctcatggatccgcttcgcgagcgtcgcgatgggataggtcaccaggagcgggttcgatggcgtctcgatcagcaccaccgagccgggagcaaggcgatccaggtgcgcatcgaggtcggagggctcaacgagctcgatgcccgggatacgcgcaccgagccacctggcgagctgtcgcgttcccatgtacgagtcggccacgacgagggccctcggaccaagggcgagcagcaacgcgaacgttgcggccgcacccgaaccgaaggccactgcggtaccaccctcgagctcaccgatcagggcttcgaaggcctcccaggtcgggttcgtgtggcgcccgtaagcagaacgctggccctcgtagtaggtggcattgagcgagaccgaaggattcggcccgaagagacggtcctcgctcggcggcaactgcaagagggtcgcgatcgaacgccgttcgaccacgtcgtcctccggagtggccatgctcagctgggatcccgtcgaggaagctcctcgacgttcacgtctcgaaacgacaccacccgcacatgatcgacgaagcgcactggacggtacatgtcccacacccaggcgtcgtgcagttcgatctcgacaaagctcaatccggcctccgccttcggctgcacaacgaccgagttcgccagatagaagcggcgctcggtctcaaccacaaagcgaaacagcgggagtaccgccttgtattcctggtagagacccagctcgacctcggtctcgtaccgctcgagatcctcagcactcatcgagcaacgccgtcacgctggcggtcagcgcttctccttgaccttcgcggcgcgaccgacgcgcccgcgaaggtagtacagcttggcacgacgcacgtcgccccgggtcaccacttcgatcttggcgatcgtgggtgcgtgcacggggaagatgcgctcgacaccgatgccgaagctcagctttcggaccgtaaaggtctcctgcgcgcccgacccgtttcggccgatgacgatgccctggaacacctgtacccgctcgcgagatccttccacgacccgcacgtgcaccttgacggtgtcacccggggcgaactcgggaacgtcctcacgtagcgaatcagcatcgacgagatccgtggccttcatcttcgaccctcttgctccttgacccagcgtgcaaccaggtcagcatagccgtagcgctcgaggagcgagacctcttcgtcggcgagtccgccccgtgcgacgatcagatctggacgatgtcgtaacgttcgagcgagcgcagcggctcgccgccaacgagccacctcctggtggtcgccactgagcagcaccggggggacctcgaggccctcgaacgaacgcggcctcgtgtactggggatattcgaggagcccctcggcgccgaaactctcctcgaccgccgaggccgtgttgccgagcacgtgtggcaccaggcgcacgaccgcttcgatgaccagcagcgccgcgagctcaccgccttggaggacgacgtcgcccaccgagagcagctcgtcgaagacgctgtcctcgaggcgcgcatcgaagccctcgtagcgcccgcacaccaacgtgaatgcatcgaggtcggcgagacgctcggcctcgcgctgcgtgaatctccgcccagcaggagacatcccgatccagggatggggggcgtcagccacacgcagagccgccgcgaagggctcgggcttcagcaccatccccgcccccccgccaaagggagtgtcgtcgacggatcggcgaggatcgtccgcgaagcgacgcacgtcgatcacctcgtagtggaccgcttcgtcacgtgctgcccgcccgaggatcgactgcgtcaagaccccctcgacgagcgccgggaagatcgtcacgaccgcgatgcgcatggccgtgctcagtcgtccaggagcccgggcggaaggtcggcgaccacgtagccgtcggcgacctgcgtgatgaagatggaggggaccaaaccacctccttcgaggaccagcaactcgctggccgggttcgcctcgaccgcaacgatgcggcctcgatcgacgccatcggcgtcgacgagtcgcgcacccacgagatccggaacgatcaccatgccgtccggcagtgcgacacgctccgcccacagggagtgccctcggagctcctccgcggcttctcggctctccacgcctcgaaggcgcacgataggccggtcgggttggccccgcacctcagtgatcaccatagcgacctcgtcatcgagccacacgtgggcgtcggcgacgaatcgtcctgggacatccgagacgtggtgaagcgtcacagcgcccttcacgccgtgcgggcgcccgatgaccccaatgcggaccctcgaactcacccgcggccgcgacgccctccggatcggccccgaggcccacctcgccgaggtcgatcgtgaccatcggagaacgacacccgcgtcgacagaccagaccgctgcgcaagcgccgcgaccaccgtgcgcaccgccgtcgcggtacgaccaccgcgaccaatgactcgaccgagcgcttccgtgggaaccgtcaccgagagcgacagctcaccatcgcgcaccggctcgtggcgcacgacgacgcgctcggcaacctccggcgcgagtgatctcgtgaggtacaggacgagcgacgacgctcgctcgattgcgagcccctgcgtcggcgagatcgacggctcgctcgtcgcgggcacgttcgcggagtcgtccactactcggccgcctgcgctcgcgcgagctccaacagcttcgcaacgcgctccgatggggtcgcccccttcgcgatccacgactcggccttcgccagatcgatcgagaagctcgacggctcctggcgtggctggtaccaaccaaggatctccaggaaccgaccatcgcgaggggtccgcgcatcggcagcgacgatgcgatactgcggctgcttcttcttgccggtacgagtgaggcgtagccgcactgccatcgagagggactccttccgttccaggtgcgccaactcgggcgctcggtcgaacagtctagacgcaccgacctcgccgttacttccgcttgcgccgaggaggcttgcgtcgcttggtcgcactcggcgcgccaacacccgcttggcggagcaccttgtgcacgtcgcgaaactgcttgagcagcgcggcgacctgcgctggttgtgtgcccgagccacgcgcgatccgagctcgcctcgatgcatcgatcatggtcggattgctccgctcttccctcgtcatcgacgagatcatcgcctcgatgcgtgtgagctccgcatcatcgatgtcctggttgcgcaactccttgggaactccgggcagcatggccagtacccccttcaggggcccgagccgacggacctggcgcatctgctcgagcagatcgttgaggtcgaagcggccctggcggagacgatccactcctcgctgggctacctcgtgatccatcgtcgactcggcccgctcgatgagtgagagcacatcgcccatacccaggatgcgcgatgccatgcgatcggggtagaacggctcgaagtcttcgagcttctctcccaccgaagcaaaggcgatcggcttgccaaccacctcgcgcaccgagagcgcagcgccccctcgtgcgtcgccatcgagcttggtgaggatcacggccgagatcgagaggcgctcgtcgaacgcctgagccactcgtaccgattcttgacccaccatcgcgtcgacgaccaggaagcgatagtgcggatcgatagcctccgacaccatctgcacttcgcgcatgagggcttcgtcgatggccaggcgacccgctgtgtcgacgatgacgacgtcgcgcccaagtcgtcgcgcctcggcgacaccgtgacgagcgaccgtcacgggatcgtccccgtcgctcacgacggcgacgccggctcgctcgcccaagatccgtagctgctcgatcgcaccagggcgctgcaggtcggccgcgaccagcaacggcgaccgtccctcccgtagctgcgcgagcgcgagcttcgcagctgcggtggtcttgccgacgccctggaggccggccaggaggatcacggtcgggggtgtcgaggcgtagcggagacggaagggctcgccgccgagcacccggaggagctcatcgtgaaccgccttcacgacctgctgcccgggggtcagcgatgccgacgccatcgcaccgacagccgcctcttcgacgcgggcgaggatcgtgtcgaccacacgcaccgcgacgtccgcctcgagcagcgcgactcggatctcggcgagcgcttcgtcgacgtcgcgctgggtcagtcgactcttgcggcgaagacgacccagcgctccgtccaacctgccactcagcgtctcaaacatcggcctcgtctcctcgcatggaatcgggtcccgcctccgatccactcatgtcgagcaaggcatcgacgaagtcatcaggatcaaacggttgaaggtcctcgagggcctctcccaccccaacgagcttcaccggcaccttgaactcgtgctcgatcgcgagcgcgataccgcccttggctgatccgtcgagcttggtgaggacgaccccggtgagcccagtcacctcgccgaacacgcgggcctgactcaacccgttctgtcccgtcgtcgcgtcgaccaccaacaagacctcgtcgacgtggccggccgccttctcggcgacccggcggaccttgccaagctccgccatcaagttcgccttgttctggagacgccctgcggtgtcacacacgacgaccgcggcgccacgcgccttggctgcgtcgaccgcatcgaacacaacggcaccgggatcggcaccctgctggcccgccaccagccgaaccccggaacgctccgcccagaccgcgacttgttccgttgcggccgctcggaaggtgtccgcagcagcgatcaccacatctccccgctcgcgcaagcgcgctgcgagcttgccgacggtcgtcgtcttgcctgccccgttgacgccgaccacgagtatcacggtcggtagctctgccgctaccgcaagcgatcggtcgccactcaggaggcgagcacgcagggctctccggagagcctgccagaggtcatctgccgacgcgccgcgtcccgtctcacgtcgaacctcatcgaggaccgccgccgtcaacgtggggccgagatcactctcgagcaggacctcctccatcgtctggaagagcgcgtcccgatcgagcccgccgattcgccgacgcaggtcccggaaccgacccgatgagcgtcgcatcgcaccctcgagggtgcgcggacgagactgaccgatgaccgctgcggcttcgtccggcgctgccgattcgctcgccggaatcgactcttcgcgcgcatgcgggcccacgcgtggacgacgacgaacaagcagtgccgccgtggcaatcgcgaacacgagaacgaccagcaatacgatgtccaagaccatcgccaaagagcgtaggcgaccggcacaggagcgtcgccgaccaggcagacgccgtgctggccgcgacgtcaatcaccattggtcggtcgggcagcgccaggaccatcgctacgaattcttcctcggcaactgcaacgctgggctcagtcgtagcgattgcccctgttgccgccacaggggcgcggccctaggacaaggaggaactatggcactcggagtcggctcactgagcaagctactcagcatgctctcggcaaaggccgccatcgcgaccgcatccgccgtcgttgcgacaggcacggtggcagcagcggccactggaaaccttcccgcatcagcccagaacgtagcgtcacagctcgcggcgtcagtgggcatcacgatcccaacagccacggcagtagccccgaccgcgtcagcgacgccagccactccggcgacgccagccactccggcgactccggcaacgccagccactccggcgactccggcaacgccagccactccggcgactccggcaacgccagccactccggcgacgccggccactccggcgactccggcaacgccagccactccggcgacgccggcgagtcacgacaactcccctgacaccgcacagcaagagctccagtcttccaacgaccatcagcagagcacggatcagcagagcacggatcagcagagcacggatcagcaggtcgccaatcccgggaccacgctgacctctcctgctgggacaacgagccaggacggctcgagcagcgactctcaggcgagttcaagcacgcagagcagttcatccgacaactaaccgagcggacgctgcacgcgccacaccacaccatcgcagcgtgcaggcccagtggaacgaggagcgaacatgccggaggcggcgatgtcgaccgacgacgcgcaacgcgagtccgtcgacatcgatcgcctccgtacaggcgacccggacgaattcgggcgatgggtacgtcacgttggcccggccctacgaggattcctccgcgcctcaggagttgcagacgtcgacgacatcctgcaggatgtgtggcttcggctggtccgttctctcagtcgcttcgacggcgacgaagacggtttacgccgcctgacgttcacgatcgcctatcgatcgcgtgcggatgcactacgcgcgcttggacggcgccgcgaggtcgctttcgatcctgccgaactcccacatccgacgttgtcgccggaggacatcgatgacggcaccgtcacagccctcctcagacggctaccggagcagcaagcgctcgtgatcggccttcgtgtcttcggcggcttcgctgccactgaggtaagcgacatgctcgggatacccgatgcgaccgtacggagcctcgcacatcggggactcaaggccatggcacggctcctcgagcaacaatccccgtcgtcgctggaggcaccctcgtgagcacttccaccactttcaccgaccgcctcacggcgcttgcgagcgaggtcgcgctcgagaccagggaacaagagctactggcgacggtctgcgcacggtcgtctgcttggccgacggaactccccgacagctacgttcgcaacgtcacggagctggtcacagcagagttccgcaatctcgcagcatccaccaccagccagcgtcgtgccacacatgcgtgggcctcgtggttccgctctcgctggctcatcgtcgcggcggtcctgagtgccgcaagtgggggcgtcgcgttctccggtgccctcgcccacgctctccaccgtgtggagtcgatcgtcctcgccccgacgccaagcacccaccaagggacgctgaacggttcgcaaccagccattggctcatcggccggcataccaccgtcgggtcttcgcgaacaggggggccaacagtcctctggctccgcgacagcgacggcaaccccagcgcagagccgcgacaccggcgacgaacaccacccgcttggaacggtacgatcaatcccttcgtcatcgccaccggtcgaatcgcctacgccgaacgaccaagcacccccatccgacatcagccagcaagctggcgacgcttcctcgtcgcctgctccatcggaccacacggacagctcctcgagcccctccgaccagtcgaccagtacgaccgggtcatcgaaccagtcaaacacgacatccacgtcgcaggaccagtcgagcagtgcgaccgggtcatcggaccagtcgaacacgacatccacgtcgcaggaccagtcgagcgccgctacgtccagcgccagcagctcgaacccagacaactaggcgacgaagacccgtcggagtccgcgagcgacacgggacgtcgcgtggctagtccgtcgcgacctgaacgccctcaaggcccgcctcgccaaggtcatgacgcacgaccgtcgatactccgctcggcgcaatcgagacaccaagcagcacatcggcggcctccatggtccgtcgctggtgggtcaccacgagcacctggctcgagcgtcccacccggcgcagcagttcgaccagacgagtcagattgcgctcgtcgagcgcggcgtcggcttcgtcgagcacgagaaacggtacgggtcgaacctccagcatggcgaacaacagcgcgagccccacgagcgagcgctcgccgcccgacagcaacgccaaccgacgcacgcgcttggttggcagatcgacatcgacacgaaccgtcgccgccagcggatcggcaccagcctcgagctcgaccgaaccgcctccgccagggaagagctccccaatgatgctccgaaacgccgacccgacctcctcgaccgtggtcagcacgcggcggcgcatctcctcctcgagccgctcgagtccctcactgatgacagcccgcaccccacgggcctccgcaagcaccgcgccgagctcctctcgtcgagcgtcgagctcgcgcaactggacactcgcgagaccgttcacctcgccgaaggtccccaaggcatcttcgacctcgtgcaacgtccgctcaacgtcgttcggtgcgacatccgagggcaggcgggcaccttcgatgtcagcgagctcgacgtggaggcgaaggcaccacatctcttgctcggcggcgagccgggctcgagctcgctcggcgcgccccatcgcctcgagcaatcgctcacgcgccgtcacgagcgctgcctcggccgaccgacgttgcatccgcagccgctcggcctcggcacggtgccgcgactcccaagcaagcagcagctgcagctgctcgtcaagaccgcgcagcgtgagggcaactgcgttcgccaaagcgtgggcacgctccacgagctcacgtggtactggcgtcgcacgaaccctggcctcgtcaaggcgcgcacgttcgcgctcgagctgatcgaggcgctcccgagccgccaacgcccgctgctgctctcgagtcgcatccagtcgcacgccgacgagctgctcatcaagcgcttgccgagcccgctctgcggcctggccagcttcgatggccatcgccagtcggtcggccgccgccgcctctcgcgcttgaagttcggcggcgcgacgtccgacatcctcgtcgacgtcctcgatgtcgacagtcgggagctctgtcgcgaggcgcgcgacgaccgtcgcgcgatcgcgatcgatccgcgcctgctcggtcctgatccgctcgagatcccggcgcctcgcttcacgacggttgagctcctcgacatgcgtgctgcgacatcgctcgacaacggctcgcgcctcccgaagcgccgcatcaacggccgcgagctcctcgccgacgccctggagctccgcggcgatcgtcaccgcctcatcctcgagctgacgccgtcgtagccgcagcaacgcacgaatgctgcgaccccgccgaatccacccatcgtcgctcacccagccggcagcgtcgacgaggagaccgtgcgctcggccgacacgcacctcctcgagcacgctctcgacgactctcgcctgtgcgagtcgcgcacccagtggtccgggcgcccaacccaccgccgcactcccgtgctccccttcgacctcctcgatgacgacggcgctttccacctcgaccgtcgggtcgagctcgccgaccgactgaacgatccgcgcctcggcgagctcgccgagcgcagcaagcgcgacgtcaatgccagctgtccccgaacgcacgacatcgatcgtcagtcggccctgcccctcgtccccgacggcctcgagcacgctccgcagctcaacatcgatgcgacgtgcttcggccgtcaaactgctgtgtcgttcggcaaggactgcacgatctcgctgaacacgctcgaccagctccccggcctcggcgagctcgcgggctgcgtccgcgagcgcctcctcggcctcggccaacgctgcctcggccgccgcacgctcggcggccaacgccgcatctcggtcgttcaagtggcgctcgagctcgcggtcacgcgcccgttcgagccgcacccgctccgcctgcgcgcgcgcacgctccgcggcccgctcgcgctcctggagaagcgtctcgagacgcacgcgctcgcgacgcacctgatcgagctctgcccgcagcggctcgacgtcgacggtctcgatcgcggctcgttcctgctcgagacgctcgcgcatcagcgcgagtgcgcgtgcgcgctcctcgagtccggtcagggtcgcgaccacctcatcatgctcctccgcgatcgcccgccgtcgctggtcgcgagcacgctcggcatcgacgaggcgctggtgctcatcgatcgacgcgatcgcccgtgtcaagcgcacctcgagctcgcgaagacgccgcgcaccctctgcgaccggctccgggtccacacgaggcgcatcgtcgacctccccctcgaggagtacgagtgccgcctcggcatcggcaacgtcgcgactgcacgactcaacgtcacgctccgcagccgcaagctcttcggcacggcgctcgagcgctcgacgagccgccgcgagcgcgagtacctgccatcgggcctcgagcgcgcgacgtgcctccgcgcgctcgacctgcgcgaccagcggtcgacgttggcgtcgaaggtctcggtcctcgcgctcgagctccgccagcgcctcctccgcacgccggagttgctcgagggtcacctgccgttggcgccggagcagcgtgaccctcgatgcgtcctccagcatggtgcgcaggacgtcaccggacgccccagcgagggcatcgatctcgccctgggagacgacgacgtgttggctccgaccgatgttcgccccttggaggacctccaccacgtcctggagacgcgccgcacggccgttgattcgatagctcgcctctcccccacgctcgactcgccgggtcagagcgatctccgcgacaccaagtccgctctcgtcgtctgggtcgtccaaggtgagttcgacctcggcccgaccgagcgcaggacggtgcgcgctgccctggaagatcacctcgtccatgcgagcgagtcggagcatcctgggactctgggtgccgagcacccaggtcagagcatcgacgacgttcgacttcccggatccattgggcccgacgatcgcgttgatccccgatccgaatcgcaccgtgaccggatccgcgaacgacttgaaaccgcgcatcgtgagcgcacgtagtcgcactcagccccctccctgctggcaccgcgggcaccagtgcgctgatcggccctgcaagaccctccggacgatcgacgtagcgcacctggggcacggactgcccgcacgttggtagacggcgaggcgcgcgccaaaggcgccaggccgatcgagcgggtcgcgataggcccgatccgcgaaggtcgtaccgcccgctgcgagcgcctcccgggcgacatcgcccgcagcctcggcgatcgccacgaggcgtcgccccagcacgttcatcggggtgctcggatggacaccgacacgaaagagggtctcgtcagcgtacatgttgccaagacccgccaccacgcgctgatccaggagcgccgtcttgatcgcacgccgagacctcgcagcgtgccgttcgaggctcgctgcgatctcctcctcgggaccgaacacgtcgggaccgagccccgcgagccgacgcggccgcccgtcggtgccgaggacgtcaacgaaggcctcggagaacgtgcgcggatcgaccagtgtgatgacggcgcgacggaagtcgagaacgagctggacgtgggtcgccgtcgccgaggcgtccgagacgacgagacgtccagccatgccgaggtgcacgaccagcgcgtcggtgccgagatcgaacaccaggaacttgccgatgcgtcgcatcgacacgatcgggcgccccgacaccgtcgccaagagctccgggtcgtgccggcgcacgaggcgccgtccaaccatgcggatcccctcgagcgtcgccccctcgacacgtgcggccagcacctcgcgcacccgctcgacctcaggcgcctccggcacgctccggctccgatgggcgtggcgaggcgcggcggctactgcgacgccgcgggggtcgcgagggagcctccgtcgttgcctgagcgaggccggcagcttctgcccgacggttcgcctcgaggatcgcaaggcggcacgcctcctgctccgcctccttgcgcgacgccccttcgccggctgcctcgaagcctccaggaagctgcacgacgacccgatagcgacggtcgtgatcgggcccggaccacgagactttgtagcggggtggctggtggtgcagcttggcgagcgcttgatggagcagggacttgtagtcaccgagcaccaggtcgccatcgacgcgctccagcgagggcccgaggatcgcgaggacgaacgcgaccgagagctggaatcctccggcgagatagacagcaccagcgagcgcctcgaccgcgttggccgccaggacagggccaagagcatctgcttggccgaccgtgatcgcctcgagcagcccgccttggaccccgacggagccgagcgagcgtcgagagacgagagctgagcgcacctgggtcaggcgaccctcatcgacgtccggatagcgccgatagagatagtcggagaccacgagctcgatcaccgcgtcgccgaggaactccaaccgctcgttggagtccagcggatcgcggctcgctgacttgtggacgagcgcttgacgtacgaccggatggtcgcggagcgcagcgggaatgagctcgaggatcgaccgctcccgccgcttcgctcggctcacgcctctcgggtcacgccgagcacctcggcgacgtagtcaacggcgtcacgcaacgtacggagatcctcgagatcctcgtcctcgatccggaaggtgtgatcgccttgggagaactcggactcgatggcctccaccagctcgatcaacgccagtgaatcggcgtcgaggtcgtcgacgaacgacgaactctcgctgatgcgcccttcgtcgatctccaagatgtccgcgagctgcttgcgaatgacctcgtagatcgcggctcgagtcagttcctcaggcacggttcgactccttcgcttcgtagtgtcgaatggtcgagacgacgtctccctctgcgagctggaccgcgttgcgaatcgcactcgcgactgcccgctcgttcgaggcgccatggccgatcagcaccaggccgtcgacaccgagcagcgccgccgcgcccgtggcatcgggcgtcagctcgttccacagcgggagcagtcgctcgatcgcggcgtcggcgaccgcatcgctctcccctgctggtgccaacgccgacagcaccgcatgcgcaaaggtgcgggccgcgccctcgagcgccttcagcaccacgttgccggtgaaaccgtccgtgacgacgacgtcgacgcggtcgctcatgacgtcacgcccctcgacgttgccgaggaaggtgatccgcgcatcgccctcgaggcgcgcgaaggtctccttgacgagcgacgtccccttcccgggctcctcgccgatcgacaacaggccgacgcgcggcgcctccagcccgagacgcgctcgagcgtacaccgtccccatcaaggcgaaatcgtgcagccacgccgcttggacctcggtgttggcgcccgcatccaacagcaccgtcggggtcgcgcctggcaccggcaactcgaccgtaatggccggtcgcgccacgcccttgatccgacccaacttgagcaacgcggtcgccatcgcggcgccagagttgccgaaggtcaccgccgcaccggcgcgaccttgcttcacgagctcggtcgcgaccaccatcgaggcgtcgcgcttacgccgaggcgcgctcgcagggtcgtcggtcatctcgatgacctcgctcgccaccacacgctcgacgccgctcggcaacgccgcgagtgcctcggcggtgccgaccgcgatcacggcggctccctcagcccgcgcgatgccctccgcgaccaccgctgagccgaggtcggtccccatcaggtcgaccgcaatcggcagcacgagcccctagccctggatctcgaccgcgggacgaccgcgatagtagccacactgcggacagacggcatgggagcgcttcgccgcaccgcaactcgggcaactggccgcgccggcgaccacgaggcgccacgccgatgcgcggcgagaccgggacttcgccttggaagtcttcttcttaggaacagccatcgtctctcactcttccttgccaccgggaccgggggatcatgctagcgccccgagccaccctcaccttgcgactgtcccagctcgtcgaggatcgcgaagggaccgtcgacctcgggttggcactcgcacggaccctcgttcaggtccgcaccgcagcgcgcacacagcccacggcactcatcgcgacacagaggcagaacggggagctcgagcaccagcgcatcgtgcacgaactccgacacgtcgaggacgtcgccgtggtaaccatacgcatcgtcggtggtggggccctcgcgatagagctctcgcccttcgacgacgagtggcccttcggctggtgccaggcatcgcacgcactcgcctcgccaccgtgtggttgcacggagggtcaccagcatgccttcgccaaccgcctcgacgtgaccggccacctcgatgggctccgtcggctccacgcgcgacgacgtcaccgcgatgtcatccaagctgccgacgaatccgaagcgctccaaggcggcgctcccgtgtcgcagcgcgaccaccgacaccgcgaactcacgcatcgccgacctcctcatccagcgcctctcccgacgccagcgcactcggcaccgtaccggagcccgccgcttggagccgctcgcggccgcgccgggtcgcggtcaagagctcgtcgagcgcgatctccaccgctgccagacggcgatccaggaagtcctcggtctgcaaccggagccgcgcagcacgctccttggcatcgagcacgatgcgcgcggcttcgtgttcggccgctcgaacgatctccgtgtgcgacacgagcgcctcggcctgctgacgtgctgcgtcgaggatcgcctcagcctcgagcgaggctcgcgcaaggaactgctcccgctcgcgcagcagccatcgtgcctcgcgcagctcctcgggcaacgactccatcgcttcgtcgatgagcgcaaggacgtcatcacgtaccacgatcaccgacgccgagaggggcaccccgcgcgcctcgctcacgagggtacgaagctcctggagcgccgcgagcgtcgtgctgccgtcggagccaaccgccgtcaaggccgacccccgaggcggccatcgagcgccttggcaacgacgacgggcacgaacgaggtcacgtcgccgccgtaggctgcgatctccctgatcaacttcgacgacaagaacgagtgttcggacgatgtcgggacgaagagggtgtccacgccggacagcgtgcgattcatctgcgccatctggagttcgatctcgaagtcgctgaccgcacgcagaccgcgcacgatcaccgttgcgtccactgcccgtgccagatcgacgaccaagctcgacaacgctaccacccgaacgttctcgaggtcatcgaccgccgcagcgatcaacgccatgcgctcatcgagcgagaacagctgcgacgccttctgcgggttacgcatcgccgcaaccaccacctcgtcgaagagcgcactcgctcgctcgacgacctcccggtgcccgttgtggaacgggtcaaacgaacccgggaataacgcgcgcctcactgtgcctcccgcgctcggctcgtctggtaggcccgagcggctcacggcgccggaacgaagagcccgacctgggtaccaccatagcgccgccagcgctccgctcgccaacgctcgccgagttccaccggagaggctgcctcgacgacgacccaacgagcgttcgggagctgggggccgaggtcctcgaaggagcgccggacgtagggcggatccacgaacaccacgtcgacgtccatcgaacgcccctcggacgcgaggaaccgctcgacgctcgtcggacgaacgctgagacgggaggcgacctcgagtgcgtcggcggcacgccgcacgtcggctgcgagtcgcgcatcacgatcgacccacacgacgcaggcggcaccgcgcgagagcgcttcgaacgtgaggccaccggccccggcgaagaggtcgacgactcgcgcaccctcgaggtcgacccgcgcctccaccatcgcaaagatcgcctcgcgcacgcgagctgcggtcgggcgcgtgccgctcggcacccgcaccgggacgacccgaccaccgagggatccgccgatgatacgcagcacgcctagctccggagcaggtatgccagctggtcggggtcggcgaccagtgcgagttcccgcgcgagcctcggatgctcgcggaggctcgggtcgacctcgagcaatcgggtggcgtggtggcgtgccgcctcgaccaaggggcgatcgcgcacgaccgaggcgagcttgaggtcgctcctgcccgattgacgcgcaccgaggaccgtgccctcgccgcgcagcacgaggtcgacctcggcgagctcgaagccgtccgtcgtacgttcgagagcctccaggcgcgccgccgtcgggccctggtcggtctcggcgagaaggaagcacgccgacgcgtgctcgccacggcccacccgaccgcgcagctgatgcagctgggcgatgccgaagcggtcggcgtcttcgatgatcatcacggtcgcgtttggcacgtccacgccgacctcgatcacggtcgtcgcgacgagcacgtcgatgatgcccgctcgaaacgccgccatctgccggtccttctcgcgcgccggcatgcggccatggagcagtccgagccggagtccggcgagctccgagttgccgagcctggcgaactcttcctcggccgagcgcgcctggagccgttcgctctcttcgacgagagcgcagacgacgtaaccctgccgacctcggccgacctctgcccgcaggtagtcgaaggcctcgacgtaggcgctccgttcacgcagccacttcgtgcggatcggcgtccgccccggtgggagttcgtcgatcacggagaggtcgagatcgccgtagaccgtcatcgccgcagttcgaggtatcggtgtggctgtcatgacgagcgtgtccgccacacgcccggcgatctccgcatgacgatcgcgcaacaacgaacgctgctccacgccgaagcgatgctgctcgtcgaccacgacgagcccaagcgaagcgaggttgactccctcggtgagcagggcatgggtcccgacgaccagatcgatcgttccgcgggccaacccctcgacgatgtcggctcggcgcttcgaggccacagtccccgtgaggagggcgacctcgatcggcgctacctcgtcatcgaagaggcccggtgtgcgctcccgagcctcacgagcagtgccaagcagcgacaggatcgtgcggaagtgctgttcagcgagcacctctgtgggcgcgagcaacgcggcttgatggccgccttggatcgcgaacagcgcagcaatcagcgcgacgagcgtcttgccggctccgacgtcgccctggaggagccgatgcatgggccggtcccgctgcatgtcaccggcgatatcggtgaccactcggcgctgggcagccgtgagtgagaacgggagtcgggcgagcagttctgccacgcgccgaccggtcccaggcccgaacggagcaacgtcgtgggcgaagccacgctggtgagcatcgcgctcccgtcgtacgagaccgagcatgacctggatgcgaaagagttcctcgaaggcgatgcggcgtcgagcttcgagtcgctgctcgagcgtggccggcgcatggatggcgcggagcgcttcctcgcgcccgagcagacccagcgcatctcgcaccgccctcgggatcgtctccgcgatcggggagaagcgctcgaggagtccgagaaccgcactcgcgatggcaccagagtcgatcccggccccgtcgcgcagcggatagagcggcacgatccgacccgtacggtcgccgatggggtcgacgagcgggttgacgagctgacgctccttgcgaaagagttcgaccttgccgaacacggcgatgtcgccgtggagccgtccgagctgcttcgcacgccacggctggcggaagaagcgcagcccgaccgaccccgtctcgtcgaccagccgcgcctccaccagcgtcatggagcgcttgcgcgtcggcacgacacggacgctggcgatgcgtccgatcagcacgacctcttcgcccggaaccgcgtcggcgatcatgacgtggcgggtgcgatcgacgtagcgccggggatagtaggtcacaaggtcgtaggccgtcacgacgtcgagcgcctcgagacccttcacgaccttcggtgacagccacgcaaggtccgcaagcgccgtcgctgcgagatcctcgagtccgacgccactcattccacgccaagcaggtagggatagagcggctgccctccctcgatcacctcgagttcgacaccgtgatggcgatcgaacacgcccgcaagggccgcctccacgcgttcacgatgaccccgctccccgacgatcacggtcacgatctcgcctccgggctcgagcaagcgctcgcacaggccgacgagcacggcctccgggtccggtcccaccgacacgatgccttgatcgctgataccgatcgcagaaccggcaccgaacaccccgccctgccaggatccatcgcggacggcaacggtgacctcgccccagcgaacccgtcgcgcggcctcggtcatgcgccgctcgttctctgagagccccgactctgggtcgtaggccatgagcgcggcgaagccctgcacgaggtggacggtcggcacgatcgcgacctcagcgtcgacgagtccgatcattgccgaggccgcagcgaggatgttggcgttgttgggcaggacgatgacctgcttggcgtgcgtggagcgcacggcatcgacgagttctgcgatcgacgggttggcgccttggccccctgcaacgatgctggcgacaccgaaggaccgaaacagccgcgcgatcccgctccccgtgccgacggcaacgaccgcggtcgccggaggcgacggctcggctgctggcggcgcgtcgcgcacccaggcgacttcgccggtctgctcacgcagatcggtgacggagagatcgcgtacccgacccgcgtcgatgccgccttggatggcggcagcgatgtcgttcgtgtggacgtggcaacgccagacggtgccatcaccgacgatcacgatggagtcgccgaggccggcccagaccacccggagcgcgtccacctggcgctcgggtgcctccagggagaacatcacctcgtagcgcagctcgtcctcgcgatcggacgccaccagctcggccgccgacagatcacggacgctcgcgaccgggaccgcgatgtcgtcgagccatggatagggaccgacgctcgtcgtgagtccgagcgcagcgctcatcgcctcgaggacgacgaccaagcccgcgccgcccgagtccacgacgccagcggctgccagcaccgcgagctgggtaggggtgcgctcctcggcggctcgagcagcgtcgatcgccgcggcggggtcactggccccagcggcggcgtcgatgacgctgagcatcgtgccgggcttcgggtccagcaccgccgcgcgagcgctcgccgacgccgcctcgagcccacgcatccatccgcgcgctcgatcagggtcgctggcgagttctcgtacgagcgagcccaggatctgggccaggatgaccccagagttcccacgcgccgcgagcagagcgccacgagcgacggaaccggcgaacgccgcgcagtcgtcggtatcgcctcggcgagcagcctcggccatgccctcgagcgttcggagcatgttcgaaccggtgtccccatccgggaccgggaacacgttgagccgatcgaccgcatcacgcaccgacgccaacccggcgacggcagcctcgatcgcctgcgtgagctgtgcgcaggcactctgacgttctgccaccgcccgcatgctagcctcgaaggcccgagacgtcgccgagcctcgtcgctcgcgccgtcctcacgatcgtaaaggagaccgaatggcgagcgtctgcgagatctgcggcaaggggccgcgcgtgggcatgaagctgtcacattcccaccggcgcaccaagcgtcgcttcctcccgaacgtccagcgcgtgcgcgtcctcgaaggagccacgacccgtcggcggttcgtctgcacgtcgtgcctccgagccaacaaggtcgtcaagccatagccacgatgggcccgacgcgagcgctgctctggctctcgtttggatcacccgagcggccggaggacatctggccgttcctcgagcgcgtggtcgctgggcggggtgtcccgcgcgaccgtctggcgatcgtgcacgaccaatacctcgccactggaggctcgagccccctcaacgcactcaaccgcacgttgatcgaacgcacccgagcagcgttcgacgcagccgacatcgacctgccgatcgtgttcggcaaccgaaactgggatccactggtcgacgaggcggtcaaggagctagggaggctcggtgcgaccgacgtcctcgtgttcgcgacctcggcgtacggctcctactcggggtgtcggcagtaccgcgaggacgtcgaacggacgaatcccccattcacctggacgaaggtgccaccgttcgctggccatccccgcttcctggcagcccaacgcgagatcctcgcgtcgttccttgcgacccacgatctcgaccccgagcacaccttcgtcgtcgccacggcgcactcgatcccggtcgccatggccgccaacagtcagtaccagcgccagcttgccgaggttcgagcagcgctcaaccaggttgctcgcacctacggcctcgtcgtcgaggaggcctaccagagtcgctctggcgatccgcgcacgccgtggctcgagcctgacgtcggcgatgcgatcgaccgcgccgccagcgagcgcacgctcgccgacgtcgtgtgcatccccatcgggtttctctcggaccatcaagaggttcgctacgacctcgacatccttgcccgcgaacgcgcagaagcccgcggcgcgaggttctggcgcctcgagaccatcggcgaacacgggccgatccccgagatcgtcaccgacttcacccaggcctggctcgaggggcgagacctcagatcgctcctcccgtctgagccggccctgtgcaccggcacctgctgccagcccctgcacgctcgacccagcaggagtgtgtcgggcgcgtaacgactcgatgacacctccggccgacggcgcgggatcgttgcgggtcgagttgctcgtggcctaccatggtcgcacgacatgaagagtgcgaacgaagtgggggcatcgtggttcagcgacgtcgaagtcgggtcctgaccgtactggcaggcgcagccctgttggcggcgtgcggcagcactgcccagagcggttcatcgagcacgtcgagttcgtccgccgcgaacggcatcatcaccttcgccgaacaacccggtgcgagcccgaactggatcttctggctcacgcccggatccgacttcaccgttgcgaacaacgatcagttccagtatctgctgtggcgtccgctctacgtgttcggcaatggagcaaaggccgagatcaactacgcgctgtccatcgggaatgcgccggtgtactccgatcacgaccgcgtcgtcacgatcacgctcaagcattggatgttctccgacggccagcccatcaccgcacgaagcgtggtcttctggatgaatctcctcaaggccaacaaggccgactggggcggctacgtacctggtcagttccccgacaacgtcgcatccgtcaccgcggtcaacgcatcgacggtccgcttcgacctcaccggctcgttcaatccgacctggttcacctacaacgaactcagccaggtcgttccgcttccgatggcgtgggaccgcacctcgctcggcgccccagccccgaccgcctcgaccccgaacctccccgacaccacgacccaaggcgcccaagcggtctactcgttcctcgccggccagtcgaaggatctcgccacgtacgcatcgagcccgatctggtcgatcgtcgacggcccttggcgcttgaaggccttcaccacggacggtcaagcgaccttcgtccccaatccggcctactcggggccgatcaagccgaccgcgaaggagttcatcgagctgccgttcacctccgacagcgccgagtacaacgtcctcgcgagcggccaagggcagatcagctacggctacatcccgagtaccgacgtcgagcagaccgcgcacatcacccagctcggctaccacgtctcgccctggacggtgttcggcttcaactacatcccgatgaactaccacaacccgacctacggcgctgtcttcgggcagctgtacttccgccaagcgctcgaacacctcatcgacgaaccagcgtggatctcgaccttcctccacggtgacggaacgccgacctacagcccagtgccggtcagccccgccaatccgttcatcgataccacgacccgccgtccggcctacccatattcgccggctgcggcacgctcccttctcgagtcccacgggtggcggctcgtcaacggcatcatgacgtgcgagtcgcccggcaccgctgccaacgagtgcggcaacggcgtcgccaaggggacgagcctctcgtcggtttcgctcgcctacgcgagcggcgtgccatcgctcgcccaggagatggaggcgttcgcctccgcagcccacagcatcggcgtcaacatcgtgctgtcctcgaagcccttcgacaccctcctcggaggactcggtgcatgctcaccctcgcaagcactgtgctcatggcagatggtgaactggggcggcggctggacgtacggtccggactacctgcccacgggcggcgagttctacctgccaggagcaggagccaacccggagagcttcgcagaccccaccgcgacctcgctcatcgacgccacccacaccgccacgaacctcaccccggcccttgatgcctaccagaactacatcgccaagaccctgccggtgctctaccagcccttcccggcctaccaagtctcggcgatctcgacgtcgctccacggcgtcgtccagaacccgtacgggatcttgtatccggaggagtggcgccagtcctaagcgccgagccacggatcgcgaaatccgcggtggccgcgcgtgagggcgacgacaccgtccggcccccaggatccccgacgatacgggacaaccgggttgggatgcgcgaggatcggatcgacgatccgccaggcctcctcgacgacgtcctcccgggcaaaacgtgctcggtcgccttcgagggcagcgaggaagagcacttcgtacggctctggcgaccgaccgagttctgcccggaacgagaggtcgagatgcaccggcgcgagatggcgctcctcagcgtcgagcgactgcaaggtcacacgcagcgccgaatcaggatcgatccggaggatgatctcgttggcctcgaggtgctcgggcagccccaaggccccgagacgtggagggcgccgcaggacgaggcggacctcggtcgcggtcaccggcaaagccttccccgctcggaccacgaccggtacgccatcccaccgccatgaatgcacgccgagcgcgagcgcaatgaaggtctcggtcgtcgagtcggccccgactcccgggatggaccggtaaccctcgtactgaccccgcacgacgcgactcggctcgatgaggtccatctctcgcaggaccgccacgcgtgcgtcccacagtccatcggcaccaggccgactcggcggctccatgagcacgagcgccaagagctgcaacaggtggttgacgaccacatcgcgaagagctccaactgggtcgtagaagctgcctcggtcctcgactccgaagtcttctgccatcgtcacctggatctcctcgacgtgttctcgacgccacaacggctcgaggacctcgttcgcaaagcgaaggtggacgaggtccgcgagcggttgcttgccgagaaaatggtcgatccgcaggatggattgctcatcgaccacgcggtggagtcgttcattgagagcctgcgctgaggcgaggtcatggccgaaaggcttctcgatcaggtaggtgacctcgctcgcgatcggctcgcgctggagattctcgatgaccggcgcgaacagagcaggggggatctcgaggtagacgagagcctggtggacccgtcccacggccgaacgcagcgcatcgaccgtgtctcgactcgtgaagtctccacgcacgtagcgcaagcgtcgcccgagccggtcgacgaccgagggcttggcgtccgcgatctgcgagctgacggactcgcgcatcctcgtctcgagatcgcccgtgctccagtcgtccagcgcgacgccgacgatcggaaagtcgagcgccccacgctcctcgagacgatagagcgaggggaaggtcatcttacgagcgagatcaccgctcaccccaaagatcacgaagacatccacgaacgagcctcctcctaggggcgcagctgcgccccccacgtcgcctccagaccttcgccggccgtgagctgccagatatcgttgcccgtagcgagcgcgttcggcggcgcggtcatcggctcgacggcaagcccgcaccgacggcgctccgacgcgagcgtgtcgccgctgaagagctgaaggtatcgatacggcggtgcagcccatagtgcagccaccgcaccgtcgacgccggtgagcaaggcccacgcccgatccgcgccgagaagatcgagccggatggtgtggtcgagccgccgaccagcgagcgcgatgcccgagccgacgtctgcaagttctcggtcctcgctcaacgcagaaggcacctgaagccacgcgccatcgatggaacctgcgcccggagagaggtacgggtgatgtccgatcgcgacaggagccgactccgatccttcgttctcgacgatggttctcacgacgagtcccgcgtcacggagctggtagtgcaccgtcacggcgaggtcgaagggataccccggtgttggcgggatccgggtcgcgagcaccacttcgttcgttcgcgcgtgctccaacgtgaagggtcgccaccgaacgagcccgtggatcgcgttgcccgccgacggctcggtgaggtcgagctggaattcggacgtggccactcggtaacgaccgcccagcacgcgattcggccacggaaccagcacggcaccgtgcgcgccatcgcagacggagtcctcctcgtacggatcgagcaccgctcgattgccgcgcgtgaggacccgaatacccgctccgacctcgacgacgaccgcacggtactcgccgctcaccagcacgaactggctgccggacggtggtcgatgctgggtccctcgcacgcgcccaccctacatcggtcgccacccgacctccaagtgccgcgcatcgaagcgccctgctgtcgcccaggacatcgctcgacaccctcggccgggccgagcacctcggtcacgacagccgacagcgtgagagcagcgttgaccctcacgacggccacgagtaccagactgcgcagccgatctcatcgtctcgccgaactcgcaccgagcaacttcggagctccgcgatggacgaggctcctccgacagcgcggtggccctctgcccgatccatgacgttcggcaggcggaaccgacatacccgggagcacgcagcgatggcaccttgtccgcgagccggtgtgacgaatcgcgggcccagagcccgaggctcggggcggtcgcaccctcttcggcgatcaccctcccgatccgctcactacagtggctccacaagacggcccagcgcgcgatccacgtgcgacaacgggatactcgggacctcgacacacagcagaactctcgagacaccgcagagccgacgactcgcagccgtgcctgagggaagaagccgccccttcgggagtcagaacgagcagccccaacgggattcgaacccgtgtctccaccttgagagggtggtgtcctaggcctctagacgatggggccagagtgctcgaagcagcatagcgggctctggccctgcgagacgctactcgcagggccagaggtgcagagcgaatcaggacgacggtctagcgggaatccgaagctccaccctgattactgatgcttcggtagtacgagcgccagatcgcacggtagagcggcacgtgctcggggagtcgacgcaacccagggatgtagggcacgaacgcaaaggccaacgtgaggaccgccatgatcgccatgacctcgacgtcggcgttggacgaactcgccatcgggttcacctgataccagaacgtgtacagccacagccaggactgtcccgggaagttgccggtctcgttggtcatgccccactgcggggtcccgaggaggtgtcgctgggccccgaggttggcaaagtactgaccatcggcgaggaacatgagcggcttcgtgtagttcgttccgtagaaggcgctgtgcgattcgagggccgcgtccagcccaccgctccgtgcgatgacgagcaggtcactcaggagcgtcggaatcggcccgtacgatcctcgcggcacgatgagccgtgagcccacgacacgtagatgggcatcggccttcgcgaacgcggcgttccaagcggcgcgctgagcggcggtcgcatcgttgtacgtcgccaaggctggcgcaagcccaggagtcacggcctcagccaggcgcagcggctggaggacgaaggtctgtgccgcattgatcggttgggtgacgcccgcgagcttctggagggagatcggtccgaggttctgcacgaagccggtcccgttgttgtagggcggaccgtaggtggccgtctccgacgtacccgcaagctcggtcgcggcggtctgcacgaagtccaccggatctgccgtcgcccactgacggatggtcaccgctggatcatccggcgagccgaacacgatcgacaggccgagcgtcagcactgcaaccaccacgaacgcaatggtggcctccttcaggatgtcgtacggccgcacgcgtccgcgccacggcttcgcctcggcctctcgcggcaccgagccgatcggtgggaccacaccgcgataacgaaccaggaggacgtgaatcgccacgacgagcacgacgagcagcggcagcagcaagatgtgccacatgaacatctggccaaagttcatgacgttgaagaaggccccgataccggtggcgttcatggcgtccttggcctgcgtcgagatccattgtgagtcgaagttctgttggctcagatacccggtgaacgctgctccgatggacaggaggaacgcgagcacgccggtgatccacgtcatcgcgcggcgcccgcgccacgccgccatgaagaacttcccccacagatgcacgaccatgaagaagaagaacagttctacgctccacaagtggagggaattgacgaaatggccttcgggactcccatgccaccagtccgggcccttgagggcgaggatggcaccagagatggcgaccacgaccagtgcggacaacgtcaggacgccaaagacatagatccagcttgcgacgtagatcggctgtgtatctggcagcagcttctcaggtggcagcttccccgtcagggtctggcgaagccgatgggtccactccctcgacaacgtctcgggcgcgacgccgtcctcggtcgagatcggctggtcggtcttcatgaccgcctccgatcgtgcgacggaaacggcagtgcgagagccacgatgaacacgacgatcatcaacgcgatgatcaccgcgttcgccaccgtgatctggatcacgccccattggatgtagtgctgcttgccgttgagattgatcaacgcgccaagcacgagtggcaacaccaccccacctcctcatattcgcatgctgagaccaccagcacaggacggataataggcgatggcctcgtcgatcaacagggtcctaggtccccgacagaccgggaccctgggcagatcacggctacagagcgctgggggggccgtacgccgcagcccgtcgcgcatggtcgatcaccgtccgaaggtccgcgaacgcatataccagctctgcagtaagcccgcgaccacgccagagagctcgacgcgctcgctcccaccctggcgcgtcagcatatgctcgccccggtccgtcgaaccagtgctcgagcgccagcttctcgcgtggcgcaatgccccgatgccgttcagccgccgcaagggtcgagagcacgatcaggtcgtcgacacgccagcgcggaatgtcgatcggtgtgaaccgagtggactggatgagggcctgcaccgaggcgagcgaacccgggcgcgcatagcgataaccctgcacacaactaccaccgagacggagccacagaccgatctcctcgtcgacctcgacgccctcggcaaccacggacacgctgcccgtctcctcgagcgtcgcgagcgcagcaagcaccgaaaaggcatggtggtcctcacgcgcccgttgcacgaagctgcggtcgaccttcacctcgtccacctgcaagcgcgccagtgccgacagcgacgaagccgcagtaccgaagtcatcgagggacactgcgatgcgacgagcgcgcaccgccgccacttgcgccgccgcaagctcgaggtcttcgagagcgacgtcctcggtaatctccacgaccagtagggagccgcgaggcacgagctcgtccagatcgtcgaggaactcaccgtgcagaaagtgtgatggcgtgatgttgacggcaacgggaaccccgttgagcctctcggaatagtccgcgccggtcctgagtgcagcacgcccgagcgagcgtgcaagctccggcgcggcgcgaagctccgcgacgacatcgacggtcgcgatctcgggccagcgcaggagcaactcgacaccgaccacggtgccgagacgtgcatcgaccttcggctggcacgcgaaggtggctgcgcctgacgccagcgcatcgaccagcccatcacgcacccgccgacgccgctggacccgctgcgaaacgtcgccgccgtagcgaacccaccgggccttccccgccgccttggccgcgtagagcgcctcgtcggcggccatcagaagctcgcgagtcgtgcgcacgtcgtcgggcgccagtgcccacccgatcgacccggtgatgcgccaccgctgcccgatcgtgcgtaccatcacgctgatacgctctgcgatctgatctaggcggtgacgtgccgatccaaccagtgcgaccgcgaactcgtcgccaccgaggcgtgctacgaacacgtcgggggcggcgagccgagccagcgcgcgcccgagcgcagcgaggagttcgtcacccttcgtatggccgagcgagtcattgacgtccttgaagccgtcgagatccaagaatccgaccgctaccggctcctgcgcgacgagtgcgttcaatcgaacctcgaaggcggagcgattcatgagccccgtgagcgtgtcagtctgagcaagtcgctgctgcagcgcgcgctctcggtcgagtcgatcacgaagcgcgacctccgccataccgaggccgaggagttgggcaccggtgccgatgaccgaggccagccgcagctcgtcgacgccagcgtgagccaggccgactccgagcgtgtcgtggggcccatcggccgagccactcgtcggaacctgaacgagtaccgcgtggcgccacccgcattcggtgactgccgcgccagcaccctgctcgacggcgacgagctgcccgtgggcaagatcacggactcgacccaacgtgtcgaccacgattccctgcgatggccccacggcgcgggtgagtgcggtcgcagcacccggcggcacgcgcagcgctcgcacgatctcgctcgcacctgcgcgagcatcccagcgagagagccatgcccccgccaccaccccagagttcgcgagcgcccgcagcacggcctcctggacgtcctcgggtgcgcccgcagccaccacagcagcactggcatcgaggagtgatcgcgatacctgcgcgaccgcctcagtggtacgcaatccctgattgcgctcgaggcgagctcccgcagcgccaatcacgtcaccgagctggtcgaagagcgcatcggtgagcggtccatgctgctcgtcggcgacgctcaccatcaccacgcccatgagctcgccttggctgacgacgggatagcggaccaccacctgcccatgggcgaggcgcccagcggtgcgatcgagacgatatccagcccagctggcggcgacgccagcggtgagaacgcgttcgcgatgcaccgcagcagcgatcagcggcgcctccgctgcgcgcgcggggtcgaccacgacctcgacgacctcgagctcgcgacgaacgtcgtcttccgcctcgacgtggacgagtcgaaggacctcgaggccgtcctggcgacccgcgtgctcgtagaacgcagcccggtcgaccgcaccgcagccgaccagcgacgccgtcaccttggcaaagaactcacgcgacgaggactccgcactctggaggatcgtcgctcgcacctggtcgagcgcctggcgccgacgctcgagtcgcgccatcgcacgggcgcgaaacagccgtgagagctcgtgaccgagtgccgcggcgatgtcctcgacgtcgtcgggaagctccgctccccgtggacgatagagcgcaatgacacccgatcggtgcagtgagatcgacaccggggccacgactgcggagccgagtccccacgcgtcagccatcccgcgccaaagtgcaaagcgcgcgtcgtgcggcaatccggacacggtgacgcgcccggtccgcagtgcacgcccaaccggcccctgaccagcaggcagttgctcatcggtcgagagcgtcaggcctagggcatagggcgtcgcgacccccgctgccgcccgtaccaccacgccgggtccgagaccactgtgaggggtcccctctgcttcggcccagtacacgagcgggagaccggtgacacgaaccaccagatcacagatgcgctcgatggcgtcttgctcggggaggcccacgaactcgtcgaaactgttcgcgagctccacgatcgcgcgctcgagcgcatcgcgcgcctcgagtcgctcttcggcgagcatgcgcatcgagcgagagagtgcgcgctcgtgcgcgacgacgaggagcgcctcggtgccgagtccctgctcgacgagtacctgctccagcagtgcgtagatctgggccgcccgatcgaactcgacaccgatacggtgatgcatgcgcgcgatctgcgcaacacgctcgtcatcgacgtgccctcgctcgagggtcgaggcgatctcatcgaggactgcgtcggtcaacccggcgacgtcgacgacgttctcgtcgtcgagctcgagcgccgaatggacgagccgatcgagctcggcacgaaccgtagcgcgcacggcagcgagcaccgctgcgatccgtgcctgccccatcagctcgcttctcctacgcgtcaccttgcgacgagccgcccgacatcaacgcccgtggagtcgggcaccatggcgaagcgtagtgcgggctcaccgactcgactgagctatcggctcgaaccgcccgttccttagacggctgctcgatggcggcctctcggtctcaagtggcacccccacccgagaccgagcagaatgtgggtatgactgccttcgagctctcgcaagagcaagacgcctttcgtgccgtcgtgcgtgccgtcgcggaagagcggatcgccccgcacgccgccgacgccgaccgttctgcttcattcccatgggagagcttcaaagctgctcgcgaactcgagctgcccgcactcggcatcccccaggcctacggcggccagggagccgaccacgtcacccaggcggtcatgatcgaggagatcgcgcgggtgtgcgcgtcgacctcgctcgcgctcctcatctccaagctcggcatgaccccggtgatggtctggggttctgaggacctgaagcgacgctacctgccgcgcgtcgccagtggcgaggcccaggcgtcctactgcctctccgagccagacgctggatccgacgtcgcctcgatgaccacccgtgcggtccgcgacggcgacagctacgtcctgagcggcacgaaggcctggatcacgaacgccggcatctccgacacctacaccgtgttcgccaagacggaccccagcgctggccatcgcggcatctctgccttcgtcgtcgaggccgactggggcgtgcaggtggccaagctcgaacacaagctcggtgttcgcggttctccgacgggccaaatcgtcctcgacgaggtacgcgtaccggtcgccaatcggatcggtgaggaaggtcaagggttctacatcgcgatgggcaccttggatcgctcccgtccgatgatcggagcgcaagccgtcggcatcgcgcagggcgcgctcgacgcagcggtcgcctatggcaaggaacggcgtcagttcggtcgccccatcaccgacaaccagggcatccagttcaccatcgccgacctcgccacgcagatcgaggccgcccggggtctcgtctatcgggcctgcgctcggatcgacgccgacgagcccggaaccgagctgactcgcctcggcgccatggccaagctcttcgcatccgacaccgccatgcgagtcaccacggacgcccttcagctcctcggcggctatggctacaccatggacttcccgctcgagcgcatgttccgcgacgcgaagatcacgcaaatctacgaaggcaccaaccaaatccaacgcatcgtgatcgcgcgccaggtcctgaaggaggtcggagcatgaccgtcacacagctcggcgtcgtcggtggtggcctcatgggatcgggcatcgccgaggttgctgcacgacgaggcatcgacgtggtagtcgtcgaggccacggacgacgcggccaaggcggcactcgggcgcatcgagcgctccatcgcccgcggactacgctcgtccaaactctccgaggcagaggccgaggcagcccttgggcgcatcagcgtgacctccgacctcgaggcgctcggcgatcgcgacgccgtcatcgaagcggtgatcgaggacgaagccaccaagctcgcggtcttcgccaagctcgaccacgtcgtcacccgcgccgatgcgctgctcgcatccaacacgtcgtcgatcccgatcatgaagctcgcgatggcgacccaacgacccgagtacgtcatcggcattcacttcttcaacccggttccggtgatgcccctcgtcgagctggttccgtcactgctcacctcagaggcaacccaggagcgcgctcacgccttcgcggccgatcagctgggcaagcacgtcatcaaagccaaggaccgcgccggcttcatcgtcaacgcactgttgattccctacattttgtcggcggtcaggatgctcgagtcggggttcgcgaccgcagaagacatcgataccggcatggtcgatgggtgcgcacaccccatgggccccctcgcgctcgccgacctgatcggcctcgacacgaccatggcagtcgccgaatcgctctacgaggagttcaaggagcccctcttcgcgccgccgcccctcctctcgaggatgtgcgaggccgggctgctcggccgcaagagcggccgtggcttctatcgctacgacgagccgagcgcaccgaagggaggctcctagactcgtcctccgcgccctacccaaggccgaggaggtgtcatggcccctgagcgcgtacgcttcgcgccatcaccgacgggcatgttccacgtcgggtcagcacgcactgccctgtacaactggctcatcgcgcgccagagcggaggtacgttcatcctgcggatcgacgacaccgacgaggagcgcaatcgcgaggcctgggtcgacggcatcctgcgcgccatggagtggctcggcctcgactgggacgaaggtccgctccggcagtcgtcgagggccgagcgctaccgtgccgtcgccgaacggctggtgagcgaggggcacgcctattggtgcgattgcacgcgagagcgcgtcgaggcccgcaagcaacccggcgaagcgccaggctacgatggcttctgccgtcaccgagggctcgggcccggcccggggcgcgcgctccgctttcgtgtccccgaccatgacgtggtcgtgacggacctcgtccgaggggaggtgcgtttcccggccggctccatcgaggacttcgtcatcgtcaagtccaccggtcagccgctctacgtcctcgccaacgtcgtcgacgacatcgacctcgccatcacgctcgtcctgcgcgcggaggagcacctccccacgacgccgaaggcggtgttgctgcacgaagcgctggcagcgccgccgccgcgcttcgcccacctctcttttctcgtgaacgaccagcgtcgcaagctctccaagcgccgcgatcgagttgcggtggaggactaccgtcagatgggcatcctcccctgggcgctgctcaactacgtggcgctcctcggatggagcccaggcaccgacgaggagttcttcagccgtgaggagctcatcgctcgcttcgacctcgctcgagtccagcactctcccgccttcttcgacgagcgcaaactcctggcgttcaatcagcactacctccaggcactgccacttgccgagctcctcgagcaaggccacgaccacttcgcctcgatcggcgcgttcgccacccaacaggcaaccgagctgctcactcagctccttccactcgtcgtgcctcgagcacgaacactgtccgaggcagcagcgatgagtgcctttctctttgcggacccacccatcgccccgaacgagatcgaggcactccggtcggagtccgcgtcgtggctcggggcgatcgccgcacgtctcggggagctcgagcgcttcgatgccccctcgatcgaagcagcccttcgggcgctcgccgacgagctcgggacgtcgctgcgccatctccaagcaccgctgcgcgtcgccgtcaccggcagtcgtgtcggacccccgctgttcgagtcgctcgcactcgtcgggcccgaggccacgctacgacgcatccatgctctccgcgtgaccctcgaggaccggacccaagcacacgccgggtaagctcagctctgcccttcgggggtggtgtaattggcaacacagcaggttctggccctgccattgggggttcgagtcctcccccccgagccgaaggctgcgcacgctccccgcgagcacgctccgaactgcgcgtgccgctggtcgagcgtgcgggccaccgaatggcgtctggccgaggcgatcgatctggcaaaggtgggcaactcggccacgccatcgatgacgaccgtgtagaacgtcgcgtccactgtcgtcgctcgtgtgccctgacgcctccgtgctgcgaccgcgtggaacgggtgagccgacgcacgcgccgcttctgcgagcctcgcgtcgaggcacacccgcaccgcgcctctcggccacgagctctcatgagccaggagctggtcgatgacgacggggacaggtgagacaacgggagcgccagctcgacgcggactcgcgacgagctggcgccgacaccctcgatcccccgacgctcagggcgtctcgcggttcgatgccttctcgcgcacccgcgctgctcgattgagcgcattcaagagcgcacgcgcagaggcctcgacgatgtccgtcgacacgccacgcccactcacctcgtgcccaccgacgtcgacggtcaccgcgaccgatcccagcgcatcggccccgcccgtcaccgacgtcaccgagaagccggtgagccgtgcctcgagggccgtcgcctcggcgagcacccgaccgagcgcgtcgaccatgccgttgccggaggccgaggcctcgaccggggtcccatcgacgagcacggtggccgacgccacggcctcgcgacccgttcccgcctcgacccgaaagctcacgagctcgaaccgatcggcgagcgtcgtgccgagctcttcggcaacgatcgcctcgagatcggcctccgacaactcgaccttgcggtcagcgagctccttgaagcgctggaaggtcgcgttgagcgcatcaccctcgagcgcgatccccatgcgcgccaacgcttcttggaaggcgtgccgaccagaatgcttcccgagcacgatttgggctgcctcctggccgacgctggcagcgtcgatcacctcataggtggagcgatcggtgaggacaccgtgctgatggatgcccgactcgtgcgcgaaggcattccggccaacgaccgccttgttgtactgcaccggatagccggtgagccgcgagacgagtcgagaggttcgcgcgagctcgcgcgtgtcgatcccggttgtgacgtcgccgatcacatccgaacggatcgcaagccccatcacgacctcttcgagtgcggcgttccctgcacgctccccgatcccgttgatgcagcactcaacctggcgtgcacccgcggccacggcggccagggagttggccgtcgcgagaccaaggtcgttgtgacagtgacacgagatcacgtaggaaccggcgacctcccggcgcaccgactcgaccatgcgcgcgaaatcccagggaatgccgtagccaacggtgtcggggatgttgagcgtgctcgcgccctcgtcgacggcgacctggagcacgcggtagaggaacggcagcggcgtgcgcgttgcgtcctgcggagagaactcgacgtcgtcgacgagctcacgtgcgcgagcgatcgcgcgacgcacggcctcgaccacctgatcctcgctcatgcgcaacatgtgctcgaggtgactcggcgacgtcgagatgaagacgtggatgcggtggtgctccgcatcgcggaccgcttcgtagcagcgctcgatgtccgccacgtgggtcctcgacaggccgcagatcacagggccgtgcacctggcgcgcgatctggcggaccgcgtcgaagtcgccctggctcgcgaccgggaatcccgcctcgatgatgtccacgccgagtcgagcaagctgctcagcgatctcgagcttctccaaaggatcgagcgagatgccgggcgcctgctcaccgtcgcgcagggtcgtatcgaagatccgaatccgctcttgcgttcctacctcgtccaccatgttcctccccaacgtcgatcacccaatcgtctgtgcgttgccgctcggagcctcgctcccccagcgctccgagcggccagtgttgcccgaatacgagacgaccctcctgccggaggcaaggagggtcgggccagccgcgatcgcggctggcctaggtaaggagctgctcgctacgacgcgcacgcacgcacgacaccctagaggccagcgacggcacacgtgaccgtccgggcataaatgatgccgtcggtggcatccagctcggtcaacacctcgtccgggatcgggccgtcgacgccgagcaccatcagcgcagtgccatcgtcggtgcgcggcgagaccgccatggcgtcgatggagcgaccggcctgcccgaggagcgagcccacgaccccaaccatcccaggtcggtcgacattgcgaaccaccagcatccatcgcgacggaggaacctcgacccagtggccatcgacaaggacgacccgtggctcgctcgcccgctgacccgcgagcgtcccccccaccacgtgcgcaccagagcgcacgacgaggagagagtgatagttcgccgaggcgacttgcgtcgactctcgtaccgacagcccacgttcggccgcgagctgcggcgcgttgacgtaggacacgggctcttcgaccgcaccggagaggatcccacgcaagacagcgagcgacgcgagtcgcgtgtcctccgaggccaactcgccctcgtaggcgatctcgagctgctcgggaagcttgccctcgatcgccccgagcaatacaccgagcgcctcggcgagcgggaggaacgagcgaacgagctcggatgcttcgcccgcattgacgttgaccgcgaaggggacgaactcgttcgcgagcgcgagcaggacctgttcggcgatcgtgacgccggccttggactgcgcctctgcggtggaggctccgagatgcggggtgagcacgacctgatcgagccccacgatcggcgagttggtcggcggctcctcggcgaacacgtcgagtgctgcgcccgcgacgtgcccacgggcgatggcctcggcgagcgctgcctcgtcgatgatccctccacgagaagcgttcacgatccggatgccgggcttggccttggcaagcagcgccgcgccgacgagccccacggtctccttcgacttcggcagatggatggtgacgatgtcggacgtcgccatgagttcgtcgaggtccagcagggtcacgcccatcttgcgcgcgcgctcctgcgagatgtaggggtcataggcaacgagccgcatgccgaacgcgttggcgcgctgggcgaccaacgccccgatccgccccaggccgatgatgccgagcgtcttgccgtagagctcgacaccctgaaaggcgctgcgccgccactcaccgcgctgcaccgacgcgtgggcctgcgggacgtgtctcgccagcgccagcaggagcgccagcgtgtgctcggcggccgacacgatgttcgactgcggggcgttgaccaccatcaccccgcgcttggtcgccgtctcgacgtcgacgttgtcgagtccgatgccggcacgacctaccaccacgaggtggtgagccgcctcgagcacgtcggcggtgaccttggtcgcagagcgaatgatcagcgcgtcggcgtcggccaccgcctcgaggaggccatcgtggtcgagcccggtgcggaccaccacctcgtgacccgcgtcagagagcagctggaggccctcctcagcgatcgtctccgtcaccaacactctcgccatcgcgcgctccttctccctgctcagccctaaagcctaccaatgaactcagcaattcggcgaaccccctcctccagggcatcgtcgccgagtgcgtaggagagtcgccacgccccagggccgtcgaaggcttcgccgggcacgaccgcgacgtgcgcctcctcgaggagccgagtagcgagctcgagcgcgctgctgcttggcatctgcacctcgaggacgcgcgcgagcgacgggaagacgtagaacgccccgtcgggccacagcacgtccaacccttcgatgccagcaagagcgctcacgatcgtcgtgcgccggcgcgcgaacgcatcgcgcatgggcgccgtcgcctcgagcggggcctcgagagcggcgatcgccgcacgctgggacacgttggcgacgttggacgacagctggctctgcaggttcgccaccgcggacgccaccggtgccggggccacgatccaaccgacgcgccaacccgtcatcgcaaaggtcttcgcaacgccgttgacttggatgagcctcgcctcgagggcctcggtgcccacctccgcgagcgacgtcgcgcgctgccccgtgtaggtcaggtgctggtagatctcgtcggtgagcacccagatcccggcccgctcgagaacctcggccagcgctcgggactcgtctcggctgtagaccgccccagtcgggttcgagggcgagacgtggatgaacgcaacggtgcgatcggtgatcgccgcctcgacctgctcgggggtcaccttgaacccgttcgcgagggtggtcggcactgcaacgggcacgcccccaaagagtcgcacgatctcggggtaggacacccagtagggcgcggggatcagcacctcgtcgccgggctcgacgatagcggccatggcctcgtagatggcgtgcttgccgccgttcgtgacgaccacgttcgaaggactcaccacccgtccgctgtcacgcttggtgacctcgacgatgagctctcgaagctcgcccaacccagccgctggcgtgtagcggtggttccgaggatcacgtgcggctgcggtggcggcctccacgatgaagtcgggggtcggaaagtccggttcgccggccgcgaagctcacgacatcgatgcccgacgccaccatggccttggctcgctggtcgatcgccagtgtggccgacggtgagagctcggtgagtctggtggcgatacgacctcgtggcatggacctcggcctcctcacgccccgtgaagggaatccggacggttacagtgtcccttgccaggcaccaagcgagcctcgaggcagcgaaggtgaccaagggccacacgaaggaggagcacccatgcccgacgcggacgccatcagactacccagcaacctgctgcccagcgacggccgcttcggatctggcccgtcacgcattcctccgtcccacctcgaggcgctcgccgcgaccggcacgacgctcatgggcacgagccatcgacggcctaccgtccgcggcctcgtcgcgtccgttcaagagggcctggccgagctcttcagcgccccagaaggctacgagatcatcctcggcaacggtggcgcgaccttgttctgggacgccgccgcgtactccatgatcgagcacaagagccagcacctcgccttcggggagttctcctcgaagttcgccagcgtggtcgccgcgacgccccacctcgacgaaccggacgtgcgccgagccgaggccggctcggcacccgccgccgagcccaaccctgccgtcgacacctacgcgctcacccagaacgagacctcgaccggcgtcacgacccaggtgacccgccccagcgaggacgggctcgtcctcgtggacgcgacctcggcggcgggtgcgatcgtcttcgatccctcccaggtcgacgcctactacttctcaccacagaaggccttcgcctccgatggcggcctcttcgtggcgatgctctcgcctcgggcgatcgagcggatcgagcggatcgccgccagcggccgagcgatcccggccacgctctcgctcctgaccgcactcgagaacgcgcggctcaaccagacctacaacaccccggcgatcgcaaccttgttcctcatggatctccagatcaaggcgctgctcgagctcggcggcctcaagggggccaacgaacgctcgcgccaagcctccgacgtgctctatgcgtgggcaaccacgcacgcgcacgcgacaccgttcgtggccgaccccgcactgcgctcgcccgtgaccgtcacgatcgacttcgacgacaccgtcgacgccaaggcgctcgctgcggtactgcgctcgaacggcatcgtcgacgtcgagccctatcggaagctcggccgcaaccagctgcgtatcgcaacgtttcccgcgacaccggtggcggacgtcgaacggctgcgcgacgccatcgactgggtcatcgagcgcctcgccgacgacgctcgagccccccagacggcctaggcgaaggccctacgccgacgcggagccttcgaggcgaggcagccaggacggtcgtcgtgcctcgaaggcttcgatctcggcctcgtgctgcaggctgatgccgatgtcatcgaggccgtggatgaaccggtgccgaaccgccgggtcgagggcgaaggatgcctcaaggccaagttctggcacctcgaagcgacccgagaccacgtcgaccctcgccacgatcgtcggatcggacgcgctcgcctcgaggaggcgctcgacgatcgccgtgtccagcacgaccgggaggagcccgttcttggtggcgttctgacgaaagatatccccgaaccggggcgagacgacgacccgaaacccgtaatcggtgagcgcccacacggcgtgctccctcgaggacccgacgccgaagttctcccgtgccaccaggatcgtcgcaccggccatgcgcgggtcgttcagcacgaacgtcggatcctcgcgccactcggagaacagtccctcgccgaatccggtgcgcgagatgcgcttgagccactcgctcgggatgatctggtcggtgtccacatcgctgcgcccgagcggcaccatccgcccggcccactcacgcatgggttccatgctcagccctccacgtccgccggtgtggcaaagtggcccgccagtgccgtcgcagccgccacggcaggcgacacgagatgggttcgtccgccgcgaccctggcggccctcgaagttgcggttcgaggtcgacgcagagcgctgaccaggccggagctgatcggggttcatcccaagacacatcgagcagcctggttcgcgccactcgaaaccagcagcgaccaagacgcggtcgatgccttcggcctcggccgcctccttgacgcgccgtgaccccggcaccacgagcgcctgcacgcccggggcgacccgtcgtccacgcgccacgctcgcgacgacccggaggtcctcgagacgggcgttcgtgcacgagccgatgaagacgacgtcgacgggcacctctcgcatcggcgtcccgggctcgagccccatgtaggcgagcgctcgctcggctgcttggcgctcgtgctcggtcgtgaacgacgaagggtcgggaacgacgtcatcgacaccgatgacctgcgaggggttcgtgccccagctcactcgaggggtgagcgtcgaggcgtcgatgcgaacgacgcgatcgaagaccgcgtccggatccgtcgcgagcgctcgccatgcagacacggcctcgtcgaaggcccggccacgcggggcgtacgggcgaccttcgagatacgcgaaggtcacatcgtccggggcgatcaggcccgcacgcgcaccggcctcgatggtcatgttgcagaccgtcatgcgagcctccatcgacagccgacggatcgcctcaccgcgatattcgatgacgtgtccgatccctccgccggtaccgatctggccgatcaccgcgaggatgaggtccttcgcactcgccgactcggccaaggtgccctcgacctcgatcgcgagtgtgcgcggtcgacgttgcgggagcgtctgcgtggcgaggacgtgctcgacttcgctggtgccgataccgaaggcgagcgcgccgaaggcaccgtgggtcgcggtgtgcgagtcgccgcacacgatggtcatccctggctgcgtcagtcccaattccggaccgatgacgtgcacgatgccctggttctgggaccccatcgggaagtacgagatcccgaactcggcacagttcgtcgcgagtgcatccagctgcgccgccgagatcgggtcggcgatcggctggtcgatgccgaccgtcggcacgttgtggtccgccgtcgcgaccgtgaggtcagggcgtcgtacccgacgacccgcagcgcgcagcccgtcgaaggcctgcggcgaggtgacctcgtgcacgaggtgcaggtcgacgtagagcaggtccggttcgtcctcggttccctgggcgacgacatgcgcatcccaaatcttgtcgacgagcgttgtgctcatcggctgctacccccctcccgtcggccgctagcgagcggtcttgagcggcccgatctcgacgacctggaccttcagggtaccgcgtggcgcctcgtactccacccaggcaccgacgcgcgccccgagcagtgcctcaccgagtggcgaggtcggcgagacaacctcaagccccgggtgccgctcctcgatggagccgacgagatagtgctcgacatcgtcttcaccctcatagcgaaggcccacgaccacacccgggcgcacctcgtccgtcggaaggtccgccgacaccacccgagcgctctggaggatctgctggatctggcgtatccgcgcctccatcttgccctgggcgtccttcgcggcgtggtagtcgccgttctcgctgagatcgccgagcgcacgggcagcctcgatcgccttggcgatctcgatgcgcccctgggttgtcagctcctcgagctcctgaaccagggcgtcgtacgtcgcctgtgagatctctacctcgctcattgacgacgatcctagcggccggcgccgagacgccgaggcttgagccgaccagcatccgagggtacactgagctgccagcaggccgatcgacgcatcggtagcaccagcatcgtccgacggagcaccaccggtgcgacgactgatcgagaagcgaccgacctagaagggagcaacgtgggccaccgcgtagcggtcatcggcggcgacggcatcggccccgaggtcatccgagaagcgctgaaggtggtcgaggcgacgggcgtcgtcctcgaaacccgagcagtggagctcggtgcggcgcactatctcgcaacgggcgaggtcctcgacgacgccacactcgagttcctccgctcccacgacgccatcttgctcggcgccatcggaccggcgatcggctcgacggaggtcccgcctggcgtgctcgaacgtggcctgctcctgcgcctacgcttcgaactcgatctgtacgtgaacgagcgtccgtttcgcaccatcgacccctcggtcaccgtcacgcggcgcgaggcagacttcgtcgtcattcgcgagaacaccgaggggccctacgcgggcgaaggcggctttctctatcgcggaacggcccacgaggttgcccaacagggatcgctcaacactcgtcacggcgtggagcgcgtcgtgcgctacgccttcgagcgagcgcgctcccgaccacgcaagcatctgacgctcgtccacaagaccaacgtcctcacctacgctggcgacctctggagcaggacttttgcagaggtcgcggccgaatatcccgacgtcatgacggcctacaaccatgtcgacgcggcgtcgatctacctcgtcgaggatccggggcgctacgacgtgatcgtcactgacaacctcttcggcgacatcttgaccgaccttgccgctgcggtcacgcagggcatcggctacgcagcctctgccaacctcaatccggcgcgcaccggaccctcgctgttcgagcccgtccacggtgccgctcacgaccgcgtcggcaccaacaccgccaacccatgggcggccattcggtcggcgggagccatgctcgagttcctcggcgagcacgaggccgcgtcgcgtatcgaagcagcgctgtcggtcctcccgcccccgtcggcaacgacaacgcagatcggtgacttctatgcagaaagggtgcgtcatggcgatcgctgagggcaaggtcatctggatggacggcgaggtggtcccgtggggcgaggcgaaggttcacgtgctcacccacgcgctccactacggctacggcgtcttcgagggcatccgtgcctacgatacgccacgcggctccgccgtgttccgactgcgagagcacctcgtccggctgcatcgctcggcgcgcatgctgctgatggagatccccttcagcgtcgacgagctcatcgaggcgacgaggacggtcgtcgcggccaacggagaaccggcgtgctacatccggcccgtcgccttcaccgcctacggcgagatgggcctgtcgcccctgtcctcgtcgatttcggtgtcgatcgcgacgtggccgtggggggcctacctgggcgacgaggggatcgccaagggggtgcgtgcgaaggtgtcgtcgtggcgccgacacgacccgaacgtgatccctccggccgccaaggtgaccggaggctacgtcaactcggcgctcgccaaggccgaggcgatcaaggccggctacgacgaagccattctcctctccccgcaaggctacgtctccgagtgcacaggggagaacctgttcgcggtgttcgacggcgcgatcgtgacgccaccgatcgcggcgggggcgctcgcgggcatcacgcgacagaccatcatgacgctggcggccgacgccgggatcccggtgcgcgaggccaacttgctccggtccgatctctacatcgccgacgaggtcttcttgtcgggcaccgccgccgaagtcgtaccgatcgcctccgtcgacgatcggcccgtcggtaccggagaacccggtccactcgcccgagagctgcaacggcgctactacgcggcggtgcacggcgaagatccgcagcacgagtcctggctcacctatgtccacggctgacgtcctatgagcgcagggttccccgcagaggtcgagatctacgacacgaccctgcgcgacggttcccagcaggaggggatctcgctctcggtcgacgacaagctgaaggttgcgcgccagctcgacgccctcggtgttcactacatcgagggagggtggcccggcgcgaacccgaaggacgcagcgttcttcgccagggctcgcgacgaactcgcgctccacaccgcacagctcgtcgccttcggatccacccgacgagcctcgacgaccgcggagagcgaccccaacctggctgcactcaccaatgccggcgtcggcctggcctgcatcgtggccaaggcgtgggacgttcacgtcatccatgcgctccgcacctccctgccagaagcggtcgccatggttgcggactcggttcgctggctcgtcgaccacgggatccgcgtcatgctggacgcagagcacttcttcgacggttggcgtcacgaccggtcctttgccctcgacgtcctcgccgcagccgccgacgccggagccgaacgcttggtcttgtgcgacaccaacggcggcacgctgcctgatgacgtcggacccatcgtcgacgacgtacgagctgccgtcgcaacaccgctcggggtccacttccacaacgactcggggtgcgcggtcgccaactcgctcctcgcggtggcccacggcgtgatccaggtgcaagggtgcatgaacggctatggcgagcgcacgggcaacgcgaacctcgtacccgtgatcgcggggctcagcctcaagcgatcggtacgcacgattccgccggagaacctcgagctgctcacgaccgtatcgcgccacatcgccgagctcaccaatcaacccctgccgccacagagcccctacgttggggcctcggccttcacgcacaaggcgggcctccacgtcagcgcgatcgcacgtcgtcgcgacgcctacgagcacatcgatcccacactcgtcggcaacaccacgaggttcgtcgtctccgagatggccggacgccagagcattcagctcaaagccacgcaactcgggatcgacctcggcgaggacgacatcgccgaggtgctccgccgtctcaaggatctcgagcatcgtggctaccacttcgaagccgccgacggctcgctcgagctcctgctgcgacgcgcgagcggctggacgctcgacgacgtcgccgtcgagtcctatcgcacgatctccgactgcatgaccgacggaccccgggccaccgaagccaccgtcaagctcacggtgaacgatcggcgtgtcatcgcgaccgccgagggcaacggtccggtgaacgccctcgatgaagccttacgcgcagccctcgaccccgccttccccctcctcaagacggtcaagctgacggacttcaaagtacgtgtcctcgactcagaccagggcacggacgccaccgtccgtgtcctcatcgacttccaagacccagaagacacctggacgacgaccggcgtctcgaccaacgtcatcgacgcttcgttcgaagccctcctcgacggcctcatcgtggcgatcgctcgcgcccgcgaccgaggcgaggaatggtagagcaggaggaaccatggcccaaccagaccccaccatcgtccccgagcgcgacgtcgcacccgccttctgggccgaggaggtcgatcgcgccccgctggctcgccccgcggcgctgcgtggacgtcgactcgacaccgggcccgctcgcgggcgaccgggccccgatcaagggtggggctaccatctgttgaccctggtcgaaggcgagctcgatctcgtcgctggcgaacagcaccaggacatcacggctggggtcgccgccattgctgcagccctcgccgcgctcgaaggccgcgcgcccgtcctcgccgacgtcacccgagtcatcgacgcctaccatctccgcggaggcgcctcctcggacgacctgcgcaagcgagggcgcttccgcggcgtcgcccacgacgcgctccgtcgacgcctcctcgtcgacgcgaccctcgccgagctcagcgccgtccccacggcgcgttagaccgcggcctccgcgaccggtcggccggcactcgctgcgtgacggcccctcagccaggctgcgcccgcgaccactccccaagcgatctcgagcgcgagcagtaggtccgcggccacccgaacacgaaggacccatgagcgagccgtcgcgatccgccgctgcacggatgacacctctgcttcgaagacgacgacacgcccctcgaccgacgcgagggtccgaccaccggccgcgacctccgacgcgacagggccgaggccacggcacagcgaacctgcctgcggcaccagctgctggacgagcccgccgacaccacttgcgcacgccgcctcggcaacactgacctcgtgctcagcactcccgaccgcgacacgcagtccgcgcgcaccgttgctcacgcgctcgaggaccccagccacgcgcaccagctcaccgtgcccgtgatccagttcgcgaactaccgaccccagcaccggcgacggacccaccacgatcaagccgagcccgatgagcgtcacgaagaccaccccgagcacccgctgtagcacgcgcatcgcaacctccgaatccgggccagacacagtcccaacgcctcgacacagccccaacgcacgacgagccgggatcccgaaggatcccggctcgtcacgaaagcccggtcggcggcgccctactctcccagggggtctccccccaagtaccatcggcgctggtgggcttaacggccgtgttcggaatgggaacgggtgtttccccaccgccatggccaccgcccggacgatctgcggcgtcgagcgctccagagcgagcacgaggagctccaagtcctcggccgattagtaccggtcggctgaacacgttgccgtgcgtacacctccggcctatcaacgtggtcgtctaccacgggccttaccaggttgaccctgtgggaaacctcatcttgagacgagcttcgcgcttatatgctttcagcgcttatcccttccgtaggtcgctaaccagccgtgcccttggcaggacaactggcacacgagcgctacgtccgtcccggtcctctcgtactagggacagcctctctcaagtttcctacggctgcatcggatagggaccgaactgtctcacgacgttctaaacccagctcgcgtaccgctttaatgggcgaacagcccaacccttgggaccgacttcagccccaggatgcgacgagccgacatcgaggtgccaaaccttgccgtcgatatggactcttgggcaagatgagcctgttatccccggggtaccttttatccgttgagcgacggcgcttccacatgcgaccgccggatcactatgccctgctttcgcacctgctcgacatgtgggtctcgcagtcaagctcccttgtgccattgcactcgacgactgattgccaaccagtctgagggaacctttgggcgcctccgttactctttaggaggcgaccgccccagtcaaactgcccacctgacgcggtcccggacccggattcacgggtcgcggttagagctccagcaccgacagggtggtatttcaaggacgcctccagggaagctagcgctcccctttcgcaggctcccacctatcctacacaatcggaaccaaagctcaacatcaagctacagtaaaggtccacggggtctttccgtcctgatgcagctaacgagcatctttactcgtacttcaatttcgccgggtctgtggttgagacagtggggaagtcgttacgccattcgtgcgggtcggaacttacccgacaaggaatttcgctaccttagcaccgttatagttacggcggccgtttaccggggcttaggttcagagcttcgcccttgcgggctaacccctccccgtaaccttccggcaccgggcaggcgtcacagcgtatacatcgtcttggcgacttggcacgctgctgtgtttttagtaaacagtcgcttccccctggtttgtgacaccccctcgggctccgggcgcgaggcccttcaccctaccgaggtcttccttatcccgaagttacggaagtaatttgccgagttccttaaccacagttctcccgctcgccttggtattctctacctgcctacctgtgtcggtttggggtacgggcgcctcgatcactcgctagaagcttttctcggcagcatgggatcagtgacttcgcccgaagtgggctcggagtcgcgtctcaggcttcgtgaggtccggatttgcctggccctcgccctacacgctttccccaggaacgaccaacgcctgggatcacctaccctcctgcgtccctccatcgctcaaacgcgatcggggcggtaccggaatatgaaccggttgtgcatcgactacgccttgcggcctcgccttagctcccgactcaccctgggtggacgagccttgcccaggaaccctgaggcattcggcggaggggattctcacccctcgttcgctactcatgccagcattctcactcgagcgcgctccagctcggctcacgcctcaccttcacggcacgctcgacgctcccctaccgcccggtgacgtacgtcaccggacccgcagcttcggtgaccggcttagccccgttacattatccgcgcggaaccactcgaccagtgagctattacgcactctttgaagggtggctgcttctaagccaacctcctggctgtctgggcggttccacatcgttttccacttagccggtactttgggaccttagctggcggtctgggctgtttccctctcgaccacgaagctcatcccccgtggtctcactgccaggctctggagcatcggcattcggagtttggttgggatcagtaaggctgtgggcccccatagcccatccagtgctctacctccgatgctgaacacctgacgctgcacctcaatgcatttcggggagaaccagctatcaccgagtttgattggcctttcacccctatccacaggtcatcccccctgttttcaaccagggtgggttcggccctccacgggatcttacccccgcttcagcctgcccatggatagatcactcggcttcgggtctaccgcaggcaactctcgtcgccctgttcagactcgctttcgcttcggctcccccacgcatgggttaacctcgctacctacggtaactcgctggctcattcttcaaaaggcacgccatcgccctcgcgggctctgactgcttgtagaccaacggtttcaggatctgtttcactcccctctcggggtgcttttcacctttccctcacggtactagttcgctatcggtcgcctgggagtacttagccttacgaggtggtcctcgcagattcacacgggctttcccggatcccgcgctacttgggtggcgacggggaggcagctcgcttcgcctacggggctgtcaccccctgtggcgcgacgttccagtcgcttcggctcacgcgctgcttggtaactccctggaggggctggcgcaccctcctcgtcgctcccgctacccccggacggcaacgccgccaggcttgacaccgcccgggtttgggctgatccccgttcgctcgccgctactaggggagtcgcggttgctttcctctcctgggggtactgagatgtttcaattccccccgttccctcctcctgccctatgtgttcaggcaggggtgacgtggcattccccacgccgggtttccccattcggacatccatggatcaacgcttggtcgacagctccccatggcttatcgcagtcgcccacgtccttcatcggctccaggcgccaaggcattcaccgttggcccttcgtaccttggagttgtgatactcgtgctcgctctggagttctcaagctgccgcgcagcaggtgcttcgcgaagagggagccagtgcttcgactgggtgcggccactcgttgtggccactccttagaaaggaggtgatccagccgcaccttccggtacggctaccttgttacgacttcaccccaatcgccgaccccaccttcgacggctccctcccttgcgggttgggccaccggcttcgggtgttgccgactttcgtggtgtgacgggcggtgtgtacaaggcccgggaacgtattcaccccggcgtgctgatccgggattactagcgactccgacttcacgcagtcgagttgcagactgcgatccgaactgagaccggttttttgggattggctccccctcgcgggttggcgaccctttgtaccggccattgtagcatgcgtgcagccctggacgtaaggggcatgatgacttgacgtcgtccccaccttcctccgaattaactccggcagtcccctacgagtccccggcatgacccgctggcaacatagggcaagggttgcgctcgttgcgggacttaacccaacatctcacgacacgagctgacgacagccatgcaccacctgtgaagggccccgaaggacaccgcatctctgcggcttttccctccatgtcaagcccaggtgaggttcttcgcgttgcatcgaattaagccgcatgctccgccgcttgtgcgggcccccgtcaattcctttgagttttagccttgcggccgtactccccaggcggggcacttaatgcgttagcgtcggcacggagcccgtcgaatgaggccccacacctagtgcccaacgtttagggcgtggactaccagggtatctaatcctgttcgctccccacgctttcgctcctcagcgtcagtaccggcccagatcgctgccttcgccattggtgttcctcctgatatctgcgcatttcaccgctacaccaggaattccacgatcctctaccggactcaagccatggcagtatcggatggcgacaccaggttgagcctggtgatttcacatccgacttgccaagccgcctacgagctctttacgcccagtaaatccggacaacgctcgccccctacgtcttaccgcggctgctggcacgtagttagccggggcttcttctgcaggtaccgtcagtttcgtccctgctgaaaggagtttacaacccgaaggccttcgtcctccacgcggcgttgctgcgtcaggctttcgcccattgcgcaatattccccactgctgcctcccgtaggagtctgggccgtgtctcagtcccagtgtggctgatcgtcctctcagaccagctacccgtcgtcgccttggtgggccgttaccccaccaacaagctgataggccgcgaggccgtcccgtcgcgcccgaaggctttgctccctcgaccatgcggtcaggggagcacatgcggtattagcaccggtttcccggtgttatcccccacgtcggggtgggttcctcacgtgttacgcacccgttcgccactcggtggcaagccaccgcgtacgacttgcatgtgttaggcacgccgccagcgttcgtcctgagccaggatcaaactctccattggagatcgttccgagggtggagtccaccctcgctcgcctcgccccgggacacgtgggtctcgggtgggggagagtcgatcatggttggtgggtttggtcccaccgtttgtgttgtcggggtgacaccgagcttgtgctcgggtcgcccgcactggcttgtcttccctcttcgcgatgtcaacctgcgcccctgtcggggctctgccacgagggcacccgaagctgctcgtcgtggctggtgggttgccccacccccagcggtgctcttggagcacgtgggattcatcagtgtagcggggtcggaacgggtcgtgcacggttggggggcaaaaaatcgccacggaccctgtgcgaagtccggcaacgcggctctcgccgctggcgtcgcgcccccaatgcgagcttgggtgactcacccggccacctcggtgggcagcacagtgctgtcactcgccccgggaccaggctcgtcgagacctcgatcctcgcggccgaacccaccaactccttcagggagatcggcgttcacgatcgaactcggcgcgacacaccaacacctagccctcgccccccacaccacgccaagagggacggccccgaggcgaccgaagctgcggcgtagacgcctgcagtgcaatgccatccagcacgtgggctgaaggcacacacccggcggcggcatccatcggccagcgcgcgtcggcgcgcactccgaacgccatggtccgttggctcgagaacgtagaagcgcccacgaaatgccagaaggtgatgtcgccactcagggtcccggcgagtcgctcgttcccggagacgggtcgcctaccagatccagccgacactgcgcgacatcgagccgcccgcctggcgacgacccctcgtgcccggtgggacgacgctctcagtgctccatgacgacatgcaggcagccctggggtgggccgacgcccacgtgcacgagttcgagaacgatggcgtgcgctatgcgatgccggacatggctgacgactgggacacggaccgcgggtggccgatcgacgggttcgcctctctcgggtggccggcgaggacagccggttcctcgaccgctacgacttcggcgacgactggcgagaggatgtcctcatcgagaaggggttccccgccgaacccgacaggcgttaccttgcgagcatcgacgggcgccgcggcggacagcccgaggattgcggcgagcctctcgggtacgcggaacacctcgaggtccgagccgaccgcgcggaacctcggcaccgtgaataccgcgactgggtgggcgacttcttcgatcccgaggcgttcgaccccgcggacttcgacgagcacgtgcggacgctgcgcgcattgcgccaatggtgagacgacccattgcgtggcgggatagccaggtcgagagataggcgacccacaccgcaggccttcacggggctgccacaggttcgtggaggcctggccagcctgacggacgtcaactcgcgccaccgccaaccacgcgtctggtgcgctcccacgccaagactcggcacgctcgaagcgaccgcacgttcgatccgtcgtgctcccgagcccaccaccgttcaggcgatcttcaacccacgaccgcgacagggcgcccggcgcgaggccactcgtcgtcgccgaaccgctcagccggatgcgtccccgacatcggcggttcctcgtcgctagttcccacgagcgagctcgttcccttcgatgccgccttcgagctgcggtctaaccccccagaatgacccgcgggcccttgccccacgacagatagtgccacgaccagttcatgagcacggacgccttgttcctcgaaccaaggagaaaggcgacgtgcaacagcagccacgagacccatgcgggggttccgtgaagccgcacgcctcctgcaagctccgcgacggcagcgcggcgtccgatcgtcgccatgatgcccttgtcccggtagcggaacggctccgtctcgctaccagcgagcaaggcgaggatctggcgtgctgcgtgctcgcctccttgcagggcgggctgcgcgagctggggcaagggcgcgccgtcacgattcgtcgacagcgcgacgtccccgaccgcgaagatccgatccgatccgacgacgcgcagatccgagcccaccatgatgcgcccaccgcggcccgtgggcagaccgagcttcgacaccaccggcggaacggcgatgcctgcagcccacagcacgagcccgttgcggatctcacgtccgctcttgaggacgatcaagccctcctcaaccgactcgaccgtctcgttcagcagcaccgtcacgccacgcgctcgcagctctcgacgggcgtactccgagagatcctcgtggaacgcctcgaggagacgcccacgctgctcgatcaggacgaccttcacgtcgtccggccccagcatggtgaaatcggtgtagagcgcccgatgtgcgagttcagcgatcgcgcctgcgagctcgacgccggtcgcgccaccaccgacgacgacgaaggtcagcacgccgtcgtgcacgccgtggctcgctgcatactcgaagcgctggaagatatggttccgaacgtcgacggcggcgtccagcgtgtagatcgtgtgggaccgttcctccgcacccgggatgccgaagaacgatgcgctcgccccgatcccgagaatgaggtagtcgtagtcgacgatacgaccatcctcgagtccgatgaagcgacgcttagcgtcgacctcggccaacgtcccttggatgaagtgcgcgtgacgcgctctgcgcaacacggtgcgcaacggataggcgacgtcaccggcgttcagtcccgcagtcgcgacctggtagagcaacggctggaacgtggtgaagttgtggcgatccacgacgaccagctcgaccggcgcatcccgaaggacctcgatcgcggccaatcccgcaaagcccgcacccaccacgaccacccgtggacgagaaccctggcgcaggtcaccggactgtgattgtgtcgactgatcctgatccacggtcttgaccatcgcaactcctcacatcgtgcccgctcgctggagagtctacgaggaaccccgcccaggtcgcgtggcccgagtcagccgtgagccctgaaccgcgaagcgcaccgctcccgaaacctcgactggacgtcgaccgacgacgaggactgcgcccccgatcgactcgcgaaggacgcgatcgaacacctccggcaccacgtctgcgtcctcgacccacaacagcctcgcgaccgccgggcggaccagggccatggccagctcgagtcgcgcgcgcgcacgcggtgagagatcgaccgcgacggcgccgtctcgcccctccaatccgcttgcccgaagcacgtccgcgaacgagggaaccggcgccgaaccgactcggcgcgcgagcctgacggcgagcacgaggtgctcggcgaccgtcaggccctccaccggctcgaaatcgcgagccgcgaccgcacccatcgcgcggccttcgagcgtcccaagccgcgcaccccgcacacgaagcgccccgccggcctccgtgtcaccacgagcgagctcaaagaacgcgccggggtcttcgagcacaagcacggcccgctccttccccacgagcgtcagctccgtcagtgacaccggaccgccaggctgccagagctgcccctcgccccagaggagcgcatcacgctcgcgagtcacggccccaccaactcgcgaacgacacgcccgcgagaccgacgaccacaccaaacgaggccgcagcggccacatcctcgaggatcagcgcgtgctgcgcgaggccgaggttggcctgcacggcaggggccgtcacgaacagcgcgccagcgagcatggcgacgatcgggatgaccgggttccgagtccacacgtcgcgatcatggagcaccgcgatgacgcacgcgacaccggtcgtggcagcagcgatgccgacgaggccgaccacgaccaccgacgacgcaagcccgagcggcaccggagcgagcagaccacccgctagcacagcgacggccaggacgaggaggtccgctgccgcactcacccgaacgacgcgcgatcgacgcaccggcagcagggcaacgagccctcgcgagtcgaggaatcccccgagcggacgtccaacgacgagaccgagcgcgaggaccccgaccaccaccggcaccgcgcccgcagggtcgccacgtacgagcgccgccagccccgcaacggtcgcggtccccgctaggagcagcgcaacaccggccgcggcacgaccgcgtccgaggccgagccatgtactcgtggcgatcggggcacgcagcaggcccgcctccacgacaccgtgcggtcgatcggcaccgcgacgtggtcccgacggccgcacgtcaaggcgcccgacgccgatgcgcaacgcgagcgcgaggatcccgaggccgacgaccgccacggcatcggtgcgacccaacagccatgcaccgacgctcgcagcgagcgcaccgctcgggacgcgaccagccaccacgacagcgatcacgagcatgccgacgatcaccgcacgacgccgactccgcgcaccccggcgaacgatcccgagcacggcgccgagcgagacgccaaccgcaatccacgtcccgcgaaccacgtccgagcgatgtccatgggcaagcgggagcacgagtgcggcccccgcaaccacgccaacgatcagctccgcggcgaccgagcgcgcgctgtcgtgctccgcggctggcatcgcgatcccgatcgccacgagcgcgatcaccgtcgccgcgacgactcgtgccacccaagccaggctgtcaccgccgagcaggtggagatcacgctcgagaacggcctccccgacgacgagcgtcacgagcccccagagaccggggcgaaccagtgctctcgggctcacccacccgagacctggtcgagcttggtcgccgacgccaggaacggcatcattgcgcgcagatctcgaccaacctgttcgatctgggcctcgcgcgcctcacgccgcaaggcctcgaaacgggggcggcctgccgcgatctcgtcgaccagctcggaggcgaacgctccggagcgaatctcgtcgagcacgcgacgcatctcggctctggtctcgtcgttgacgatgcgcggtccgcgggtcaggccgccatactcggcggtctctgacaccgagaaccacatgccagacaagccgtgctcatagagaagatcgacaatgagcttgagctcgtgcaggcactcgaagtaggcactctctggctgatacccagcctccacgagcgtgtcgaaccctgcgcgaacgagttgcgagagtccaccgcacagcacgacctgctcaccgaagaggtcggtctcggtctcctcggcaaaggtggtgtcgagcacaccggcacgcgtcgatccgatcgcccaggcgtacgcgagcgccgtgtcgtgggcgcgaccactggcgtcgttggcgactgcaatgagcgacgggatcccgccgccctcctcgtaggttctgcgaagcaagtggcccggacccttcggggcgatcatgatcacgtcgacgctcggatcgggctcgatcaatccaaagcgaatgttgaagccgtgcgcgaacgcgaccgcgctcccgggctggaggttgggggcaacctgctcgcgccacaacgtcggcgccgtcgtgtccgggacgagcagcatgacgagatcggcccagcgaacggcgtcggccacactggagacctcgagtccactggcacgggccttgtcggccgacgcggacccttcgcggagccccacacgtaccggcacccccgagtcgagcaggttcagcgcgtgcgcatgaccttgggacccgtagccgatgatggcgacgcgccggtcagtgatgagagcgggattcgcgtccttgtcgtagtacatctgagccacgcgtcagctcacctttcctcgtcgtgccactcgtctgactggcttgggtagtctggccagcgcaatcctaccgctgcgctgcacctcgacgatcccgaactctccaaggagcgcctcgacgtcgtcaagtgccgacggcgcgagcgcgaacatcaaggtcagccgttcggcgttcacgtcgagcacctggccgcggaacaactcggcgagctcgagtgctcgtgaccgggacccaccctcggccacgatcgtcaccaacatggactcgacctcgacggcgtccgacgggtcgagctcggtgatcttgaggacgttgatgagcttgtggagctgcttcgtgatctgctcgagcggcgcggtctcgacgtcgacgaccatggtgatccgagagaagcgctcgtcgtccgtgggtgcgaccgctaacgagtagatgttgaacccccgtcgtgagaacaggagcgcgacccgagcgagcacccccgccttgttctcgacgaggaccgagagaatatggtgccgcccgtggacgggctggcgaattgcgccgatggggaccagattcgacgaggcgctcatcgaccatcccccacgaggtgaggcggcagcacgatgtcatcgttcgatgctccggccggcaccatcgggtacaccttctcgaaggtatcgacccgaaagtcgatgacgacgggccggtcgtccacctcgttggccttctcgatggcagcgtcgacctcctcgggggcgtcgacccgcatgcccaccgcccccatcgcctcggcccagcgcacgtagtcgggcaggtccggcgagagatagacctcgctgtagcgctcgtcgtagaacatctcctgccactgacggaccatgccgagatagccgttgttcaagatggccactttgatcgggatgcgctctgccgatgcggtgacgatctcctgcgccgtcatctggaagctgccatcaccatcgatcgcccagaccatctgccgaggccgggcagccttggcgccgaccgccgccggcacggcgaaacccatcgtcccgagcccacccgagttgatccactggcgtggcgcacggaacgtccagaactgcgaggcccacatctgatgctgacccacgccagccaccaaaatcgtgtcgtccggcgtcaatgctcgcaaccgctccacgacgaactggggcttcgtcgcagagcctggctcgctcgggacgtacgacagcggatagcgctgctgccactcggcgatcgtcgcacgccaggccccaaggtcggccggctcggccggcaagcgccgaagcagctccggcaagacgttgcgcaggtccccgacgatcggtacgtcggcacggcgcaccttccccaactcggccggatcgacatcgacgtggatgaccttcgcctcgggagcaaacgcgctgacacggccggtcacgcgatcgtcgaagcgtgctccaagggtgatgagcaggtcagcgcgctgcatggccatgacggcggcataggtgccgtgcatgccaggcatgccgagcgcgagcggatggtcgtcggggatgatgccccgagcgagcagggtggtcaccaccgggatacctgtgcgttccgcgagcgctcggagctctcgctcggcccccgcacggaccaggccgccccccgcatagatgaccggccgccgagccgcggtgatgagcgccgcagcctgttcgatcatcttggggtggcccttggtcacgggctgatacccgggcaggtcgagacggcgcggccagtaccactcgagctcgccagttgagacatccttcgggaggtcgatgagcacggggcccggacgtccagtggtggcgacgtggaacgcctccgccaccacgcgcgggatgtctgccgggtcggtcacgagccagttgtgcttcgtgaccgacatggtgatgccggtcgtgtcgacttcttggaaggcgtcagagccgatcgccccggtcgggacctggccggtgatcaccaccatgggcacggagtcgatcgcggcgtcggcgaccgccgtcacgatgttggtcgccgccggaccgctcgtgacgatggcgacgcccggacgaccgctcgcctgcgcatagccctccgccatgtggccagcaccttgctcgtgacgcacgagcacatgccggatgggggaatcgagcaacgggtcgtagaccggaaggatcgcgccccccggcaacccgaagaccacgtcgacgccctccatctcgagggcgcgcaccagcgcctgtgctcccgtcaaccgcatgtcgtgacccccttgtgctcggcgctcgccgccaactcctcctcagaccgtctaccgcgacccggatagcaaaagacctcccgcaagggaggtccgatgggcacgacgacggaggacgccgtgccctagcgaaggagtacgagcgaattcgtcgccatggcacccaacctagcgcgagtcgtcgtcgaatcctgccgaggtcaccgccccaacatcggcaccgcgcacgagcgccgcgaacttcgcgagcgcaccgctcgtgtagcgagggggcaagggcgcgaacgacgctcgtcgtcgctcaagctcgtccggggcgacgagtagatcgatcgcatggttcgggacgtcgatgcgaatccggtccccgtcgcgcacgagcgcgatcgggccgccgtcggcggcctcgggagccacgtgaccgacgcacagtccatgggtgccccccgaaaagcgaccgtcggtgacgagcgccgcgtccgaaccgcgtcccgcccccttcatcgcaccggtcacggcgagcatctcgcgcatgccgggcccgcccttcgggccctcgtagcggatcacgacgacgtcgccagcgcggatctccccggccaagatggcggtcagggcagcttcctcgcggtcgaacacccgggccgtcccctcgaagacatcctggtcgatgccggccaccttcacgaccgatccgcgcggcgcgaggcttcccgtcagcacggcgatacccccgacggcatgaatcgggtcgtcgagacggtgaatcacgactccatcggccgctggcggatcatacgcatcgagttcatcaccgagggttcgccccgtggccgtgagtacgtcggtgtggacgagacccgcctcggccagctcacgcagcacgaccgggaccccgccgacgcggtcgatgtcggtcatgtagaacttgccgtgcggcttggtgtcggcgaggtgcggaaccctcgcggcgatccggttgaagtcatcgagccgcagctcgacacgggcctcgttcgcgatcgccatcaggtgcaagacggcgttcgtcgacccgccgagcgccatgacggttgcgatggcgttctcgaaggcctccttggtgaggatgcgtcgcgccgtgatcccgagctcgagctggcgcatgacgagttcgcccgcctcgaacgccgcgtctgcacgacggcgatccaccgctggcgcggacgccgacccgagcggcgccaagcccagcgcttcggacaccgaggccatggtgttggcggtgtacatacccgcgcacgaaccgggcgtcgggcacgcgttgcgctcgatcgcgctcagttcgtcctggctgatctgtccggcagcatatgcaccgaccgcctcgaacaccgagacgatgtcgagccgctgatccttcagatgacccgggaggatggagccgccgtagacgaacacgctcgctaggtccagccgtgccgcggccatcatcatgccggggagcgacttgtcgcacccggcaagcgtcacgagtccgtccatgcgctcggcgtgcaccatgagctccaccgaatccgcgatgacctcgcgcgacacgagggacgagtgcatcccctcatgacccatggagatgccgtccgataccgcgatggttgcgaactcgagcggcacgccgccggctgaccgcacgccagccttgacccgcttggcgagctcaccgagcggcaaattacatggtgtcacctcgttccacgatgaggcgaccgcaatctgcggcttgtcgaagtcctcctcgaccagcccaaccgcgcgaagcatcgcgcgcgctggtgctcgcgtcggcccctcggtgacgtcccggctccgaaccttcagctgccgccgctccacgttgacaccccctgctctgcgacgtcggcgacaacgccgacagctcgtttgccgtgcgggcccgcccgaaccgcttaccctacgtcgaactacgctccgacgaggcgcgctcgtcgagcgcacggcgggcgagctgaccagggaccttaccacccgaacggcgcaccacctgtcctacgaggaaccccgcgatcttggcgtcgcccgccacgaagcgcccccactcctcgggcgccgacgccgcgacctcctctgccaacctcgcagcctcggcttcgagcccttcccgtccgcccgccacggccgcgacgagggcctcgatcggatccgaacgctcggcagcgatacgcagcacctctcggacctgctgggcgagcagcaggccgtctgcctcggccttgaggacctcgaccacgcgcgcgggatcgatctcgacgccctgcgagcgcacctgcgcgatctcgttggcgactcgcctcgcaacgagtgtcgctggaagtccggcgtcgagcgcaactcgggtgtaggcccacagctcctccgacaccgccgtctcgcgcacgtctgggctgacggccgcgtcggcgaggcgagcacggcgtgtgcgcggcagcgaggcgacgagtaggtccgacatcgcctcgacggcggcctgatcgaccacgagtggcgggaggtccggctcggggaagtagcgatagtcctcggcggcctccttggtccgcaagccgacggtcgcaccgcgagcctcgtcccagtggcgcgtttgctgcaccacgggctcaccgcgctcatagctctcgatctggcgcatcgcctcggcggcgatggcacgctgcaacgagcgcaacgaattgaggttcttcagctcgacacgggtccgcagctcctccgaaccgatcggtcggacggaaacgttcgcgtcgacacgcagggacccctcctccatgcgcccgtcgctcgcaccgacggcgaccacgatcgcacggagctcgctgacgtaggcgcgtacctcgtcagggtcgcgcagatcaggggccgacacgatctcgagcagcggcacgcccgctcggttgtagtcgatcagggtccgctcggccgactcgatgcggccccctccacccacgtgtgtgagcttgccggtgtcctcctccagatgagcccgctcgatgcgaatccgtcgacccccatcgagctcgaccgcaccgcccgcacagatcggcacgtcgtactgcgagatctggtagttctttggcatgtccgggtagaagtagttcttgcggtggaactggctgctctggacgcgcgatcccagggcggctccgaccgccatggcgatctcgacgcagcgcgcgttcacgaccgggaggctccccgggaggccgagacagaccggacacacgttcgtgttgggtgcctgcccgaatgcgttggcacacccacagaacagcttcgtcgcggtccgcagctccacatggacctcgaggccgatcacgagctcgaatccgcgctcgagccacggccacctcatcgctcggctcccgcctcgagcgctcgcgccgccaccaacatgcgcgcatcctcccacgcaggtgccatcacctggatcccgatcggcaagcgatcagcgtcgtagccgaagggcactgacaccgcaggcccaccgaccaggttcgacggcaccgtacagacatcggaccggtacatggccaccggatcggcgacccgctctcccaggcggaacgccgtcgtcggcgacgtcggggtgatcagcacgtcgacatcggcaaaggcacgagccaagccggcagccagccacgtgcgcacgcgctgagcctggacatagagggcgtcgcgatagcccgccgacagcgcgtaggtgccgagcatgatgcgtcgcttcacctcgtcgccgaagcctgcggaacgtgtcgccaccatcatctcgtcagtggtgagcgcctcgacgcggagtccgtagcggacgccatcgaagcgcgcgaggttcgacgacgcctcagccggggcgaccacgtagtacgcagcgagtgcggctgccacctcggggatcgacacggagacgacgctcgcacccaggcgctcgaggtggcgggcggccgcctcgagcgcggccgccaccgccggatccgcggtctcggcgagctccgtcaccacgccgacggtccagccagcaacgtcgcgatcggatggatcgctcacgatcgggccgcggggtgcactcgtggcgtcacgcgggtcgtgcccgctcagtaccgccagcaacgccgcggcgtcgtccaccgtcgccgcgaaggggccgatctgatcgagggatgaggcgaaggcgatcaaaccgtagcgtgagatcgcgccgtaggtcggcttcacgccgaccacgccacagagggaggcgggctggcgaatggatcctccggtgtcagaaccgagcgcaagcgcgctgaagcgggccgccaccgcggccgcagacccgccagaggagcctcccggaacacggtcgagatcgtgcgggttgcgagtcggcccaaaggcagagttttcggtcgacgatcccatggcgaactcgtcgagattggtcttgccgacgatgacgccgccagcggcgagcacccggtcgacgaccgtcgcactgtagggcgacacccacccttccaggatccgcgagcccgccgtggtcgggactccctcttggacgatgttgtccttgatcgcgatcggtacaccggcgagcggacccggatcatgaccggcccgcacggcggcgtcgacagccgccgcccggcggcgcgccgcgtcgaagtcgagatggaggaaggcatggacctcgggctcttcgaccgcgacctgcgcctcgtaggcctcgagcacctcctcggcccgcacagcaccctcgcggaccgcacgagcgatgtcgaccgcccccagatcgagaatcgcctccgagttcacgcgtcgagctccacgatcggcggcaccaccagcagctgctcctggttgaggcgatccccgctggccaacccggcggggccgagacttgcctggacgacatcagggcgtagcgacgacgactccgatgggacgtgctccatcggggccacgcccgcaagatcgagccgagcgatctcgtcgatcagcgccaacaccccagagagctggtcgcggtagtgcgcgagttcaccgtcatcgagacgcagccgcgcgagccgggccacgtggagtacttgctcagtggagatgccgtcctgcacgcgcgccatcctagcgacgcggccacgaccgactaagacgtgatcgcacgcaggatcgccgtcacgcgctcgtcccgggtcgcgaagacctgcgccagcccgagcagcttcgtgatgtcaccgttcacggtgacgcggccggcgaggaacgcctcgacggctcgctgggggtccatgtcgacgaacatggccttggcggtctcgtaatcgatcgtgatggtgagatccgcctcgtccacgaggcccaagccgatctccaagatgcccgaggtggtatcgatgtgagccgtgatcggttcggggccgaacggcgtcccactgatcagctggttcatccgcagcggcaccgacacgctgatgggctcgataccgagccgactcgtcaggttgtcgaactcctcgagccatgcctgcgacaagaactcgtgtttcgcaagcccctcgaggatttcgggatcgaacgactccatgccccacttcctgaccggcgttactgcgtgcagcctacgagttcggggcgagcaccaagttcaccgcgctcccgaccgggacctcggtgccagccggctcaccctgggcgacgacgaccgccgaggtgccgaggtaggacgcaacgccgttcaacgacaggccgcccggcgtcgtgagctggccataggtcaggtgatccgcctggagcgcagcgaccgcttgcgcaaaggtgtcgtcgaagaggttcgggaccgcgacgtcggggggaccttgcgagatcacgagcgccacagtgctgccgaacggagccaccgtgcccgcacccggcgattcgctgacgacatcgcccgatgggaccgaggtcgagtacgcctgcgacgtcgtgacggcgaatccagccgcgcggagggcggctgctgcagtcgcctctggctctcccgcgaccgccggcacggcgcgcggcggcggtccagcggacacgatcagcacgacgacgccgtgccaccggacgcgttggccagccaggggctctcggatcacggtgccggccgagacggtggccgagtaggcccgatcgagccgcacaccaagaccgacacgcgagagcgcgcgtcgagcatcggaggcgatgaagccgacgacgtcaggggcgaccaccggcgcatggccgcgtgacacgaggatctcgacgaccgcgagcggatggagggcaacccctgcaccaggcacggtccccacgacgcgtccgggcgcgaccgtggcgctgtaggtctcgcccgtccgaatgcggaagaagccgagctcggagaggcgtgctcgtgctgcggcaggttcgaggtctgccagccgcggcacgctcaggcgtcgaacggcaaggtaccaggttgcacccagggcggccacgaccacgatgacgagcagcatgagccacacacgccgccgacgtcgcgctggagggcgtgcctcgatgctcgtcagcgacgccgtgcggccctgatccggggggacgaacgcgaccgacaacgaacttgggtcgaggacggcctcaggatcgtgcgcaggattttcgagcggtagcggtgacggcgccgggagcgcgcgcaccagttcgtcgatgagacgatgcagcgtctcatcgtccggtcgctcggcgggatcccgacgcgtcatgcgaaccaccacgtcgagcagctgtcgtccgggctcagggttgaccacgtccttcgtgaggcgttggcgcgcgacctcctcgatcgacccgccctcgaacgggaacgagccagtggcgagctcatagagcacgagcccgagcgcgtaggtgtcggccggggcctcactgcgagacgccagctcgtcgtgtgcacccagggccgagcgcagctgttcgggcgctgcgtatctcggtgtgccggcgtggcgcccaccggaggtctccgatgcgtgacgcaccagcccgaagtcagccaggcgcacgtggcccgtctcgtcgagcaagatgttcccgggcttgacgtcccgatgggtcagaccgtgcgcatgggcggcagccagcgcgctcgcgacctcttgggcgatccgggcgacttgcgcatcgtcgagacggcgaccacggcggacgagatccttcagcgatccgttcggcatgtactccatcacgagcacgagcccgatcggcgggccaacgtcgaggaggtcgagcacacgaacgacgtggggatgctgcatctgcgagatgacctgcgcttcgcgccgcagctctcgaacaaaggtgccatcggtgcgcagctccggccgcagcaccttgagcgcgacgggcgcaccgagtcgaaggtcgagcgcgacgtagacgacaccggcaccaccggtgccgaggcgccgctggacgacgtagcgaccaaccagggtccgacctgtgatgtcatccatcggcgacgtcacgctgaccaacgggctcccacctcgatcccgcgatcgacggtatcacgcatccgacccgcctcgacggtcgatgagctctcggagcccatcgaggtcgatgacggggatcccccgagcgcgggcctcgtcgagcttcgaccccggtgatgcccccgccaccacgtagctcgtccgctggctcaccgacgtacgcacctggccgccgtgctcctcgatgagcgcagcgagctccgcacggccaatgcccggcacggtgcccgtcagcacgaagctgaggccctccaggggtccaccggccgcgcgcgggcgatcggctgaggctccgaccccagcacgttcgagcttgtcgaggatctcgcgcccgaggtcgctgtctcgaaacgcgacgacgctcgccgcaacgaccgggccgatcccctcgacgcgacagagctcgtcctctgtcacggttcgaaggccactgagtgagccgacgacgtcagccacgagcatgccgacgtgctgaccgacgttgtcgatggcgagggcgaagatgacacgcccgagcgggcgcgaccgcgacgcctcgatgccagctcggaggcgctcgatgctccggtggcgcaccccagggagccgtgccaggtcgtcgtccgtgagtcggtacagatccggcgggacgaccacgagccctgcctcgacgagctggcgcgcgcgttgttctcccaatccatcgatatccatggcgtcgcgactggcgaagtggatgaggcgctgcacgagctgctcgggacagcgacggttgggacagcgccagtcgacctcgccgcgatcgcgcacgaggggcgtatgacacaccgggcaggtcgtggggaagacccatggcaccgcgtcgtcgggacgcagctcgagtaccggacgaaccacctcgggaatcacctcaccggctcggcgaacgatcacggtgtcgccgacacgaacgtcgagccgtgcgatctggtctgcgttgtgcagcgtcgcgcgactgacggtcgagccgccgacccggaccggatcgagcaccgcgaacggcgtcaccttgcccgacttgcccaccgacacctcgatccccacgagccgggtcggacgctcctcggcggggaacttgtaggcgatcatccaccgtggcgcgtgcgtcgtcgtgccgagacgcacgcgatcctcgaggcggtcgaccttgatgaccgcaccgtcgatgtcgtagtcgagcccgtcacgagcctcggcgagccacgcgagcttgtcggcgagctcgtcgaggccgaccggggtggcgtgtgcttcgacctgaaaaccaacctcgccgagccactggagcgcttcgtggtggtagtcgaagctcggcccctcttcgagctggtaggcgaagaaggagagcccgcggtcgcgggtgagcgccggatccttctggcgaaggctcccggcagcggcgttgcgaggattggcgaacggtcgctccacgcgctcgttcagggcccgaaaggccgagcggggcaggaagagttcgccgcgcacctcgacgagcccaggtcccgtgacgcccttgagacgacgtgggatcgcgtcgacgacgagggcgttcgccgtcacgtcctcgcccacctcgccgtcgccgcgagtggcagcttgggccagacggccatctacataggtcagcgagagcgcaaggccgtcgatcttgagctcgaagaagagcgcagggtcgtggccaagaccgcgccgcgtccgctcgacccaggcgtcgagctcgtcggcgtcgaagacgttgtccagcgagagcatcggcgttcgatggcgcactggagcgaagctcgatccgggaggcgcgcctaccctctcggtgggcgagtccggagaacggagttcggggtgggccgcttccaacgcccgcagctcgaggaccagcccgtcaaactcatcgtcgctcatgatcggatcatcagcgacgtagtacgcctcgctcgctcgctggatgagcgagcgcagcgcggcaacgcgggcagcggccgactcagtcatcgtcgacgacccgtgccgaggcgagtacccgatccttggcgtcgtagaggacgactcgctgcccgggagcgacgcgacgagcaggctcgtcgaaggcgaccgccgcctcggacagcgacccaggaagcgcgacgccatgcgctgcagtttggacgaggccccgaagcggctcgctccggggcacgtaggacaccagatcctcgatcggctgggctgcgaccaagagatcgctcgcactgccgacgcgaacagccgtccgagacttcgcgatcacgtagcgcggggtggaccccgagcgaccgggttcgcgaagccgctggcccacggtcgccagctcgaacggcagcgtgaccccgaccggctcacccgcgacgtcgcggacgggtacatcggtcaagccgacggccgcggacacgaacgccgctcgcccgtggggcacgaaacacacgtcctgcgaatcgcgcttgtcccacaccggcaatccggccgcgtgggcacgggtgcgcacctcgtccttggagagctcgccgagcggcagccagagacgcgcgagcacctccgggggcacgtccgccaacacgtacgactgatccttacgccgatcccgcccccgaacgagcatcggccgcgacccatcgaggaccgtcgcatagtgaccggtcaccaagcgggaggcgccgagtcgctgtgcccaagccgcgagggcggtgaccttgacgtagcggttgcacgacatgcatggattcggtgtccagcctcgccgatgggcgtcgagatagggttcgaccacggcgcggtggaactccgctcgcatgtcggccacgatgtggttgatgccgagcagggctgccacggtgcgcgcgtcctcgacgtccccaaccgagcagcagccgcggtcacctgcggcttccgtcaggcgcaaggtgacgccgatcacgtcgtgaccagcctcacgcgccatgagcgccgcaaccgaggagtcgacgcccccggacatcgcgaccacgacacgcgccaccgaccctcccctcgacgtgccccacgctagtggcgtgcctgccgcgacgatcgaccgagcgcgcgcgagaggagccccgggacgtcggtgatgatggcgtcgacaccaaggctgtcaaggaacgtcgcctcggcgacatcgttgatcgtccacacccacacctcgcaaccgagcgcgtgcgcgtcccgaacgcgccgctcggtgagcagtggaacgccacgatacgaacgcggtaccgacaacacgcgccaggggggtcgacgctggcgcgaaccagcgatccaggctgccacctcactgggggcagcggtggtccgcacgccgggccagcgcgacctcacccgctccagaaccccccgatgaaagctggcgaccacgcagcgctcgagggcccccgcatccgtgagcgtcgcgatgacgcgtgcctcgaggtcgcccgagggcccatcgtcgtccttgatgtcgatggaacacgcgaggccctcggtcaccgccagcacctcctcgagtcgagcgagcgatgcctcgtgggtgccgcacgggagccgaatcgtcgcgagttgctcccaggtcgccgatgcgatggagagcgccacaccagcggtccgatccagcgtcgggtcgtgatggaccaccagcaccccatcggcactcttgcgcacgtcgagctcgaccccagtagcaccgcgcgccgctgcactcgcaaaggattcgcgggtcgactcgcacgcctctcccatgcccccgcgatgcgccacgatgagcggcgtgctgcgcccgtccacgcccgcggatcctaacgactaggctcgacgccaaggcatgctccaccacgttctcttcgacctcatcggatccctgcgcgcaagcctcaaagacgccatgcttgagggcggcggactcgacgagcagcttcacgtcgacatcctgctgggggacacaacctacgaaacgtcggcaagcctcccgggtgaggaagcgccgccacgtgtgcgcgcggacatctcgctggagtggtcgacctgggctcagagtgcctatcgatcctggacgctcggtgagggactcgacgaacccatcgacgttgtcctcgaggtcgcgcttcgcgtgtcgggccttcggggccccgccatgagcgccgcggcgttccggtcatcgctgccatcgcagtcgcctccgctcgtcaatcacgaggtgctcgagctgcgaaccgtctcggccgaaaccaccatcgaccccgacgaggatctcgaggaactcagcctcgaggcggtctacgacgtgaccttgtccctcgacgagaacgagctcgagcaccccgactcgctccacgaggccctgcggcgactctcgggctggatcgcgagcgcactcgtcgcagcgagtgacctcacggcacgacaccgcgcaccctgagatcgcgttgcgcgagtcgacgtgccatcccgtaggctgaccacagagacgagggggtgccgtgaagccaatcccggttgagttccacctggggccgcttgtgctccacacgtacggattcggcctcggcgtcaccttctggttcgcctactggtacctcggcaagcgcttccgccggttcggtctctcgagcacctggctcgagcgtggtttcatccctatcatcgtgatggccatcgtcggtgcccgcgtcgtgcacgttgtcgcgaacatcgaggcctatctccacaacccaatcggggtgttcgaggtgtggcaaggcggtctgtcgtcgtacgggggcctcgcaggcggcattccgaccgcgttgtggtatctccaccgcgacatgccgaacctccgtttccgccgggccttcgacatcgcagcaccggtcctgctcgcctcgtggtccatgggacgccttctcggtcctcagctgatgtacgccggcggtggcctgccgacgaaggcgtggtacggcatgtactacaccggcgagatcggcaagcgcattccggtgccgatctttcagtcgatcgaggacttcacctgcttcctcctcacgctctggatcgcacgccactttgcccgctggcgcatgccggcaggctccgtcgcggtcgccgccctcggattgtggtcgatcgagcggttcttcgacgagttcctgtggctcgcccgtccgcgggtctgggatgccgtcgaggtcttcgcgctcatctgtctcgccttctgcgccgccacgctcgccgtgctgacgtcacggcgaggccgtacgaccgaggtggtcgacctcccgaagctcgtggccacaggaccaaccgcgtgagctcgaccgcgctgctcaccgaccgttacgagctcaccatgctcgagactgcgatcgcgagcggccttgcagaggttccggccaccttcgaggtcttcgcacgctcgctcggcggtcgtggcttcggtgtggtcggtggcaccggccggctcgccgaggcgcttcgagcctttcgcttcgacgacgagatcgtgcgttggctcgtcgacgagcgcgtcatcgggtcaccgaccgctcgctacctcgagcactttcgcttcagcggctccatcgccgcctaccccgacggagagctctacttccctggttcgccgatcctacgggtcgacgcgccgttcggcgaaggcctgctcatcgagacgctcatcctgtcgattctcaacttcgacacggcggtcgcgacagctgcagctcggttacggctcgcggcgggcacggccacactcatcgagatgggctctcgacgcgtccacgagcgcgctgcggttgccgcagcacgtgcagcatggatcgcaggcttcgactccacctccaacctcgccgcgggtcaacgctacggcgttcccaccggtggcacgatggggcatgcgttggtgcttgcccatccgagcgagcgggccgcgttcgaggctcaggccgccgtgatcggatcctcgaccaccgccctcgtcgatacctacgacatcgggcacggtattcgccaggcgatcgaggcgttcggcaccgatctcgcggcgatccgcatcgactccggcaacccattcgtcgaggtacggcgtgctcgtacgctgctcgacgagctcggagccacgaagacgcgcatcctgatctccggggacctcgacgaggggctcgtcaggcgcctggtcgctgagccggtcgatggattcggcgtcgggaccaaggtcgtcaccgggggtggggtgcccacggcacaactcgtctacaagctcgtcgccgtcgaacgcaacggcgttgcggagcccgtcgccaagctctcggcgaacaaggagacgtctggaggccgcaaggctgggtaccgacgcctccgcaaccatcgcatcgtcgaggagttctcgatcgacccagccgtgaccgtcgagccgaccgacgactcgaccctgatggccctcgaggtccccgtcatggtcgagggagacatcctcgatccggagtctgcggcccagagtcgtcagaggctcgccgaccgtctcccgaccctcggcgaggacctcgacgcgatcctcgatgcaacggagcccctgttcgtctgccaccacctcggtccgtcgctgccacgttccgggcacggccagcacgaccagtagcgtgtcgagatggacaccacgtcgctcacgcgagcccatccgagcagcctcggcttcgacgcgcacgtgctcgagcgccttcggcgaaccctcgacacctggatcgaaacccaacgcctcgctggcctcgcggtcgccatcactcgcgacggtgaggtcgccttcgagcactacaccggatgggccgatcgagcgcgcaacgtcccggtcacgccgcagacgctctttcggatctactcgatgaccaaacccatcacctcgatcgcggcgctccagctggtcgaggagggacggatccgcctcgacgatccgatcgcaacggtcttgcccgccttcgccgaaccacgcgtactcgtctctggcggtgcgccagggggctacgcgccagcggtgacgcgcggggcgatcgaacccattcggctctggcatctgctcacccacaccgccggtctcacctacgacttccatcgccagagcgcggtggacgcgatgtaccgcaagctccagcgcaccctcgacggcgccgaccttggagcctgggtcgacgcacacgccgagctcccgctcctgttcgacccgggcacgcactggaactactccatcgccaccgacgtcgtcggccacctggtcgcgacgctgcgaggcgcaccgctcgccgacgtcctcacaaccttcgtcctctcgcctctcggcatgcacgacacgacgttcgaggttccggcctcagaggccgatcgcatcgccgcgatcgtcacccctggtggcgacgggacgctccatcgcctcgggcccgtgcagccggagacccgcgtggcgccgatcgactccggtggcggcgggttgttctcgaccctcgaggactacacacgcttcagcatcgcactcgccctcggtggccgcctcggggacgcacgcctggtcggaccgctcacactcgatgcgatgcgatccaaccaccttcccggaggttcggacatccccaccatggcgatcgccaggccacaacccggcgaccgcccagggaccggcttcggccttggcttctcggtcgtcgatgatccgattgcctcacaccgactcggtccgcgaggttcctacggttggggcggcatggcctcgacgaccttcttcgtgtggccggctcaacgcgtgagtgtcgtgttcatgacacagcttgtgccgtcgaacacgtacccgctcgccgaggaactcgagacgttcgtcgcagcagcgctcacgcggccctgagtcgcacgcccgagccgggctcgcgtgtggcgacccgacgagcctcgcggactcaggcctgtcgggcctcagccgcctgcgcctccgcgatctgacgacgcacgtcgtccatgtcgagggcaaggacctgcgagatcaggtcgtcgagcgcctccttcgggagcgctccaggctgggagtacagcaagatctgctcgcggaagatcatcagcgtcgggatcgacatgatcccgaacgccgctgcgagctgctgctcggcttcggtgtcgactttgccgaagacgatctccggatggacctcggacgcctgctcgtagatgggcgcaaacatcctgcagggaccacaccacgccgcccagaaatcgacgaagacgatgtcgttctcctgaatcgtcgcctcgaagtcgctgagcgtcagattgcgggtcgccatgatacctcttcctctcgatgagttcgctctggcctaacgccaatacccataagggtattccgtgtgcccggagcgggagtcgaacccgcacggccagcggcccggagggtttaagccccctgcgtctaccgtttcgccatccgggccttgtctcgacaccacgaccaggctagccctcggcgccgctcacgcctccacgtcggtgagcagctcggcgagcgacgggtcgagcgcgaccacggcagcagccgtccacaccccaaccggcgagaacccccctgccagccacagtgcaaggtgagcatgcaggcacttcacgccagcgcgcgcaccagcgatccgtggatgcgggacgtggcgtcgggcagaggcatgggcgtgttgggccaactcgagtgcgcgagggtcgacgagctcctcggccctacgaacccctcgtcgagcctcgactcgagcaaccgcctgcacgagtcggcgatcgacaagccaaaaccagttcgattgaggacggccctgccggtcgtattcggccagttcgatgacgatgggccaaccctcgcgagagcgtgcggcaacggtgtagggaatgctgggcaggcgaccaagctggtcggacacccacgcctcgtcctcctcacgcaccacggccacggcgtcctcgccggcgcagcagaatcgcgacgaccaccgccacagcgatcacgggagcgagcgcccggcgagcgagcggacgccagcccacaccgagcacgtcgagcggcgggttgtcggcaggcgttcgaacggcaggcgccgtcgtcgcatcggacacgggctctgcctcggtcgatgcggagtcggtggcctcacccgcctcgtcgctcgccgacgacgcttcgctcccgacctcgccgggaggcgtctgcaagaggtcggcgagccgatcggcgaactcacgcatgagctcggcagacacatccgcaaggactccacgaccgaactgtgcgacgcggccagcgatctgcagatcgaccacgacgtccacgtgcgttccctcgccgtgcggtgtcagcgtcgccgtcaccgtcgccgatgcccgtccttgtccccgctgctctcgaccctcggcgcgaaggacggcaacgccgtgctcctcgtcgagcgagacgaacgacgcctcacccttgtacgaagcggtgatcggtccgaccttgaccttcaccgtgccaaggaagcgatctgcgtcgcgcccggtcaacgccgcacccggcaggcacggagcgatgcgttcgagatcggtcaagacgctccaagcgaccgccggactcgccggcacgtcgaacgcgtttcggatctccaccgctatcctccctctccctcatcagctcgttcctcggcgcgcgagagatcgtgcctcgtatcgacgtccatcgggtcaccttgacacgagaccgacaccaccgtcaggtcccttcgggcgaagagtgctctcgctccgacgtctcctgagactgggagtgcaccgaagaggcgcctcgcgatgcgcacgggattcgctcgcgacccagcatacgtcgccaccgcgagatcgacctcctcgggagccgcggccacggcgtcccacgcctgcgccgtgatgaacggctgatctgcgagcccgacgaccatgccactcgccccgtctgcctcggcccacgccgccgcgagcgcaagcgaactcgcaaggccgcgctcgggatggggattcacgatcacctcgaaaccggtcggcacgagatcgtcgaagcgatcccgaccgaccacgaccgcgcgcgcggccagcagacgtgcgtcggcacacgcgctgagcgcccatgtcaacaaggcgcgaccaccgagaggagtccgcagcttcgcacccggtggatcgaatctggtcgctcgacctgccgcgaggaccgctccgacccacctcaccatgtgaacgcaccagcggcgtgaatgtcgccgtccgtcgccgagagaggcgtaccgctcctgccctctcgacgagcgatgatctcggcaacgatcgcgatcgccgtctcctccggcgtcctcgcgccgaggtcgagcccgatcggcgccgccactctcgcatcgacctcgtcgagatcgacgcccgcctcccgcagacgctcacgacgatcgcgctgggtccgacgcgagcccatcacaccgatatagccagcccgcgtggcaagggcagcctggatggcgggcacgtcgaacttcgggtcatgcgtcagcacgcagatcgcatcgcgcgcctggatctcgtcgcgatgcgcctccaaccacgcgtgaggccatgcgaccacgacctcatcggccatggggaagcgctctctcgtcgcaaagagcgcacgcgcatcgacgacgagcacgcgatagccgagcaatctggcggttcgggcaagcgcatcggcaaagtccaccgcgccgagtaccaccatggtggggggcggcgcctcaacggccaagaccaccgagacctcgcgcgagcgcgtctcgccgagtcgaccgagctcgcggcgcgtacccctcgctgcgtcgatggcccctgccgcctctctcgcgacgacccgatccaacgactcgttgccgaggctaccgaagcgtcgaccatcgccgaggaccgccaacgtcgcgccgaccttgggcatcgcgacgcccacgtggtcggcggcgaagtagtcatcgactgacgagtccacctgccacacgaacgcgaggctcgccgcgacaccgtggccgatggcgtcgacgacctcgtccaagaagtctggcggatcaggatcgacgagaatgtggaacgtaccgccacaggtcagaccgacggcgatggcctcgtcgtccgagtagccaaaggcgagcgtggccgccccccgctccacggagcccgtgatgccgatcgacgcaaggaccgcttcgggggcatcgagccgcgcgagcgcctcggcaacgacggccccctcgacgcacccacccgacaccgacccgacgacctcagctcgctcggagaccgccatcatggtgcccggttcccgcggtcctgatccttcgaccgcgacgacggtggcgagcgccgcgcgcacgccagcccttcgccacgcgacgaccgcctcgagtgcctcacgcacggcccgcctcctccacgatcctcaccgctgcccgctcgagcgacgcaacgctctcacccgcgaccaaggcatccacgtactcgagtgctgccgccatcccgcgcgcgaggggcgcgtagccatccaggccagccagcggattcacccacacgatcgcggcgctgcgccgacggagcgaggccatcgctcggcgcatctgctcgggatcgccccggtcccaaccatcagagcacaccaccacgaccgctgagcgcaagctgcgccgcacgccatggacgaaggcttcgatccctgcaccgaggcgtgtcccgccaccccagtcagcgaccagcgcgaccgcttcctccacggcgacgtcaggatcccgcccaccgagcgctcgactgatgcgggtggcacgggtcccgagcgcccacgcctcgaccttggcgacagcggcgaacacccacgcgagacggagcatggccacggcgtagggctgcatcgagccggaaacgtccagtagaaagaccacgggacgcggaaccgtcgtggctgctcgataccgacgctcgatgggttcgaggtcagtcgcgaaggcagcgcgcatggtcgcccgcgcatcgagctgtccgcgaggtgcggaacggcggcgcgcgctccgtcgcatcggaggggcaagacgaagcgccgcgagcgcctccatcgcctcggcgcgctcggtggcgtcgagcgtgccgaggtcggccgagtgcaggcgctcgaccgccgagtagcgaacgacacgctccgcgcgacgctcggtctcgttctcgccggcaccgtcgtcgccgtcgtcgagggccaccatggtcggcagcacgaccttcgacgcgttcggtgcgacgatcccgagataggaggccgctagctcgaggtaacgagggacgtcgtcagcacgcttgacgaacgtggcgagtccggtctcgagtaccactcgccgacttccaacgcccacgacgtccaaggcttgctcgaaatcgatcgtactcgaggtcgaaacgcgcaatccgccgctgcggaggtgatcgacgaacccgacgacgaagcgttcagctcgacccaccatcgccgtccaccacgccagcacgctcgcgaatcgtccgcacgccgatcgcctcgatgcgctcgagatcttctcgtcccttgacgacgagtccgagcgtggcatcgacgagctcatcgtcgaggtcgtcgatgccgaggcgcacgagcgcctccgcccaatcgatcgtctcggagattccgggaggcttgaacaggccctctcgccgaagtgccgcgacgacacgggcgatctccgtggcaagccgagcgctcacatccgggacgtgtcgacgcacgatctcggcctccaacgacggaccgggggcgtcaacccagaggtagaggcagcgcctcgccagggcctcgtggagttcacgcgtccgattcgacgtgagcacgacgatcgggatcacctgggccccacgagcgccgagctccggaatggtcacggtccaggtggagagcacttcgagcaggtaggcctcgaacgcctcgtctgcacggtcgacctcatcgagcagcagcaccggtggacgggcaggatcctcgccgccgagtgcccggagtaccgctcgctcgacgaggaaccgaggtgagaacagctccgcctcgatgtcatcgacctcgcgaccgcgcagagcatctcgcgcgagcgcctcgagcgtgcgcacgtgcaagaactggcgtccccagtcccagtcgtagacggcctgatggacgtcgattccctcgtagcactgcagccgctccagcgacccgccgaagacgcgcgcgagcgcataggcaagctcggtcttgccgacaccgggctccccctccaagagcagcggtcgctgcagcgagaccgcgaggaacccagacagcgccacccgtggcgaggccaggtagccaacggcgtcgagtgcacgacgcagatcctctggtcgttcgatgccgtgcgctcgaagcggctccggagacctaggcaagctcacgcagtgctcgtgccaccaggacctcggcaaggtgacggcggtagtcggcagacgcgttgacgtcgctcggcggttcgagcccctcggcggcacgtcgggctgcctcgtcgacgccagcaccgctcgcgagcgcctcctcgacgcccatcgcacgtactggcgtcggtgccatgttgacgaacgcaacccgcgtgctcccgttgcgcaccgcgacgactcccacgatcgcccagtcctgcgcccgacggttgagcttctggaacgagtagtcccgcaccgccggcacgcggatctcggtgaggacctcgtcaggcgcgagtgccgtctcgaggaagccccgaaagaaagtgctcgccgggatgcgccgctcgcccccgccgccgcgtgccaccatcgtcgcctcgagcgcgagcagcgcagcaggcagatcggcagcaccgtcaccgtgagcgacggagccaccgatcgtcccgcgatggcgtacggacggatcgccaatctggcccgccaccgcagcgagaaccggcacccgacgccgaagcacctcagaggtcgcgaggtcatgatgacgagtcagggccccgatcgcgacctcgtctccatcgtcgcgcacgtacgagaggtccgggaggtggccgatgtccacgagcaacgacggtgaggccagacgcagcttcatgagtggcagcagcgagtgaccgccagcgaggaacttggcgtcgtcgtgctcgccgaccaaggcgatcgccgcgtcgatcgactgcgctcggtggtagtcaaagggcgctggaaacatgcatcctccctgtcaggcccgatgggccgttgcatcggcgatcaggcgccagactcgttcgggggtggccggcatgggcacatcgcgcacgccgagcggagccaaggcatcgaccacggcattgatcaccgcaggtgcggacccgatcgttccggcttcgcccacacccttgacgccgagcggattggtcggcgacggcgtcacggtcgatcccatggtgaagctcggtacctcggcggctgacggcaccaggtagtcggccagcgacgcggtcacgagcgtgccagcctcgtcgtacaccgcctcctcccagagtgcctgcgcgacaccttgcacgatgcccccgtgcagctggccctcgacgatcattgggttcacctggttcccgcagtcgtcgaccgcgatgtaggagacgagatcgacccgacctgtctcttcgtcgacctcgaccacggcgatgtgggtgccgaacggaaacgtaaagttcggcggatcccacgtgacctgggcctcgaggttcggctccgtgccgtccggcaggttgtgggcggtgaaggcctcgaacgcgatggcgccgagaggaagctccttggtgggcgaacccttgacacggaaggtcccctgggcaaattcgagatcttcctcggctgcctcgagctggtgagccgcaatgcgcttggccttctcgagcacgcgttccgtggcgaggtagaccgcggtaccgccgaccgagagcgaccggctcccgtaggtgtccatgccgagtggcgcgatcgccgtgtcggagtgcaagacatcgacgtcggcgacgtcgatgccgagtcgatccgcgacgatctgggaccaactggtttcgtgaccctgtccgtgcggcgccgtgccggtgaccacctgcaccttgccggtcgggagaatgcgcacagtggcagcctcccagccgcccgcgccgtagctcaacgacgccaacacccgcgacggcgcaaggccgcacatctccacgtagcacgacacgccgatcccgaggagccgtcgctcgccagcggcacgccgtcgcgtctgctcgagacgcagctcgtcgtagcgagccagtgccagcgccttggcgaggttgtcgtggtagttacccgagtcgaacacgaggccaggtgccgagctgtaggggaactgctcggccttgatgaagttccgtcgacgcagctcggccgggtcgaggtcgagttcgcgcgcgagcgcgtccatggcacgctcgatggcataggtcgcctccggccggcccgccccacggtaggcatccgtcggcgtcttgttcgtgaacagtccggtgcactcgaatgagtaggcaggaacgtcgtagaccccgtgatagaggaaggcaccgagcaggggaacccccggggtgacgagctggaggtaggcccccatgtcggcgaggagacgcacccgtatcgccgtcacccgtccctcggccgtcgctgccagctcgatgtactgaacctgtccacgaccctgaatcgtcgctaccgtgttctcgccgcgctcctcggtccacctcaccggcacgccgagacgtcgagcgaggacgaaacacaccagctcttcggagtagacgtcgagcttcgagccgaaacccccaccgacggcgggggcaaccactcggacgtggtgctccggcacgcccatcgtgagcgccaacatcagcttgaggatgtgggggatctgcgtcgcggagtacaccgtgaacgagccgtcgaccggcgacggcacgacgaccacgcctcgcggctccatggctgacggaatgagccgctgctgcacgtagcgctcgctcacggtgaccgccgcctcgcgaaacgcgcgctcgaccgcctcctcgtccggcttcaacgaccagacgaagctcacgttcgacgcgaggtcctcgtgcgctcgtggtccgcccgctgcggccgcctcaagatcgaggaccggatcgagctcggcgaagtcgagctcgacggccgctgccgcatcgacggcctgttggcgtgtctcggcgacgaccaccgcgaccggttcgccctggtagtgcacggcgtcgatcgccaggggatagtgggcaggattgaccatgtccggcgtgaccggccatgcacacggcatgggcgcggcccactcggatgccaggtctgccccggtcaggaccgcacgcacgccaggcatcgcggccgcttccgtggtcgacaccgacgtgatccgaccatgggcaatcggcgagcgcacgagcaccgcccagagcgcacccggaacgacgaggtcatcggtgaaccgcgcctggccggtcaggaggcggggatcctccttgcgaagaacccgctgcccgatcaccccgcccgttgcctgcggctccatcgtcgtggtcatgcctggacccccatgcgctcgtgcgcggcgagaaccgcgcgaacgatgttgtggtaacccgtgcaccgacacaggttgccctcgagcccgagtcgcaccgttgcctcgtcgagcaccgggttctcacggatcagcgacagcgacgccatcaccatcccgggcgtgcagtagccgcactgaagtgcgtgatgctccatgaaggctgcctgaaccggatgaagcgctccgtcgggcccggcaagaccctcaatcgtggtcacctcctcaccggcaacctgcgcggcaaggacggtacaactcttcaccgactcgccgttcaccaagaccgtgcacgcaccgcacgacgaggtgtcgcagccgatattggtcccagtcaggcccagcgcatcgcgcaggaacgaaacgagcagggttcgaggctcgacgtcagcgtgtcgcctttggccgttcacggtcatctcgatcagcatgcggggcctcccttggccttcgatcagatcgtcggagtcgggccccgacgggggcaccgagcggaccttaccacacgccacccagctcgtcacggatctctcctccgcgagccccggctcatgaccgtcagaacgccgacttcggtccccgaggtctcgcttcgccgtggcggaccgcgagtgaccccttgctcttgccgccgagttgtcaatgtgccgtagggctacactggaagccgaggaggcaccatgctcttcgtcatgatcgcgttcgtcgcagcggccgccctcatcgccgtggcgatccactttggtccgcatggctccgtcgtctccggtgtgatcgggctcgtcctcggtctcgtcatcgcctggtccgcgcaggcagcgatcagcacggtcggcgcctgggccctcggtgctggtgtcgtcgtcgtcggccttgcgctcgccggcattggcctacgaggggttcgaggcctcaacactcgcgctgcgatcgccgcaccgtcaccgcttgcacgcctacttggtgaggaagccgtcgtcgaacgcgatctgagtcccatcggcgccattcacgtccatggcgagtcctggaccgcgaccaccgagacgggcgagtccgtcccggcgggtacacacgtcttcatcacgcgagtcgacgggctgcgcgtctgggttgttccggctgccaggccggaagatcgccaacggcactccgcctagaaggagggatcccatggccccgctcatcgttctcggcatcatcgtccttgcggcgctcatcctcatcgcacgaggtgtgcgcatcgtcagggagtatcagcgcgtcgtcgtgttcaggcttggtcgcgcaatcggcgccaagggtccaggactcaccctgatcaaccccgtgatcgaccgtctgagcctcgtcgacctgcgcgagcaatacctggagatcccgcatcagacggcgatcacaaaggacaacgcccccatctcgatcgacttcatcatgttctacaaggtgatcgacccggtcacgagcgtcgtcgccgtgcgcgatttctcgggcgctgcgctgaacgtcgccgcgacgacgcttcgcagcatcgtcggtgacatgtcgctcgatgacgtgctctcgcgtcgcgaggacatgaacgccacgctgcgagtcaagctcgacgaggtcaccgagcgctggggcgtcaaggtctcgaacgtcgaggtacgagagatcaacccaccgccagccgtccaagaggcgatgacgcgccagatgtcggcagaacgaagccgtcgagcgctcgtgaccgagtccgagggtcagcgccaagccgccgtgacggtcgcagagggcgagaagcaggcggcgatcttggcggcagaaggtcagaagcaggcggcgatcttggcggccgaggcagaacgccaagcggccaaactccgtgcccaaggcctcgccgatgcgctcagtgccatcatgcctgaagcacgcaacgccgactcgcgcaccatcatgctccagtacctggacgcactacgcgagcttgcgcgctcgggagccaccacgtacgtcattccagctgagttgaccgggttcctcggacagctcgcgggtgccctcagcgccagtccaaccgaaccctccacgaacggcgtcacaggtcattgacggcggagcgccactcgtagacacagacgggccctccgtcggtgcatcccttcgaacgacggctgaacgcgctcgctgccgaggtcgtcacgctccctgacctcagctggcggctcgttggcgcctcgatgctggccaggacaccccggtgctgagcctggccggtaccacgatgtgcgcttgtgatcgtggcgccatgacgcactgggcgctcgtgcccggcagcgatcggtaccgcgaccacttgcgaccatgtggcgccgctcagctcccgtgtgaagacgggaagctgaacggcgctctcacgcatttgtcgactaaggcccaaggtaggaccagcccaccgcgtcccgccaaccggccgaaggcacgaccccgccggcaatcctggcgcgagcgaggccgtacccactatgacggtggacttcgtcacgcgccgtccaaggcactacctcatgtcccggcgtcgcagacgccactcggtgcggagggcgcgccatcgaagcacacgacccgagacacgtcgttccgcgatcgtcgacaccggctcggcggtcctcacccgccccaaccgagctctctcgtatcgacaccaaacgcccctgccaggccaaccctggcaggggcgcgcgcatgtgaggccgcgccaggcaacgtcagcgccgtgcttcggctccctgccgacgtcgtgtcagcgaatcgacggtcacggccgcaagcaagaccagcgccgtcacgatgtactcggctgccgcactgacgcccaacaatccgaggccgttgtagatggccgcgatgatgatgccaccaagcacggcgtgcaccatcttgccgcgcccgccgaacaggctcgtgccgccgatcactgctgccgcgaccccatagagcacgagcgtgccgccgtcgatgttctccgagatcgatccgaggcgcgaggcgtagacgacccccgcgatacccgcagtcaagcccgagagcgcgaaggccgcgatccgaacccgcgagagattgatgccggcgcgacgagcggcctcggcgttgccaccgatggcgtagatgtaacggccgaaccgggtccgattcaggacgaatgtgtagagaccaagcacccccacgagaatggggacgacgaacggtacgccctcgagcgtgacggtcaccccgcggttggtgttcgccacgatcagcaacacgaccgcagccacggcaccgagcgcaatacgcagcgcaatgacaccccgcggaggcgccgagagcccagcccgccgcatccgctcggcaccgaagaacatccacgcaccccagagcgcgaccaccaccgctgcgatgacccaccctgcgaccaccgagagattgccgttgacaatatcgttgaggatgttcgacgagatcgagatcacaccgccggccgcgggcgccgcgtggtcgatcatgtagagcatgaccccttcccaccccagcagaccagccagggtgacgacgaaggacggcaagttgagcttcgtgatgaggattccctgcaccacgccgatgagggtggagaccgcaaggccagcgagtagcgcgacccaccacggctccttggcgatgatcggcgaagccaggatcgccatgacggaggccccaacaccggccacgtacccaaccgacagatcgatctcgccgagcagcaagacgaacacttcagccatgccgagcaggacgaacgtcgcgccttgcaccagcaagttgacgagattgccggcggagagaaacaaggagttctccgcctggaagatgatcacgatgacgacgaggccggccaacaccggcaacatgccgctctcacccgaacgcacgcgccgccaccagctggagatccagcttcgggtgtccgtgagcacgatctcggcaccctgggcaggtgcgctcgccggtgccgccgccggcgcatgtccattcgacgaaggggcctcctcgacatcaacggggagttgctctcgttccaccatcagactgaggcctccttcgcaccacgcggggcacccgactccagcgattgacccgtcatcagttcgacgacgcgaccaggctcgaactcggctcgatctccctgggcgaccatccgcccgagatgcaaaatggcaatccgatcggccgttgagaagacgtcttgcaggttgtgggagatcaggatgaccgacatgccgctcgcggcgaggtcacgaatgatgcccagcacgacccgcgtctggctcacgccgagagccgcggtcggctcgtcgaagagcaccacgcgcgagttccacagcacggcgcgcgccaccgcgaccgcttggcgctgacctcccgacagcgagcccaccggctggcgaatcgaacgaaccgtcacgaccgacagacccgcgagggtcgagcgcaccttctgctccatcgtcgcctcgtccaagatcccacgacgacgcggctcgcgcccgaggaacatgttctgaacgatgtccagattgtcgcagagggcgagatcctggtacacggtggtgatgcccaaacgctccgcgtcccgtggatcatgaatgtcgacccgctggccatcgatcaggatctctccaccgtcgatccgatggataccagagatcaccttgatgagggtgctcttgcctgccccgttgtcgccgacgagcgcggtgaccttgccggggacgacggtcaagtcgacgtgttcgagcgccttcaccgcaccgaagttcttctcgacgccccgcagctcgaggagagcgccggacactgcctgggtcattggacctcccatcaggctcgtgacgaaggcggggtgcgcagacgactgtccgcgcaccccgctcgtgagagacgctaggccttgatgcccgcggccgcgcacgccgaggcataggtgcccgagcacagctgcgacgccggcacgaagttgtcagcgatcacggtcgacgccatgttcttggtggtgacccactcgggcgtcagcaacaccgacgggatgttgttgcccgagaccggatcatgggtggtgccgttcaagagagctgccggaggcgtcttaccagcgcgcaggtagagcgcgagggagacggccgcctgggcctcctgatagatgggcttgtacacggtcccgcactggtaaccagccaggatgttctgcaatccttggagcgtcgcgtcctgtccggtgaatgggatcgtcttcggcgcgatgtggagcgactgcaggtacgagatgatcggcgcagcattctcatcgttcggcgtcaccacggcgttgatgttgggatgcgccgtgtacatctgctggaactccgtcaacgctaccgacggcgtccacgtccctggaggcgtcccgaccaaggtccacttgcccgacttgaagtacggatcgatcaccgaatcgtacccctcggcaaagagggtggcgttgttgtcggtcggtgcgccacgcatgaccagcacgttcggatgcgtcacgtgccacgcggcgacgcaggcgacgaatccctggccaatcagctgtccgacgcggacgttgttgaagctgacgtaataatcgctcggcgaggagcccagcgtgagacggtcatagttgatgacgcgaacaccgtgctgagcggcgtacttctcgatctcgacaccgacgcccgagtcgagcggatcgaagatgatgacgctcgccccacggctgatcgcgctctgggccatcgacagctcggtcgcgtcggagccctgggcgttctcgacgatgtactggttggacttcaggccagccaactggaaggccttcgtgaggaacggcgcatcgaactcggtgtagcgagccgaggacaccgtatcgggcaagatggcagccacgagacccttgcccttggccgccagcgagctcaggctgctcatggcggtgaagttccggttgaacgaggccgctgtcaccaccggcgtggacgcactcgtggaacccgaggatccaccgctcgagctcgaactggtcgagccacaggccgcgatcgccatcgcggccccagcgaccacgagcgacgctcgcgagaacgacgacattcgcacagacaacccccttgtcgtggcggggacggttccccgcgcctctgcgatggtacgcaggcgtgtgtaaacgaggggtaaacacttgggtcgggacgtgaaaaatctgtaaacggccttacgccgcgtcccgcaccagccgatagccagcacgcggttgcgtgaggatcaacggtgcgtccccgggcgcctcgagcttggccctgaggcgccggatgtagacgcgaaggtactcagtctcggtctcgtaaccgcgaccccacaccgcacgcaacaacgccgcgtgcgacagcagccgaccgtcgccacggatgagttcggcgagcaacgcaaactcggttggcgtcaggtgcactggcacaccatctcgctcgacgagctgacgttcgagatcgaccacgagacccgggcgtaagacgatcgtgcccttgtcggactggctcgccgcgggtcgcgttcgccggagcgtcgccgtgatcctcgccatcagctcttcgatgccgaagggtttggtgaggtaatcgtcagcgcccgcgttcagtgccgtcaccttgtcctgctcgccacgccgtgctgacaccacgatgagtcccgcggaggtgcgctcgcgaatctcgtagcacagctcgaagctctcgacgccggggatcatgaggtcgagcaggatgatctccggccgccgtgcttcgagcgcagccaacgcttccgaccggtcggaagcggccgcgacctgatagccgcgcacgagaagattcgcacggatcaggtccacgatgttcggatcgtcctcgaccaccaggaccgacgtcatgagcgctccatcccgaggacggcgtcagccgctgcctcatcggcctctgggagctggacctcgaatcgcttgccgacgtctcgcggcacgagccgcaggacgccgccgtgggcggcaacgatgctcgatgagatcgcgaggccgaggccattgccagtgccttcgcgatgacgctgcgcgagctcctcgacgctcaccccggccgggagcggcgccccgtcatcctcgaccgcgatgaccaccccgccatcgtcgtcgcgtcgtgccgtcacacgcacgtgcgttccaggcggattgtgagacgcggcgttgtgaagcaggttcacgagcacctgctcgatacggtcgtggtcgacgaagacgggcgggacgtcgtcgaggtcgacgtccaccaccacctccggtacgcaggcaacggccgcctcgacgatgtaggcaacctccgcccagtctcgccgcaccctgagggtgcccgactcgatcgcggagaggtcgaggagatcaccgacgagacgggccagacgctgtgactcggcgacgatgcgttgcaagaatcggcgctcggactccgtgtcccaacgcacgtcttcggcaagcaggctggaagcgtaccccgtgatcgccgtcaggggcgtgcgcaactcgtgactgagccgctgcacgaaggcaacttgcagtgcctgcgatcgccgcaaggccgccgcctcgcgttcggcctgctccacgcgccggcgctccagggcgagccggacggaactcgcagccgcagataggagctctgcagcctcatcgggcggggcgtcgtccccaagcgtggcgaggagcgcagtcgactcggcgccgtcgagttcgatcacgcgcgcaagggtccccggcactcggtccagccgcgcctcgatcaacgccgcgccctcgacgagttcgagttcgaccgccccgagaccatccttcagcacggacagcgccgcgtccagcgccggttcgacacgcgcaccccccgccagcacctcgaggaagcgttgaagcacctcgagcacgtggttgcgctgctcaagggcgtggagcacgcgttcgcgctccaccgtcgtggcgatggtcgcggcatagagcgaggcgagctgtgcccgagtgcgatcgtgctcgagcggacgcccgacgatgacggccagtaccccgatcgctccgcgcggtccgagcatcggaacggcccagagcgagcgacgttctccgtcgagctcgagctctccgtcgcgagctgctccgacggtcagcgcctcggcgatcgggccatcagcgtcgacgatcgcctgctcgagtcgcgtctgcgcgagcggatcgaggccgtgagcgctcacgacacggagggcccccatcgactcgccgaggagcgccgcgaccggtacagcgccgagggcgacggaacacgctgccgtgatcgccgtgacgccggtaccctcgtcgatggcggccacctgctcgacgaggctcgcaaagcgagccagctgacgtcgtgaactctcctgggaggacccggcgacgatgagctccccgagttcttccggccccaccgtgccgccgtcgaccgtcgcgacgaccttgccatggtgcagcacgacgacacgatccgacgcactcgcgacgaggccgagatcatgcgacaccagcaagactccgacaccacgctcccgaatgcgcgcaacgagcgccatcacggccgcggcctcgagcgcaccgagcgaggccgtcggctcgtcgagaaggagatagtccggctccctcgcgacctggcgcgcaatggcgacgagccgccgctgtccaccggagagcgttcgcaggggtcgcgagagatcgtcgatggcgaggccgactctcgcaaggacctcgtgggcggctgcgtgcgtccgacgaggcgacaccaggcgacgaccttcgcgaccgagaacgaggttttcggcgatgctcaggctctcgacgagctcgacgtcttgccagaccacggcgacgtcacgatcacgaggctgaatcgaccctgcctggatcgccagctccccagcgatggccttgacgagcgtggtcttgcctgccccgttgtcgccgacgaggccgacgagctccccagggtggatcacgagcgagacgtcgtcgagcaccacgacggagccgtaacccacgcgcagaccacgcaggtccaatgctcgagcatcaccgtccaacgcggccgccaccaccggctcgagtttaggtgtcatcagcgcgtccgagagacttcgtaggctggtgccgtgccgcccacgatcgatcacctcgtcgccgaagcactgagcccgcacgccaaccggatcgcccccgtacccgtggcgctcgccctcgccacgggcgcagcccgcgcccacggcgtcgccgtgagcgctacggggatccttgcgaccgcagcgcgcctcgatggggcgctcatcggtcgcccagccctccgggaactcggcgcgcgcggccgagggatcgcgacgctgctggacgccgtcgacgatgcccttggcgaccgaggccttgcccgcagggagcgagtcatgcacgacctcgtcgccaggtcggcgccggcctcgatcgagaccacggtgccagacgacacgagccttggcgtcgggctcacgctgccgacactgctcacactggcactcgtcgtcgagttcgcgccaaaggctcgcctcgcggtcgacgtcgttgcatcgcccatcggcgatcgagtcgtcgcagagctggagcgtcgttcgcgccacgctggggcgtcgatcgacctccgacctgcgccactgccgctcgagatcgatgcccaccggctgccgacgcagctggacgaggcccgctggctcgcaacggccatcgagaacacctccatggccggtcgtcgcaccgaggtggtcgccgcaccaggtgatccacttgccgacctggtcatcgctgccctcggccggcgaggtcaggcggtcgtcgacgaacgaccggtcctccttcgcgacacagcactgtggcgactcgctcgcgatggcctcatcctcggcaccctggggagcctgcccggtgagcctcggagggagcgccgcctacgtcggatcgggcccccgccggcgaacctcggcgacctcgagacctggctcgacgaggcccgctggacgctcaatgcggaggatctgccaccggagggcgcagaagaggccgcggcggcgctgctcttcggagcagcgcgggcaacgcgcgccacggatccgacgagttccgcactggcggtgatggccgacctcggtcggataggcctggagcgcgaccgtcagcccgatgccgccgttcgcgtcaccgcgacgccgcaggacggcttcgagggccaccgattcatcgtgggcgccgacgccgaacgcttcccggtgcccatcagcgatgatccggtgctgccactggatcgggcggtgcgcctcgagctctcgctcggccctgaggccgctgccgtggccgcatggtaccgcggagccatgacgctcgtgggcgcgcgatgggtgacggtcacgatggcacacacggtcgaggctcagctcacccgaccgtcaccactgctcgatgacctcggcatcgagatcgccgaccgtcaccgacagacacgcccgccgggaccatgggcacgccgagctggcgtcatctcggcgctccgccgtcgcgcgactccgagcccctggacctgggacatcggtgcgcaccatctccctcgctcgctcagcgtcacgcagctcgaagaagctgcttcgtgcggcgcacgcttcgcgctctcgaccctgctccgcgtgagcgaaccagagcccgaagggcgacaggcctcgtcggcgaccatggggacccttgcccacgccctgctcgagcaggacgacctcgtcctcgatgcggaggcgttgttcgccgcactcaccgacctcgtccgttcgcacccgtcaccgcgggtgcgcacggaactcactcgagaccccctcggcgtgcatcgactccgagacctcgccagtcaccttgcgcgagtcctcgcaagcgaggacctccgccccatcggggaggtccaccgcgaaatcccgttcgaactcgagctctgcggaactcgactccgggcgcgcttcgaccgactggaacggcagggctccacgtggcgtgtcctcgactacaagctccgtgcctcgaggcccgagtcctggccgatcgcctcctccgatcgaccggtacagctgtgtgcctacgcgctgctcgcagccaaggggtcgagccctcgcctccctgaccggcagcccccgacgagcgtgacggcggcatgggtgctccttcgcgcgcgcgacgcgcacgtcatcgccccctccctgcctgatctcgccgtcatcgacgacgagatctgcacgctcatcgagcgactcgatcgcggccagctcgacctcgaccctggcggccgcggcgcaccgtgccgtctgtgcagacgccgcgcaacctgcggtgtcgcgtggcaaggcgagggccgctagtggaactcacccaagcgcaggatcgcgccgctcgccatcagggaccgcttgccgtcatcgccggtgccgggaccggcaagacactgaccatggtggagcgctatctgcgcctcgtcgccgatggggtcgagccctcggccatcgtcgcggtcacctttacccgtgcggccgcagccgagcttcgcgctcgcgtgcgcgcagcactgctcggcaacgatgcctcgctcggtgcctcggtcgacgccgcactcatcaccaccttcgacggcctcaaccatcacctcgtccgcgcctacccgtgggcgcacgacctcggcaccgacgtcgaggtcgccgaccccgagatcggcgcagcgacggcttccatcgaggccggcgcgctcctcgctgctgcactcggcaccacgacgctcccaagctcgctgacactggttcaggcactcgccgacgaggcccagcgacaaccagagcgcaccctcgccgccctgtccgtccccatggagccggcacgcgatgatcacgtccggcgagcgcgcgcattctggcgtgacgttgcgctgcgtctcggcactgcacttgctgcgtcgaacgccgcaaccgacgcccagcgtcgcttcctcacccaggcccagctcctcgcgaacgccatcgatgcatggctcgactcgccccacaccgacgcctcgggcctggtcgcagacgcgcggtcgatcgggctccgatctcgcggcgccggcatcgaccaggtgcgatccgtcatccaggagctgcgtgaagcactcgacgatccggctcgccgctggcaggcgctcggctggaccagagccgatgaactggtcaccgtacgtcaacctcagctcgccacgatcgccgcatcggtgatccgcgcgggcgacgagcgtcgccggcgggtcggtgaggccagcttcagtgccatcgagcgcgcggccctcgccgtcctcgaagattcgaccgctcgcgccgaactctcggatcgctggcacgctctgatcgtcgacgagttccaggacgtctccgagaaccagctccgactggtggagctcctcaccagcgtggtccaaggacgcgccgccgtggtcggtgatccgaagcaagccatctacgccttccgaggcgcgcggcccgaactcgcgacaagcttcgccgagcggtcggccgtgatcgagctcgaacagtcctttcgctctctgccacgcatcatcgacctcgccaatgattatgcccagcgagccctcggggcctccgagcgcctcaggccgacgcgaagcgcgccgtcgagcgatgggtccatcgccgtggtccaagtcgtcgggggcagggccgtcgaacgacgccgaggagcagctcgcgccgtcgcggctcgcatcaagcgcgacatcaccgatggcacgctccgtgctcgcgacatcgccgtcgtcgcacgtcgctgggccgacctcgacgactaccggcgtgagctcggctcggtcggcgtcgccgccatcgcgagcggtggcggcagccttctcgacacgaacgtcgggctcctcgtgtcatccatcctgcgctggctcgccgacccgagcgacgacgccgccgcgatcgccgtcgctcgagcagacgtcatagggtttcgagacgacgagctggttgcgtacgcccacgaacgcgacctgacccggccgtggtcgacgttcctcgaagcactcgacgatccacgctcacgacgtcttcggaccctgcgggacaacacgcgcggcgcgagtgcctcctgcgcgatcgtcgcagcgtgcgagctgctcgagatcgacgacgcgctcgccgagggcccggaccctgagcgaaccctcgccgatctgcacgccatggtcggcctcatcgcgcgcctggcgacgggtcgctcgctcggggaggtggtcgcgctgctcgaacgcttgcggactacgggagtctcactcccccgaccacccgtcgctggtgcggacgccatcacgctcaccacggtgcacggtgccaagggtctcgagtggcccatggtcgtcgccgtcggtctcgaagccgacccacacccggcgctgcccgaggggttggtgctccacccgaccctcggcgtcgcctggcgcgaccgggacgaacagaacccgtcctcacgcgcgctcgagatcggcgctcacctcgcccacgagcgcgagcaggaacaacgtcgcctcacctacgtcgcgctgacacgggcccgggacacggtcctcgtcgttctcgacggcgacgcggactccgcgctgcgcgagagcctgcacgcggtcgggacgaacgagtggacgaccatcgatgtgctcgccgacgaaccagatcgcgacggcgcagccgacggcgccgatgcagtgcccatgccgtcgtcgccgccccccgatagcggggccagcgaggccgacgagcccgcacccgtgccaccgccgaccgccccgccacggtcgatcgctggtctggccgctaccctcacctgcccatggctcgcacactggtgtggccccgagggggccgacgccctacgccatccgaccgacgggctggtgcgggtgcccgcagagagcgcggcactgtgcggggtggacccgacggtcccactggcccccgtcgttcgcgacgtgcacctcgggacgtggacggtgaccgcggtcgcgctcgccgtgaccgacgccgccgtgatcgtgcccgtacggagtgtgcgcgcagccgaaccagaagctcgtctggcggcggcactcagcgcacacgcccttgagcgacggagcgccgtgctgctcgcgctggacgaaggcgtcgcgacggcgatcgaagcggtcgccccagaggacgtcccggtcgcggcggcccctccctgtcggcgctgtcgctttcgacaccgttgcccgggatcgcgagtcacgttcgactcggttgtccacaccgcggtcgtcgacgaagcctaggctggtgacgtggcagcgatcgatgtggccggtttcgtcaccgacctgaaggaccacgcgctcgaccatggattccacgtccacgatgagcgccacttcgtcgagacctactccctcaggcagtggtgggaggtcgatctccatccagaggaggggtgcggacagcccgtcgacctccatctcgcgctcgacgtcgacccgcgcgtgttgctcgcgttcgaggacaccatggccaccttgcccgatgacgccgaaccgcccgacgacttccatttcccgctgaccttcacctggtcgctgccgccgcttccggtcgacaccgacatcttgcggctggccgtcgagctcgcaggcgtgaccggtccggcgctcccgctcgagatcgcggcaaccgacgtcgtctcctccccgaccgacgctccagaacgacggatcgtcatcacggcacgctgggccatctcactgtcgcgagtcgtcagcggcaaggagtcgctctgcgagctcttcgaccgatcgcgagaggtcagcctctacttgctcgagcactacacgcgctggcaagccgacgaccgctagccatccgccgaggtcgactgcagcgaaggacaggcatggagggttggacggacgcgagcgacgcatcgctcgccgttggcatcggtcgatggcacgaagcagcgctgcaggaggcgtaccgacgctacgcgtcgacggtctggggcatcgctcgacgcgtcacgcgcgacgcgatgatcgccgaggagatcactcaagaggtcttcctgaccctgtggcgcgaaccggaacgcttcgatccggcacgaggatccctgcgcacctggctcgcaacccttgcacaccgacgggccgtcgacgccgtccgccacgacgcagccctcaggcgacgcgaggaccgcgaccatcaactcacgaggccgccgacgaccgccgagatcgaggtggtgatggatcgcgtcatcgttgccgacgcactggcctctctctccgagcaagaacgtcgcgccatcgaactcgcctacttcgacggcctcacctaccgcgaggtcgcagcgcgcctcgaagaacccgaaggaacggtgaagtccagaattcgaggagcgctgacgaagctgcatcggcagatggtctcgacgagaactccggaggcatgatggagcacgaggaagccgcatcactgcttggcgcctgggcgctcgacgctctcgaccccgacgaggccaaggccctggaggcgcacctcgcggtctgcacgcagtgtgcgctcgaagccgacgaactcagggctgcagctggcctgctcgcgaccaccacgaccgagcccgccccggatctgtgggactccatcgccggacatctcggccaatcgccagccgaacctcgccaaccaaccgtccacgcacctcgacgcccgagggcggggcaccgacgcggtcgcatcgccaccgtcgtcgcgggcctcgcactcgccgttgccggcgcgggcatcgggggcgtcgtggccctggcacacgaggtccacacattgaaccagcacgcagccagcctcggcacggcggcctccaccatcgccgcgacccccggcaccaccgtgatcgatctcacagactcgcacgacatcccgaccgccacgctcgcgctcactccgtcggggaccgcggtcctcaccgccgtacggctaccggcactcagtcgttcgaagacctaccaggtgtgggccatcacgacccaaggcgtgatctccatcgggctcctcggcgcaaatccgacggtcacggtcctgcacgcgccgacgcgtggcctgcacgcggtcgcgatcaccgcagaaccggcgagcggcagccctacgccgacgagcgctcctctcgcggaggcgcgccttacctaactctcgtgcacggcgcgcaccgagcgcgacggcactcccaggcggccaagtcagggcctgcgcgctcaacagcgcgcccgtcccaccatggtacgtcccagggagctaggcgagcgtactccgcgaccgttcgcccgggaaccgcatcgccacgacggaaccgtctcgctccaccacgagcactcgaacaccgcgggcagcttgcgccgccgactcgctgagtcctcggaatcgaacgttcgacccgagagcagccgtgaacgtgactccgtccggttcgacgacggtcacggacgaggtcgtgagcgactgcagggtcccgcgcacccacgaccaggtcacgacgcccgagggccgatcgacctcgaaggatccggagaaaccacggaaccagcgatggtgtccatgatggcccaggtgggacgtcgcggcggtggtctgcgtcacgaccggcgtgagcgccgagctcacagcggcgccgcccccacgcagctcgaccatcccggctgcaagggctcccacggagatcgcggcggcagccccgagcacgagatattgcttcttcataccagggagcctacggcacccgaagccacccgagcccgccaggtctgtcagggaactgtgagggttgctgccccgccgtggtccctcgacaccgacgactcgacgccgacagctgccgcgtggctctgcgtcatgggctgcggcgtgggctcgaggtcccgctcgggtgccccacagcgccgagccacccgcgcgccgcgatgggcacgtcggtgatgattgccgtcgggtggaccgacagggcacgcgagaacgcctcctcgtcgttcaccgtccagacgccgacgtcccagctcgccacggcgggcggccgccaaccctcacgcagcaggtcgaccccgacgaggagccaccggagaccgagctcctcgagatcgcgcagcgtcgactccgccggtgcctcctcgacgatgagtcccgcccgcgccccagaggcgagacacgctcgcaccgcgcgctcgtcgaacgacgagatcagggcgtcgcgttcgcgaaccaactccaccagccgcaccgaggcctcgacggccgcacgcacgcccgtctctggcagcagcttcaactcgatgtcgagcatcgacgaccccacgacctcgagcacgtcctcgagggtcgggagtcgacgaagcgacgtgctgggggcgcgctggatcgtgacgccgtcgacgtcaggatcgtgatggaggacgaaggcaccgtccgtcgtcggccagacgtcgatctcgatgccgtccgcacctcccctgagcgctgcctcgacagcgcccaccgtgttctccgtgagcgccgagccgtcgagacggccacggtgcgaccacagcgcgaccgcggctgcgtgctgcgctacgcccatgggacccgcacacctcggaacctgcgaacgaggcgtcgcagatgacgacgaccacgccgcaggctccagcacccttgcgcccctgcgacccggagcgtccggacgaggtgccggtgggggaaggccgtcacctcgcccggacgctccgcccgcagcccccaaggggtcgtcgcgtcacgccgaaccctcgctgagcgcggaccccgtcgagaccgaccatcctggtcgcgaacgtccatgaccagcaccctacggatgcgacgtgaacagccggcgaaggcgcagcatcaatcaggcgtctggttggtgaacgctgcgccgacgactcctgtccgagccgcacgcagcgcggccaccacacgctccggtgtcgtcggcatggcgatgtcgcgcacgccgagcggtcggagcgcgtcgaggaccgcgttccacaccgccggcgtcgctccgatcgttcccgactcaccgattccctttgctcccagcggattgaccggggtcggcgtctcctcgtgcacgacccggaaactcggcagctccggagccgagatcatctcgtagctcgccagcgtgccggtgagcggcgcaccatcgggcgcgtagacgaactcctcgagcaccgcttgggcgatcccctgcgcgagcccaccgtggacctgaccctcggcgagcaacggattgaggatacgtcccgcgtcgtcgaccgcgacgtagtcgacgacctcgacggcaccggtgtcgaggtccacctcgaccacgcacgcatgcgccccgaacgggaaggtcggccccggcggctcgaagtccaccgtcgctgcaagctggataccgcgcgcccgtgcctcggtcgcgagcgtggcccacgacaccaccgaactcgggaccccgacaacaccgataccggactcgccgaccacgagatcctcgggtgcggcttcgagcatcgtgctcgcgagctcacgcgcagcggccgcaacctcgaccgacgcgaggtgcacggcgacaccacccgtctggaccgaacgagaaccaaaggtccccacgccccgtggcacggcgtcggtgtcaccggtcaccacccggatccgatcgaggggcataccgagctgctcggcggcgatcatcgcccacgtcgtgtggtgaccttgcccgtgcggcgaggtacctgaccacaccgtgagcgtgccatcgtcggccacctccacgcgtgcgtactcggacgatgtgtagccgttcgtgatctcgacgtaactcgacaacccgatgccgagcagacggcgagcgccccgctcgaggcgccgagcctgctcggctcgcaacgtgtcgtagccaaccgcctcgagcgcacgctccagcgcgagccgatagcgaccggagtcgtacctggcaccggtacgcgtctcgtacgggaaggcatcgtcggcgatcagattgcgccgccgaagctccgccgggtcgatgtcgagctcgtgggcgagcaggtcgaccgcgtgctcgatggctgccgccgcctccggtcggcccgcgccccggtacgcggagatcggcacggtattggtgaggacggatcggtaggccacgcgcacccgcgggatctcgtaggtaccctgggccatgagggtggtgagccgcgggagcatcggaccgaggaggggccaggcccccacgtcctggaggacgtcgacggagagcgcgacgatggcgccgtcacgacgagcaccgatggccacctgctggacttgtccccggccgtgcgcgagcccgagcatcgaggcactgcgcgtctcgatccaccgaatcggacgcccgagtcgaagcgccgcagcgcacaccgcgagatcctccgggtagaccgcagccttggccccgaagccgccgccgacgtcgcccgcacgcaccaccaccgcgccatcggcgagcccgagcacgcgcacgatctccgctttgagtcggtgggccgattgggtcgatgcgaagatctcgaggcgcccgtcggccgtcggcacggcagccagggctcgggcctccatcggcgctggggccaagcgctggttcaccaaccgtgcgcgcacgacgacgtcggcgtcggcgaagaagtcctccggttctggctccccaccctcggacaccaggttcgacccctcgtgcacgagctggaggtcctcgagtgctcgctctggatcgatcacgggatcggtctccaccaggtcgagatcgaccagttcggcggcgtcctctgcgacctggggcgaggttgcgagcacgagagcgatcggctccccgacgtaacggacgcgaccacgcgcgaggagaggtcgcgcgaggtcgccacggccgcgcagcggacttggcatctcgagctccccgaggtcatcggccgtgacgatcgcgacgacaccatcgagcgccatggcctccgacacgtcgatccctgcgatggtcgcactggcgaccggcgatgtcacgaaccacgccgcgagcgagccatccaagggcacgttggcgacgtaggagccctgacctcgcaggaggtgttcgtcctcaacccgacgcacgtcgtttccgagaatgctcacccgacctcctctcctgacgacgcacgtgagcaaggacctgccaaaagccatccgttgcgccttcgggcgtgcgacgtcgtgctccagcgcccaccgggccgcgatcgcacgtgcgctccgcttgggacagctgcgaccttagccgaactcgggcgcgctgagctctcgggcccgtgcgccgggacggggagcgagctggtgacgccgactaggtcgacgacgaggaatcatcgtcggagccgtaggtgccctcgggcatcgggccagccgccgcgggatctgacgccgacgacgcctcgggagccgaactcccggcctgcgcagacggtgtgcccgggctccccccgaccccgcctgggatccaactgccgctactgcccggcggcggtgttgccggcgtcacgacgacgctgacacccttggcctcgaggtcgccgagctcgtccatgatggccgcgacgcgtgccgagtccgcagcagtcgcccgatgctggtggtcggcccagacgagccctccgagctcgagcaagagcgcatcggcttgcttcttcgcctgatattggtcgagtcgcgccgtcgccgaaccgtaaccctgctgcgcttgatcggcaagcaccgctgcctgctgcttcagtcgctcgaccgtttcaccaagtccactcaaacgatccttgaaccccatcgggccctctcccttccccgagtgccttcgccacccctagcgcccgagcatgtcgccgaggatccccccgagggaaccgcctgcaacgccaccggcgacgccaccagcgaccgcatccgaggcgccaaggtagggcccgagcgcctgggcgagcaccgccagcggcatcgactggagccagacctggccgggcccgacgagctgcaccagccaatgaccatcaccacccgcccagcgattgacgatccccggtacccgtgtcacctggaactgaaccgtctcagcgaacgcgccaacgtggccagggtgaaccagcagctgttggccctcggcgagctgatagttgaccatctcgcccccgagttcgatccatgccgtaccatgtccttcgagccgctggaggatgaacccctccttcccgaagagcgccccaccgagcgactgctggaaggccatggaagcgacgacatcgcccgtcccacagacccagccatcgcgatgcacgaggtaggcctgcccctgcgcgatctcgagcggaacgatgtgaccggggagcttggcaccgaaggcgacgaatcccggtccgcccgtggcctcgaagtgcgtgagcagcagactccccccgccagcgacgcgcttcaacgcgcccatcaagccgccccctgcagctccggtcgtctgggtcatgcgcacgttggccgacatccacgacagctcgccgcgatcgctcacgagatggtccccgggatcgaggacgatctcgagcaccggcatcgtcgaacccttgatggatgcctgcacgcctgcctccttccgccacgccgtcgccaagcgtaccacaggccgcctcgcagatcccgggaccggcccacgaggtcacacgtggcgacggctcgtcgaggttgcggacgtcgacctgtgcggcggcgcgggatcgaccggtcgatacagcggcgagctcggcagcacctggaccgcgaccgtgccccgcgggaccatcccgtcctcttgctcagcgaggtgctcctgataggcgaccgtgccgacgacagcgatctcgtgggtgaggcgcgcgttgtcggctcgaaccgtggcgagctgggctctgagtgcctgttcgctcgcgtggagatcgaggatggtcccggtgggcaggacccaggctccgtaggccagggcgagacctgcagtcagcgtgccgacgagtatgcgccgacggcccttcggcgtcatcgttgggcccgagtccagtcgacgtagcgcgcacccggaccgagctcgcgctcgatcgcgagcagacggttgtacttggcggcgcgttctgagcgagcgggcgcaccggtcttgatctggcccgtaccgaggccaaccgcgaggtcggcgatggtcgtgtcctcggtctcgccggagcggtgcgagatcacgctccgatacccacttcgcgtcgccaggtccaccacatcgagggtctcggtgagcgtgccgatctggttgagcttgatgaggatcgcgttggcgacaccacgctcgatccccttgccgagcagcccagggttcgtgacgaagatgtcatcaccgaccagttggacccgcgaagcgagccgctcggtcaagatcgaccaaccgtcccagtcctcttccgccatggcgtcctcgagcgagacgatcgggaactggtccaccaggcgcgccatgtactcgacgaggccgtcggcctcgagctcgaggccctggccgaccatcacgtaacgaccctcgcgccagaactcgctcgcggcagcgtcgaggccgagcgagcagtcacgtccgggtacgagacccgacgcctcgatcgcagcgaccatgagctcgagcgcctcctcgtggctcccgaggtctggggcgaacccaccctcgtcaccgaccgcgaccgagtggcccttcgccagcagctcgctgcgcagtcgatggtagatctccacgccccatcgcagcgcctcgccaaaggtcgccgcaccgtgtgggatgatgagaaactcctggatatcgaggttgttggaggcgtggacgcctccgttgatcacgttgagcatgggcaccggcaaccggtgcgcacccaccccaccgaggtagcgatacagcggcacgtcgagcgctcctgcggccgcccttgccgtcgcgagcgacaccgcgagcatcgcgttcgctccgattcggtgcttgtcgtcagtaccgtccgcgacgatcatggcttcgtcgatgagccgctgctccgtcgcgtccatacccacgaccattgtcgcgagctcaccaccgacggccgcgatcgcaccactgacacccttgccgttccactcggttccaccgtcgcgccgttccaccgcctcgtgcgttcccgtcgacgcaccagacggcacgattgcttctccgacggccccgccttcgagcacgacccgggcgccgacggttggattggccctcgaatccaacgcgagaaacccctcgacgctcctgatctgcgtccgtgtcccagccgccatggtgccgcctcctctctgcgggccgatgctagctcgttccgtcgccattccctgggcgccccgcatcgacgtcgacctcgccgagcgcgcgctcgaggcgacgagccgcatctcggagcgcctcatcgacgtcgacacccgagagagcggcctcgacgagcacgcccgcgaggtcatcgccccgtcccaacgaggccgcgcgcacgtcacgcgcccgggcgcgccgagccagcttggcgaggcggagcgacgccgggagccccacgggaaccggccgagacccaggctgctccgcggccttgatcgcctcccatcgctgctccacctcgccggcactgcgggcgaccgcgtcaccgaagacgtgagggtggcgtcggatgagcttgtcggtgagggcgcgagcgatcgcgatcagatcgaaactgccgtcctcgtcggcgatggtggcgtgcatgagcacctgcagcaagacatcgccgagttcctcgacgacgtggtcgcgatcgtgtccatcggcctcgtaggcatcgagcgcgtcgaccgcctcgtaggcctcctcgatgagatgacgtgccaacgaccggtgcgtctgggacgcatcccatggacatgccgaacgcaacgtgctcaccacctcgccaaggcgtcccaacgcgaccgacggtggctcgaagtcggtgagcacgacgctgctcaggtgatcgaccgcggcgagcctctcatccccggagtcgacctcggcgacgacctcatcatcgagaccgaggtggtgcgcgaggaccgcccgcgccccgctgcgctccgcgaggacgaccaggtcgcgtgccagcggctcatgccagacctgcagtgcgacgaccgtaccgctcgcgatccaggggttggcgtggagcgcttcggcgtcgaccacgctcaatccctcgaggggatcgacaccgaaacgttcgatgatcagctcgagcactccgcgtccagccagaatctcgacgtcgatgtcgtcggcccgacgcagcaacaccaccgtgcgttcggccacctgtggcgaacccgggaccacgtagcccacagggccacccgtctcgaacgcgaggtcccgcagacgctccacgatgcgctcgtagcactcctcgaaagtcgtggacgccgcgtagagatcgtcgcacgtcaggatcggagcgtccagtgtcccgagcgcctcggcgagtcccgggtgctccagggacctcgcaaccaccgccacgcacccctcgagggcatctccgagcgccgctgcctccgcgcggccagcaccacacccaacgacccgaacgatcggtttcacaccctctcaccctacctacccagaggagctgcaagaggccctcaagaaccagcactctccgtgccgattccacatttagtgacctatcgccccatctcgcttcccggattgaccaccagtcaccactggatgtggcgcatcatcgccgcgtccgtcgcaggaacctccggcgtcggcgcgacctctctcgcgctgcacgcccttaccggctcgacgacctcgtcacgtgccgcggccatcgttcgccacgatgcgcgagtcggccgtgccccggagccgatgccgacgccgcagcgccctcggagctcatcgccatcgcatccagcaccaccgaccccggctccacaggctccgtcgacgccctcacccaccagcgcgacgagcccaccagcgtcggccgcaccaccagcgacgccgccggcgaacccacccgtcgtcgcctcgtcgacgccaccgccggcttcggcgctcgcggacccaccggccaacatcgccccgaccccgaactttgcctcgatctgcgcctcgagcatcagcgctggccctgacggcccaacctgcgagagcgccgccgtcgaggcgatcgacgccgcccgcgcccaggaagggctcggtccactcaccctccctcccaacttcaccgatctcagcccgacgacgcagctgctgtggctgatcaacgaggagcgcaccgcgcgcggcctggccccggcggctggtgtcgtcgacaccctctcggcactcgccgaggacggtgccgcctcgaacagcgatccgcccctcgggtcgctcacgactgggggaccctgggcggtctccgcagaggccaattgggccgcggactactccacggcagcatccatgtacgactggatgtacgacgacggctggggtgggtcctcggccgcgacgacgaacgagacctgcacgtcgccgaccgcagcaggctgctgggagcaccgagccaacatcctcgcgaccgcccccgcgggctacgtgccggtgctcgggctcgccagccaacccgagccatcagggacgtcgctgtcggggctcgagtcggacgcgatggtcctcaccttcgtgcccacgagcgcgctcagctcactctcgttcgtcacgacctggccatagcaccgtgccgtggcggaagagcagcgtggcgagcccgacgccgcgagacccgtcagccaacccgttcgggcgtcacgatctggcgtgcgagcgccgcacccttcggcacggtgggcaccacgctgagcactcccttctggaccacgatccgaccaagggcccgattcacgtggatgttggccgtgtgaacggtgcgcgccaggtagtcgttgaggagcgtctgaccgtgactcaccatggtgtcggccgcgaggagctcggcctgcgagaacggtatctcgctgcgagaggtgatctcgaacacagcaaacccgttgggcacctgtacgacccctgatggcgtacccacaggaaggctcgtcaccgaggtcgcaacccctgatccgaagctggatgcgtactggccctcggtcccgcagccgagcgcgccaccgccagcggcgttctgggtcgacgacgacttcgccacggcagcgaacgactgacccttgtgcagcttcgcaaccaccgcttcggcttccgtaggcgtaccgaccaggatctccgatccgcagtagctctcgaaatcagccgggtgcgcgcggtagtacgcctggacgccactcgtggtcaagctcacgtggccgagcgccgcctcgagctcgacgatgtcgacgctgtcgcggatgaggcgttgctgataggagcgcggaaagccactgaagacggtttgaccgccagcggactgctccgccagggccgtgccaaggctcgttgcgacagcgctcggctggacgtgcatccgcccgagcgctgcctggacccgcatgatcgtgatccgtcgagagaggatgttgtccacgaagagcgcggtgtagctctggtcatggggaccccacaccggctcgtggctcgcgacgagttcgctcacgaacgccttgttcgcagcgacgtccgcgagctccgcttcgagctgcgacgtcgtcagcgtacggttcccgaccgtcgccgcgacgctcgcggaaccacagctcgcgagcaccacggccccggcgagtgggatgagtccgaaccagcgacgatgcacacctacctccaggagcccacggccatgctactggggagaacctactccaggcgatggcgcgccttcgaggatctccagcagtgcctcgagacgtccaagcgcgtcctcccggcgcgcaaggggaaccgcaaggtcgtcgccacgactcacgacgccatggagccgacgctctagacgcagccgggtcgccaccgacggctggagcggaccgacgacgagctcgagtcgtgcgctgcgtgggttgcgccgaacgagcgcatgatcggcaccgagggtcgcaagccgacgccgtgccttcgcgagggacaccaaggcgagcgcttcggccggcggcggcccgaagcgatcgcgcagctcttcaaggaactgatcgaactccgcctggctccgcgccctcgcgagacgccggtagaggtccatccgagtctcggcttcggcaacgtagtcctcggcgagcagcgccgataccggcacgtcgagcgccacctcccgatcgggcgtcggctcctcgacgccgtccatgcgcgccacctcttccgcgacgagccgcacgtacagctcgtagccgacctcgctgacgtgtcccgactgtcgcatgccgagcaccgtgcccgccccgcgaagttcgagatctcgcatcgcgatccggtaacccgccccgaggtcggtgttctctgccaccgtccgcagtcgctcgagggcgatgtcggagatcccgccggtggtcgaggtgagcaggtaggcatacgcctgccgcccggagcgcccgacgcgcccgcgaagctggtggagctgggcgaggccgagctgctcggcacggtcgacgatcagggtgttcgcacgcgcgaggtcgatcccgttctcgacgatcgtggtggcgacgagcacgtcggcctctccgtgccagaactgggccatcgtccgctcgagcgcagcgggcggtagttgcccgtgcgccacgagcaccctggcctcggggacgaggtcggcgaccagacgggccgaggcctcgatgtcgcgcacgcggttgtgcacgaagaacacttgaccttcgcgtaggagttcccgacggatggcctcggtcacgaccgcgggatcgaagggcccgacgtgcgtgaggatcggatggcgatcgacgggcgcggtccgcagcacggacagatccctgatgcccacgagcgacagttcgaggctgcgcgggatcggggtggccgagagcacgagcacgtcgacgccggggaacgcctccttgagctgctccttgtgtcggaccccgaagcgctgctcctcgtcgatcacgaggagcccgagcctggcgaaccgagtcgacgcgccgagcgcagcgtgcgtcgcgatgcacacgtcgagctcgccacttgcgagctcggcgcggatgctcgcagcctcacgagccgtgctgaggcgcgagagcatgcccacgcgaatcggcgtgccctcgaagcgctcccggaacacctccgcatgctgggcagcgagcagggtcgtcggcgcgaggacgagcacctgacggccctcggatgccacggcgaacgcggcgcgcagcgcgatctcggtcttcccgaagcccacgtcgccacagacgaggcgatccatcggcaccggcttggcgagatcagcgagcacctcggcaatggtgcgctcctgatcacgcgtgagctcataggggaaccgttcggcgaactccgagagcagcaccgggtccggcgtgatgctcgaaccggtcgcggccaagcgacgctgatagagcaccaccagctcctgggcgacctcctgcgccgcgcgacgagcacgatggacctgacgctgccagtctccgcctcgcagacgggtgaggcgaggctcctcggagccgacgtagggggcaacgagcgcgagatgctcgaacggaaggaagatccgatccgcgctcgcgaactcgagctcgaggtactcccgcgagacgccatcgaccacctggcgcacgaggccccgatagcgcgcgacgccgtaggcctcgtggacgacgaagctgccctcgacgaggtcgtcgaagctcagacccccggtcgtacgggtgggcaccgaagcgcgaggagccgtcggccgtacgagactcgcatccgcgatcaccaccaacgatgccggctcgagctcgacgctctcgacgaggtcgagccccgcggccactcgaacgccgtgaccctcgaggcaggtggcgaccgaggccagctgcacgtcgatgccctcctcgccaaggcgttgggcgacatgacgtgcacgttccgagccatgcgtggcgacgacgacgtgaactccgtcgcgccgcgcactccgaatgcgaccgaacacccctgcgaggtcgcgatggctcacaccgaggcgagcaccaaagccggctggatctgccgatacgaggcgggcgcgcactgcgcgcagccgttccggctcggccatgagactgaccgacccgagcgcgtcagcctcgagtccccaggtcggagcgagcgcctcccgaatggagcgctcctcagcgacgaggcgatcggcgatgaccgcgtccatacccttcgccgggacgagaacgaggtcggcctcgtcgacgatgtcgaggaccgtcggtgcgacatcgccgagcacgagtggcacgagcggctcagggggctctcgacccgcgagcacggcctccacccgatcggccaccgctggaacgcgtgcagccagggcctcgagttgcttggcgaggtcggtgtcgatccgaacttcgcgagccgggaagagctcgacgcgctcgaggtcgccgaccgagcgctgcgtcgtcggatcgaagaaagcgagccgatccacctcgtctccgaacaggtcgatccgcaccggcgacgccaagcccgggtcggcgacgtcgacgatcgatccgcgcaccgcgtactcacccgcggccgagacctgaggctcacgcacgtagccagcgtcctcgagccaagtgatgagctcgtcacggacgagctcatcacctcgcgccacgatcagacgctccaggcgcgccgcggaggcgacgagcttcgtcaaggcggctcgcacggtcgtgaccacgacgatgccctcgtcaggcggatcgacgatggacgcgagcgctcgcagacgcgctgcggtcgtgcccatgctcggaaccacgcgctcgaacggcaaggtatcccacggtggcaacagcgcgacagggatccgaggcagccaccaccgcagatcgttggcgatggcctcggcttctcgatcaccctcggccacgacgaccatccgtcgcggagcgagtcggtgccaggcgagggcgacgccagccgcgctcagggccggcggatcttccaccgtcgccgcgagctcttcgacgagcgcggcgagcggcgcctcatgcggatcgatcgacgccacgggcgttgtaggtggtcatggcgcgctccggaccaagcgacacgagatcgacgacggcatcggcaccccgctcgacaccgacgtcgaaggaggtccgctccgggccgcgtacctcggtgaggacccaatcgacgacggcctgacggccggccgggcgtccgatgccaatacgcacgcgccagaagtctcgcgtgccgatgtgggcgacgatggagcgcaggccgttgtggccagcgagcccgcccccgtacttgagctgtacgcgaccgagcacgagatcgagctcgtcgtgaaccacgaccagctgcgtcacagggtcagcgtggaagtagcgcagcaccgccccaacggcggcacctgagtcattcatgtaggtctggggcactgcgagcaccgctcggtgatcgccaagtcgcccactgccgacgatcgagcggtgacccggcgtcaacctcacgtcgaggcgtcgagcgagcagatcgacggtcagcgcgcctgcgttgtggcgagtgaagcggtaacgagcgccagggttcccgagaccaacgacgatgatcggctcagcgggtgctggaggcgtgagctcaggcctcctcgaccgtcgccaccaccgtctccggcgcctccacgaggctcaccccagccggaagtgggagtgcccccgccgtcacggagccatcggcgagcaggtcggcgccgacgtgaatcgacgacggcaccgatgtcggggtgccggacaccgccacgagacccacgaccagccgtactccctcgcccgcctcgagcgggacctgcacctcgaccgtctccgacgcaccgaccgcaagaaaatcgaggtgagagagttcccgtcggacggggtgtcgaacgacagcctggagcttgaccgttcggacctcaccgtcgatctcgatgtcgagcagttggccgacgaccgcgtgctgaccgagcgccgtgaggaagccatgccggtccagcgtgaccgcaactggctcagtgagcccggccccgtagacgatcccgggtaccttgcccgctcgacgcagacgacgtgccgcggccgagccacgagcatcgcgtcgctcggcgaccaccttcaccatcgagacctctcctctgtgccgggcgcacggcgcctccgcgcgcgagggagcagcctaccgccccagtcgggacctcgatgcggctaggagaggttctccccctggaacagctccgacaccgacccatcctcgaagacggcggcgatcgcgtcggcgatgaccttcgcgatcgagaccacctcgagcttggcgatggctcgttcgggtggaaccggcagggtgttcgtgaccacgacgcgcgagatgggcgcgtccatgagccgcttgggcgcggggcccgagagcacggcgtgggtcgccataacccagatctcatcagctccgcgcgagcgaagcagttccgccgcggccgtgaccgtgcccgctgtgtcgatcagatcgtccacgatcacgcagtgacgacccgccacgtcgcccacgacctcgagggccgtcacgacgttggccgttcccttggggcggctcttgtggaccaacgccagtccagcgccgaggcgctgtgcaaaccgctcggcaaccttcacacgaccggcatcgggagcgacgatgaccgcgtcacgaggagcgaacgcacggaggtactccaccagcacctgactggccgtgagatgatcgaccggcccatcgaagaagccctgaatctgacccgaatgcaggtcgacggcgatgatgcgatcggctcccgctgcgtgcagcatgtcggcgaccaacttggcggtgatcggctcgcgacccgatgccttgcggtcctggcgcgagtatccgtagtacgggcagaccgcagtgatgcgcttcgccgaggcacgcttcgcagcgtccaccatgatgagctgctcgaagattgcgtcgttgacaggcccagcgtggctttggatgacgaagatgtccttgcctcggacggactggtcgaatcgggagtagatctcgccatcggaaaactcccgcagcgtgatcgcgcccaactcgacgtcgaggtgctcggcgacctcccgggcaagctgcggatgcgaacgtcccgagaacagggcgagtcgcttgcgggggacgagctccatgcctcacctttcgtggcgcgtcgacgccgcaccatcctaggctccgcgtcacggcgacgtaccgccccctgtggctgtcgcagagacgcccgaacgctcgacggctacgaacggtgggagagcgcgcgtcgatgacccgggctgcgtgggcccgatggctcgacggtgcagtcgatcgctcagaacatgccgaaccgaacgctcctcgcgctggtgttcgtcgggccctctcgctcacctcggtcgatgcgttgctgacacgggcgagttcttgagggtccgctcgttcgggccgaggtcgcggacaacgtcagcaagggcgcggtggttggtctcgttcatccccttcctcctgcacctggagcaggtgtcaaccgggaagggcacggccatccctctgcagctgtcgacgccgttcgaaaactgaacgatttcgccggtgaaaagtgaacacccgagcatggaggggtgatcactgtggaagactgggcactcatcaggcggctggtggccgagggcgtccccaaggctcgcatcgccaagcggctcgaggtctccgatcgacagcgtgcccggtcgcgagccagccaagcgccacgcatcctcatcaccacagccagagtcagaaggtctccgcgccccaggtcatcgacgcctccggggcccaggcgggaggcgtgagcacatcgagtctcgcatcgatggtggcctcggttgcggagcgacagccaccgacaccagcgcatctggccacagcccctcagggaagcccctccatgatcgtcgggacgcatgcgatcgtggtcgcacggtgcgcgagacgagacgctccgttgggggtagcaatggtttgttcccgaggcagtcgatcgccgacttcccacccacggtgcgcagctcgaggaatggggactctgcggcgcggcaccagtggcaaccccgatgctcaacgccgccatgggagccgcggcagctcacggggtccggccgcgatgagtgcgacgaggtcagactcggcgacagggtaaccaccccatgcatcgacgccgacgttgatcatcctcccgtgctgtcgccacttctcatggacatgaccgtgcaggagccaggcccctcgatccttcggacgcaacgctgggaagcgttccacctcttgactatcgccttcgtatgggaagtgggatacgaccacctccacatgcccaagctgcagcgcaagctcgccatcgaggaccgtcaagcctgcagcctcgtagctacgacgccaccgatcgacctggttcttctgcttccttcgcaagccctcccagcacttgtcatggttccctggaacgagaaacttcgtgccattgaagagctcgaccaactcaagcatctccgctactggacccatggcgaggtcgccgaggatgtagacctcgtccgcaggatcaacgcgctcgttccagcgctcgatgaggtcgacattcatcgtctcggtatcgccataggggcgctgtgtatgagcgaggattcccgcatgaccgaggtgcagatctgaggtccaccaccgccgactcatcgatctgagtgtacttcgaggggtgggcacgacgatgatctgccacaggcggcgtcaggaccctggcacttcacgaccacggcacttcacgaccacggcacttcacgaccacggcagagaggccgttcggcattctccctctccagtcttgcgtccttgacgacctctgaccattgcgatccaggtcgccgcctgctcgcggaccaagcgtcacgtcagactccggagcggtcccggacgagcaacctgcagctcgccgtcgaaacccttctaccagctcctcgaggatgcgcgttcgtcgcaggacagcagcgacaagcgatgaccgacggtcccagcgcctgcgggttcaacgacgagaccatccgtacgggtcgacgggcgcgtcgaacgctcccgcctcggcggtcgactgacgtcgggcaccgagcacccgctcaccgccggggccagtcgaccacagctcacgatggaatcttggacgtgcgaacggtcacctagggcaggcgcgcgaacggcggaaccgtacccttcggttcgacgaccgctccagtctcgagcacgctgaaggggcccacggtggcccactctccaatcgtcgcacagcacgcatccaccgcccggagctgggcgccctggcccaccacggtgtcgacgagacgagaatgagcgccgatgagggcattggcctcgatccgtgtcgctccgagcaaggcgacctgcggttcgatgaccacgccctcggccacgcgcacgcgggcgtcgacggtcacggtggaggggtgctgaatctggacaccctcgtgcaggagacgacgtacgatgcgcgcccgcatgcgctcggcgacgtcggcgagctgcagccgatcgttgacgccgagcgcttcggtcgggtcatccaacacgagcgtcccgacccgatagcccgactcggcgagcagggcgatcgagtcggtcaggtagtactcccgctggcgattggtcggcgcgaggagccgcaacgccgaggggagcacagcgagatcgaagacgtagacgcccgtgttgacttcgcgggtggcctcgccccgatcatcgtcgaggtcggcctgctcgacgatggcgcgcaccttcccgtctcgggcccgcaggattcggccatagcccgatggatcgtcgagctccatcgtcaacaccgtcgccgcgttgccttgggctgcgtgggttgcgagcaaggccctcagcgacgtcgccgtcagcagcggcgcgtcggacggcacgaccaccacctcggcaccgctggagccgacaccaggcaggagatccggcaaacgggtgagcgcgacccgaaccgcgtcaccggtcccgcgttggtcgaactgataggccgtcacgacctcgacgccgctcggagcatgtcgctgcacctctgcctcgacggcctcggcctcgtgaccgacgaccacgacgatgcgcgacagatcatcaaggtcgcccagcgcagcgagcacgtggccgaccatgctgagaccgcacacctcgacgagcggcttcgggcggtccgaccgcatgcgagtccccttgccggcggcgagcacaacgccgtagcgcatagcgcaacctcctcgtcgcaaggctagcttcgggcagtccgcaccacgtaggtcgtcaccgaatcgggcgtgagcagcgccaccacgctgtgcgcgtcgacgtccggcagcgccgtcggctggagcgacttggtcggattcgtcaccaccgcgcccatggcctggaccccgtcaagtcccgggggaagctgcacctcgagaggcaagggggctgagccaggggcggtcaagttgatggcgatcagtacgagacgcccaggtgcacgccccgcgagcatctccacccgcgcatccgacgtcgtcaccggcacgagacccatgcccggacggaggtagcgagagaactgtcccagcacgtcgtagcgcttggtcaggtagagcgtgtggtcgccgtcgcgtgcaccgttcaggtcgaagtagatgagtccgtcgttgcgcccgagtgggttgatgtctcgaaagcacccagggtcggccgcaggactgcagccgagatccggtgagagtgccagccaccagtcgaacaccgaggcgttctcgaccatgaggtcgttgtagatcgtctgggcgagccagaggcccgacgtcatggttgggtcgtactggtagccgaacccctccccgtcatagcagcagatctccgtgtcccagatcggcacgccccatcgacgtccgagcaacgcgacctggtggagcaccgcccgcgaggggtagtcgtagccatggaccgcgagggcggcgagcgaggcacgcacgcccggatacgtcagccaccgtggcgcctgccggagcagttgcgtggcgtaggaggactcgtcggcgatcacgcgcgcccacggcgcaacacgcgccagatcgcgcgcgaggtccacgacgagcggaccacgctctgccaccggaacagccattccctcttggcgacaggccgcttgcgaacccaccggctcgttcatgggcgacacgtagcgcagcttgacgtggtcgacgcgccacagacccgccacggtcagcgcgagctcgtccgcgtacgcagcgacatcgccagcgaggagcgtaccgccgcagctgcggtggttcgatgtgaactgcgggggtgctgcgttgacgaaccccacaagatcgcgcaccccccacgaggccgcttgacgggcaaagagcaccccctggggatcggcgtggaagtcgaacgtaccgttggcttggtagaagctcggcggcgccttccaccacgtcgtcacacccacgccgccgccgccgatgttgaagcggaactgcgacagctccaacccgcgcgacgagtagagcagccggcccacctgcgcgatcgtggcggagccgagcgctgcgaccggtcgcgaccaccaggcgccactcgccccgatcccgaccagcgtgtggcttggacgtggccccacgtctgcgacgacgagcggctggcgcggcggcgacgacggcgaggcgggcggcggagcgagcacgttcgcgccagcgacgatggcaaccccggccgcgacggccgtggtgacggacacgacggctcggaccaggctccctacgaccgcccgccgacccacgtcacgcatcgccgcgccacgctacccggcacggggtgagggcagcctgatgcccctgcgacctggcccctcgagcgccaaccttgcactaacctcgacgcgtgaacggagccgaactcgccgcgttgaccctgagcgatctcggcgtcggggtagtcttcgccaatcccggtacgagcgaactggttctcgtcgatgccctggagcgacgtgggccgcgcccgattctcgttacccacgaactcgtcgcgatgggagcggccgatgcacacggtcggctcggcaggctcggggcggcgctcgtccacctgggtccgggtctctcgaacggcctcgccttcgtccacgacgcgcgccgagcccacaccccgatgctcgtgctggtcggcgaacatccgcgctcccatcgggcgctcgatacgccgctcaccatgcggatcgcgtcccttgccgaggccatcgacgtcccgatgatcgcgatcgacgaccctgcgctgatcgccccccaactccgcgcagccgcgaccatcgccaccacgcagcgcacgccggtcgtcgtcacgctcgatgccgtggcgatggaacgcgaagcgacaccctccgaccccagcgccccacccacgaccgcgcacgaggcgccttccatcccccgagcgcgcctcgaagccgcgatcgacctggtgcgcgctggagagtgcaccttgctcctcggcgctcgcgttctcgagcccgacgcacgcgcgctcgcacgtgccatcgccgatgacacgggcctgcggctcttggcggagaccttcccggcgtcgcatcgctacggagaaggggcggggcgcatcgagcgccttgcctacctgcccctcatggcgcgcccgcagctcgccacggcgcgtagcgtgctcgttctcggaaccgatgccccgtcggcgtggttcgcccacctcgagcaggatccgcggctctggccgctcgctgcgcccctcgtacgcctcgacggccaggacgaggacccacgcgtcgtgctcgagcacctcgccaaggcgctcggggtcacaccggctcctccaccgacatcgcaacccattccggcgccggacccccacgcagcgctcgacgggtcgacgctcgcagccgtcatcgcacgagccgtgcaggccgacgacgtcgtcatcgacgaagcgcgcacggctgcccccgcgctctacgaacaactcgccgacgcgcgacgccaccactacatcggtcaccctggcggtgccatcggggaaggggcgtcgctcgcgctgggggcagccacgctcggcgcttccgtcctcgctgtggtggccgacggagggttcctctatgcgccgcaggccatctggaccatggttcgcgagcacctcgacgtcaccgtggtactcgcggtgaacggcggctaccgcatcctcgagatcgagcagaccatcgctgggctcgacctccacccggagctcacccgcctcgacgacccaggctgggacttcgctggcctggctgctgcgatgggcgcacgaacgacgaccgccacaacggtcgcagagctcgaggcggcgctacgagatcgacatggcgtccacgtcatcgtcgcgaccgtctcccaatgaccggtgggcgcccaccccacctcggaacgagccccgtcacgaggcggcgagtccaaggtgttggctgaggaactcgacgcgagccctcgctaccgcctcgagatcgtcgggtcgccgtggcccgtgacgactctcgaggagcgggaggaatcgtaggtcgatcccgaggtgcgcggcacgctcgagcagtcggagcgagtgaccgacgtgcacgttctcgtcgaccatgccgtggatgacgagcaccttgggagcatctggacctgcgagtccttcgatcccgtgcaggacgctcgcctgctcgtagcgtggatcgtcgaccaagccgaggtagcgctccgtgtagcccgtgtcgtaccagcgaaagtccacgaccggtgcacctgcgaccccgacccggaagcgtgacggatgtcgcgaggtcgcgagcagggtcaggtacccgccgtagctccacccgaagatccccacgcgagtggtgtcgatgccgaggtgggccgctgcccaatcgatggcggcgagctggtcgtcgagctccacggtgccgaatcccctggcgatcggctcctcgaaggcccggccacggttcgccgaccctctcccgtcgagcttgacgacgacggcgccgcttcgtgcgagccactggcaggtgagatctgcggtgagcgaccatgcatcttgtaccagctgcacgtgcggccctccatagaccgcgagcaccagcggacgaccctcggtcgacccttccccttggtagaccgcggcgtagcgccggacgccatcaccgaagtccgcttccacgaggcgaggggtcggcacgacgacctcgggctccgatcgcacgagcacctccaggtcggctccgatccgaaggagctcgggagcacgctccacggacgacctgaccgcgacgattgcccgatcgccagcggcagcgaccccgaacacgccgcccgcgagcacctcgtcgggcgacgacccatccagcggtacgcgccacagggagcgccgtgtcggatcgtcgacgtagccgatcgcgaccaccgacccaccgaccacgccgacgatggccgtcgccacgagtgccggggccagcgcacgtgcaccctcatccgtgatcgccgtcacgcgccagaagccgtcgaaacgctgactcctcgtgacgaggacgccgtcggcaccgatgagcacgcccggcacgtcgacccagggttcgtggtgctcgcgatcgatgcgcgtcgcttcaccatcgcccatcgacacgcgccagcgggtgagctcgtgctgcgcccgatcgaggatccctgccacgaacgtctcgtcgtcgagccagagggcctcgacgaggtaaccgtcaccgatcggcaggtcgacgatcgtcgcgccacctccgtcgagcgtggcgatcgcgatctcgaccaccgcgttcgccgcgccgacgaaggggtagcgatgccgctcgacacgctcgggaaagggtccgtgatgcacgatgaggtgctcagggaccttggactcgtccaccacggtccaggccactgaacggccattcggcgagagccagagcccgtcgtgacgatcgaattcctcctgagcgatgtagtcggcgagcccgatggtgcgatccgtggcgatcgcgagacgttggcgctcgcccggccccgcaagccacacctctgagccactcgccgcgaccacacgatccgagccagcgcacgtcgccacggcgaccgcgccatcgaggtcatagcccacgactggccgaccagtccgatcgaccacgctccaacgaccgccggtcgacaccgcaagtcccgcggtacccaccagccgaaacgagctgaccccatcccaggaacgtcggaggcgctgggcttcgagctcgtcggcctcggtcggtcgcgcctcgtcgtccggtccaaccagcaccacgggcgaggagtctcccgccgcccaccgaacgagcgaggcgcggtcgtcgtcgccggtacggagcgcgaggaccgatgcgccatcgatcggatcgatggccacgagtccgacctcgaccacgcccggcaaccgtcggcgccacaggtcatcgaaacgaagttcgcgcatcatgcgagcaccttacgtgccgaggcgccctggtgcgtcagcgtacgagacagcgaaccagactgcgggccgcctctcgtgcccaccgactcggctcgtacaatgacgccaaacctcgtggtcgaagacccgggccggttgagcgctgagcggttctcgtggtgacacgcatggccggagacgatcctccgaaccctcaccaatggcccacgccaggactgcactcccctggggccgggacgaggcggcgtccgatctgagggggaggtctgcgaaacggtcaccacgctcgctcccggccaccctcaccatcgactcgatccggcggagcttgagcgctaggtcgccgacgcctcgtcacgcggctccggccgcggacgctcgggcagcgcgtcgcgacgccacaccaagaccttgcgccgaaaggagacgacctcctgaccatcttggttgtagccgcgggtctcgacctccaccacaccgcggtccggcttcgatcgcgacggcacgaccgcaaggacggtgctctcagcgtagatcgtgtcaccatggaacgttgggtacaggtgacggaggttgttgacctcgagattggcgatggccgagcccgacacatccggcacgctcatgccgagaacgagcgagtacaccaggttccccacgaccacgttgcgcccgtgcaccgtggcgagctctgcgaaccgctcatcgatgtggagcggatgatggttcattgtgagcaggcagaagagatggtcgtcggcctcggtgatggtcttgcccggccagtgccgaagcacgtcaccgacgacgaagtcctcgagacagcgcccgaacgggcgctcgtgggtggccaccgaactagtcgagtggtcgtggccccgagggcatcggtgctggacctgtcggaccgttcgcgggtcctccttgctggggcatctgtggtggcgcgagcgtcgagaacgacgcgtaccagtcctcgcccgactcaccgtcgaccacgagctgccaacggtaccgcgagttggcgggaagcgggaggggcccgatcgtcaccgccagattgagcgggatatccgaaccgagcggcacgccctgcggggtacccaactggaagtcaccacggatctcgaccggctgagggccctccggagtctcgatcgtgacctgttccccggcttcgtcctggaggaacagctcccagtgatgcggattcggcgcttcgccccaggcgagctccagtcgcatcgcgatcgccatcggcgcaagaccagcgacggtcatcgaccaaccgcctccgaggatgtagagcttgccgtcgcagacttgcgcggcgtcacagagcatgagggaagccttcacggcgccaacgctagccgccggcacacctcgggtcagcgcacgagagcgcccgtgccgagcagggcgaccacggccgtgaggttgaacgccgcgtgcgccacgatggatggtccgagtcgtccggtacgcgagacgatgatggcgaggatcacgccgaagacgaacaggccgagaaattggagcggctcgaagtgtgcaatcgcaaacagcagggcgctggcgacgacgggaaccccgatgcgaagcagcgagggccacccggccgcacggagctcgtagagccgcagggtcacgccgcggaagaagatctcctcacacaggggcgccccgatgacgatgatcgcaacgacggcgaggaaatcgtggccgacgccgacgccgagcagctggacggctggcttggagatcgaccgacgcgcagccgggtcaacggcctcgacagggagatagagcagcggaaccacgacgagctggccgaggacgccgacgccgatcccgaccggaaggtcgacgaggcgcatccgaaagcgcacgaagcggaggaacgaccccgcgccccaccagcgcgcaccgagcacagcagcgccgacgaacacgacccacaggcccgcttcgtcggcggcgagcaacgacgggctgaggccagcgaccgtggtcggcaccgctcgatgctgcagcgctgcggtgccgtcgagcgccaggatgctgcacacgaaggcgaccgcgagagcgacgacggggaacgcgagcgcaccccagctgacggtgccgagggagtcgcggtcttccgtcacggcttccctccttgcgcagcctcgatgggtaccacgccgttcgctgacgaccgtacacgagcccaaccccacggagtaggcaggcctgcctcgcaccgcatcacgacatctcgaacgtgagcagcaaccctgaggcatcgctcaatgccgcctccagggtaaccaggactcctcgaccgaagctcccgtacgtgcaggaactcgcctagcataggcagggtatgatgccatcgtcccaacgcccctcgccacgaggctcgcgtcagtcgccgtcgcccgaccagcgcgggcgcattgccttcgcgatcctcgcaacgctcgtcgtcgccgtgctgctactgactctcttcagccacgccccgagcggacagccccttggctacagcaccttcatccacgacgtacaggccaagcaggttcgcacggccgtcctcaacaacaccacgggtcagatcaccggctcgctgacgaacggtactgcctacagcgtcaccggtccgctgccctacacctcgagcgaactcagcacgctctcgaaggcccacgtccaggtgagctacatcacccccgggcctggcatcgcgtccaccatcatcgagtacgtcatcttcttcgggatcttcatcgggatctgggtctacctcacgcggcgcacgcaggggtcggtcaacggcatcatgagcgtgggtcgctcgcgcgcgaagacctacaccacggaacgcccgaagacgacgttcgacgacgtggccggctaccagggcgtcaagggtgaggtgaaggaggtcgtcgacttcctccgcgatcccagccgcttctcgcagctcggtgctcggatcccgaagggcatcttgctcgtcggtcctccgggaaccggcaagacgctgctcgcccgtgccgtcgcgggcgaggctggcgtgccgttcatgtccgtgtccggttccgacttcatggagatgttcgtgggagtcggcgccgcacgcgtccgcgacctgttccagacggctcggcgccagtccccgtcgatcatcttcatcgacgagatcgactccatcggtcgtaagcgcgggacaggtctcggcggcggacacgacgagcgcgagcagaccctgaaccagatgctctcggagatggacgggttcgatccggctgagggcatcgtcgtgatggccgccaccaaccgtcccgacatcctcgacccggcgctgctgcgcccgggacgcttcgaccgtcagatcgtcgttccgctccccgatctccccgaacggctcgccatcttgcaggtccacacgagaggcaagcgcctcgcgcccgacgtcgatctcgaggtcatggcgaagggcacgccggggatgagcggtgccgatctcgccaacttggtcaacgaggctgcgctcaacgccgtccgcaggggcgcgaccgacatcgccatggcagacttcgactctgcacgagatcgcatcatcatgggccagcgccgcgaggccaccatcctctccgacgaggagaaggagcgtgtcgcgttccacgaaggcggacacgccgtgctggcctatgtgctcgattactcagatcccgtccacaaggtcaccatcctcccgaccggcatggccctcggcgtcacccagcagctcccagagcgcgatcgacacctctatccgcgcgagtacatcgaggacacgctcgtggttcggatgggaggtcgcgtcgccgagctgctggtctacggggatctctcgacgggagccgccaacgacctccagggcaacaccgagctcgctcgcaggatggttcgcgagtggggcatgagcgagcgactcgggccgatggcgtggggttcgcagaacgtcgtcttcctcggcgaggacctcctccactcggccgagtactccgaccgcacggctcgcctcgtcgacgaagaggtcgaacgcatcctgcgcgaacaggaggaacgcgcgaccgagctgctccgccagcacctcccgggcctcatcgcggtggcgcacgcactcctcgaacgcgagaccatctcgggcgaagaggtcgggcgtctggtggacgaggcggcaggccacccgatccaccccgacggcaagcgggtcctgccgatcgccaagctcccggagtacgccgagctcgagcagttcaccgtcacgaacggcaacaatcacgctgcatcgcacgacgacaccgaccccgtcagctgagacacccgtgcgcgagttggtcgtcgtcgccgagttcctcgggttgacggaggcgcacacctccgggggtttcctcgccctcgaccgtggcctcgcgaccagtgctcgactcgtggtggcgggcccgtgggcccccgaggtcgtccgtcgctaccgaggccaggaccttggtgtcacgctgacgctgacctcggcccatccgatcctgcgactctccccgctcaccgcggcaccaacgctggcgagcggggatggcggactcccggtcgcggccgccgacctcgtcgaacacgccgacgccgaggaggcagcgctcgagttgcgcacccagctcgaacgggccatctggtggggcatcagcccgagccacgtggcactcttggacgaggggatcctgcgccgcgccgacctgttcgacgtggtcgcctcgctcgccgaggagtacggtctcgtccttcgcctcacgccgagcgccgacgaggcacacctcggctacgacgcctgggggatcgctcgcgaccgcggcatccgcaccatcgacgccgcgatccccgtcgacccggcgacgctgaccgacgcgggcgccctgctggatctcgtccgctcgagtgcccacgccctcccagagggcatcagcgagctcggcctcccactcgcgatcgacagtcccgagctcgcggcctgggtcgcgagcggcggtgccgccccggcccccgtccggctcctcgagcacatcgaacgcctctggggggcactcgagcagcgctccatccaccggacgagctaccgcgacctcagtcgccgagtcgatcgaagtccgtccgacgggcgagctcctgctcaagggttcggtacgccggcgacgccgtaatgggcagcagagccacgagcagatcgaggttgccctcgacctccaggcgcccttcgagaaacgccgtcgtcggatcgagctctccccgctgcatcgcacgcgcgatctcgacgtccaccgtgatcgagacgtccgggttcgggtgctcgccaagcccggcgtcggcgagctgcccgtcctcgatcacccagtagtacggacgctcgacgtcggcaagcacgtagtactgcaccacgccgttcgcaccctcctggcgaggcatcgccgcaccgagttccttcgtatcggcgacccacgcgctcgagagccatgcccccatcacatcctcctcaccatcgggtctcgaggctcgccggctccagcagcagatcggcgaagagatcgtccaccacgacgccggctggctgaccgacgatgtggtagtcgtccgtcggccacagctcctccagctccgaagcccccagcgcgaaccaccacggcgatgccgggtccacctgcgatgcgtgggcacggagcgcctcgtgggcacgctcgatgaagccggtgacgtcgacacgcgccccgacgagctcgtcctggcccgggcgatccgtgcgagcccaaggaacctcgatcccccgtgcccgaagcgcctcggcaatgcggacggagcgctcccggacccacagtgaccacgcccaccgcggcactcgccacggtgggccgagctccggcaacaccgtgggctctggcgccaaggcgagcgcgaggcgcgtcgcttcgaagacacggagatggtccgggtgcggatagcccgcctggtcctcgggataggagatgacgacgtgaggtcgcacgcgcctgaacgtggcgatcaagccacgcgccgcctcaagcagtggcaccgaaccgaaggcgcgtggatgacgcgccgtgggagagcccggcatcccggagtcgcgaaacccaaggcgcacgatctcggcatagcccgcgatggccgccgccttgtcgagctcctcacgccgcatccgtgccatgcgctccggccgctccgtcgcgagctgagggttcaggtacgaaccctcctcgcccccggtcgccgtcacgagcacacagtggacaccggcatcggcgtagcgcgcgatagtggccgcacccttcgacgcttcgtcatcgggatgagcatgcaccgtcaccaggcggaacgttgcgatttggcgcgccgacgtctgggaactcacgccgccagcctaccgaggaaccactcctccagggcgccgtgctgccctcgaggcttacgccggcaccagcgtcaccgacccgctcacgctcacggtgccgacgccaggtcgaccggcgatcgcagcatcgaggacccgagcgagccccacgcgcgtcggcgttgcgccaagggcgtggatcgccccgaccatgttcagcccgaccacaacgccgagggtcgctgcacgagttccccctgcgcgtgcggacaaggtggcgacgagcggtgcccacgacggtggcagcgtcgtcggcacatcgctcacgaccgagaggcgtcgaggatcaatcccggcgctcaccgccagccatgcgccgtctctggcgggggcgagcatcgcgccgacgacaacgacggccttcggtgtcacgccagcctggacgagatcgtgcagcacggtcgcgtcggcgacaagatcgtcgccgacgacaagcgtggcgcccggattcgcgcgcacggcactcgcgagcgacatcgagctctcgccgatcgcgtcacgcacgcccgccggcagcacggtcatcgtcgtcccaggagggagccacagcaacgggcgcgcgcccagcgagccgtcgtgcatgagcacctggagctgcgcagcgaggggtggcagccagcctccagagacgatcgggaaggacgatgatgccccgatacgtgacgccaccgttgcaaccgtgctcgtcgctggcccgagactcgcgccgacgacggtgaacgcgtccaccgtcgtcagcgcatcgcgggtctcgatggccgctgcactcgacgtagctggcaccgtctccgcgatgaggtcgatgcggcgacctgcgacgccaccgtgctcgttcgcccacgtgagcgcctcgtcgatgccacggcgataggaggcagcgccaatgctccacggagactgagtggccgtcaccgtcgccactgcgacagagctcgcggtcacgccaggtgcgctcgccgccgggagcggcgtcgacacctgcgtactcgtgcacgccgcagcaacgaggccgagggcacaggggacgacgagatgacgacggcgcatcgcgcctcatgctatcgagcgccctactggaagtccctggagccaagggcgatggcctcaggaaggctcacgatccgatcagcgaccacggtcacgacggtcccggcccgctcgatcacgccgtcgaccagcaccgcgctgtggagtgcctgcgatcgatcgcgacgccagagccacggcttgaccaacacgttgacgaggcccgtctcatcttcgaggttcatgaagacgatgccacgcgccgtaccagggcgctggcgatgcgtcaccgtaccggccacgcgaacccgccgaccatggcgctggctcgccagctgatcggcgcgcacgacgccaagtgtcgacaaccgctcccgaacgaacgccatcgggtggtccccgaccagcaggccgagcgcgtcgacttccagcgctgcccgctcacgagggtcgagggcagggaagacgggctcgctcgagggaaacccgaggccatcgagcatccgatgccgacgtgccagctcgtcggcgaaccagatggcgcgctgccccgacggctcgagtgcacgcagggcaccagcgccagcgagacggcgaatctgctcgggcgtgagttcgacccgctggacgagatcgaggagcgagtcgaacggacgcatcgcgacgatgctcgacgccgtcgccgctgcgatccctcgaacggcgtcgagaccgagcgcaaggagctgctcgccatcgcgtacgacgacgtcggcgcgtgcgctcgaccgcgtcacatccggaccgaggaccccaacaccatgacgccgcgcatcgcgtacgagtgtctgcggcgaccagaaccccatgggctgagctcggagcagcccggcgtagaacgccgccgggtagtggaccttgaaccatgcactcacgtagaccagccacgcgaacgacgccgcgtggctctcgggaaacccgaagttcgcgaacgcctcgagctgcgtgacgacctgctcgcgcgcggccggatccacgcctcgagcggccatgcccgccatgagccggtcgtggagccgtgccatgcgcgcgctggagcgcttcgcccccatcgcctggcgcagctcgtcagcctcggcagcactgaaacccgcgacgtccatcgcgagctgcatcagctgctcctggaacagcggcacaccgagggtctttgcgagtgctcgctcagcgagcgggtgcggatagaccactggctcctcaccggctcggcgacgcaggtagggatggaccgacccaccttgaatcggaccggggcgaatgagcgcgacctccacgacgaggtcgtagaaccggctgggacgcagccgtgggagtgtcgccatctgcgcacgcgactcgacctggaacacacccaccgagtcagcacgagcaagcatctcgtagaccgccggatcctgttccagcgtggcgatgtcgacctcgacgccgacgcgctcgcgcacgagatcgaccatctcgtggatcgcctcgagcatgcccaacccgaggagatcgaacttcacgagacccatgcgcgcgcagtcatccttgtcccactggagcacgctgcgaccctcggcccgtgcccattccgtcggacacacgtccacgatggggcgatcacacaggaccatcccgcccacgtggaccccgaggtgccgaggagcgccctcgaggacgctcgccacctcagcaatcaccgcagggacctcgagcaacgggcgacccgcgccgtcacgttccgcgagtgagcgcgcgaccgaacctcggtgctcgacccccttcgaccacgccgcgagcgtggcctggtcgacaccgaagacccgcgcgctgtcgcgcagtgccgaccgagcacggtacgtgatcacgctggcgacctgcgccgcacgcgctcgtccatagcgggtatagacgtactggatgacctcttcacgacgacggctctcgatgtcgacgtcgatgtcgggaggaccgtctcgctcgggcgagaggaaccgctcgaagagcagaccgagcgccaccggatcgacgttcgtgatcccgagtgcgtagcacaccgccgagttcgccgccgagccgcgcccttggcagtagatgccctctcgcacgcaaaagtccacgatgtcagtgacgacgaggaagtagccggcaaaaccgagcgagcggatcacgtcgagctcgtggtcgatctgctcccacgcaccggggatccgcggcgcagctctcggaccgtagcgcctcggtgcccgctcggccacgagcgcgacgagggcctcgtcatcgtcgacgcccatcgcgacgacgtcacgaggcaggccaggggccaccagatcgacgttgaaggcgcaccgagcggccagctcgacggcggcgtcgaccacgccgggatagcggccgaaccgcgctcgcaacgcgcgcgctggccgcagcaccggcggccctgcgcctgggaggtagccatcgagctctccgagggtgcgccgtgcacggatcgcagcggcaactacggcggctcgctgggttcgcacgtcgatcgcgtgcacagcctgggtcgccaccaccggcaggccgtggtgcgcaccgatcgccgcgaggacgtcgttgcggaccgtgtcggcagggtcgagggtgtcgacgagttccaacaccaacgcatcgccgaagcgctcccacagcgagcgcacactgcgctccgcggcgctcggcccagcgtgcgcgagcgcacgccccggagggctcttgcgccaccccgcgagcacgaaccacccacctgatggggccgcctcagcgaggtcgtcgatcgtgagatcgaagcgtcccttctcgccggtacgcatgtgaccggtcgcgatgacacgcgacagcgctcgatagccctctggcgaggctgcgaggaccacgaggtgctccccttccgggtcggtcgcgccagctcgaggcgtcgtcgtcgccaacgtaagttcggcaccgacgagtgggacgacccccacacggcgagccgcctcgaggaagcggggtactccgtagagaccgttgtgatcggtcagcgcgagcgcacggtaacccgcgaccgccgcggcctcgacgagatcctctggatcgacgacgccgtcgaggaagctgaacgacgaatgggcatggagttcgacgaccgcctcgctcactcgtagctcccctcgagccaccatcgcccgtgctcccgtcgaacccagcaccaccgccgctcggtcgcgagcacgagtcgggcgtagcgagcacgacggcgctcccaccaccgctcgcgcaccacccacggcccatgagccgcctcgatgcgctcaggaccctctccgtcgtcgagcaccgccggtggagcgctcaagacgccatcacgatcgacctcgacggccataccatgcgcatcgagcagcacgacggcctggaggcgctccggaacccgcgtcggcgtgagtcccggaacatggccaggccacggggcgccagttccgaccctgtcgtcgacgaccggccaaaccccggtccaggacacccaaggacgtcgatcggcgaacccgcgacccaccggtcccggacctgcgacccgaaccgcctccggtccatagcgctgctggagcacgtgaaatgcctgacgtacggcctgacgtcgcgcgccaggcacgccatcgagggagagctgcgggggttgtggcacactccacgcaaggatctccacgccgacgcgtaccggtcgcccccgagcaccctcggcgcgatcgctcagcgcacgcaccgattcgaggatctccgccgccgtccctccgaccgggcgctcgacgacccgctcgagcgccacggctccctcgaggtcgacgaaggagcgccatcgggcaggcgcgacgtctgcgtgctcggcgagcacgagatcgagcgccccacggaggcgaaaccgcacgctctgggcatcctcgccttcctcgacgtcgatcgccaccgcgtccggctcgagtggaggggtgcgcacgagcggaagatcggcttccagtcgcacgagtcggtgccagcgcaggccacggtctccgaagcgagcggccaccgcagccgtgtcgatgcgctggaagccaccgacgcgacgcacgccgacgtcacgaagcggaccagcgagccaccggggcagcagctcgaccggctgggcagcgaaccacgcccgcgagcccacctcggccccgcctccatccgtcgtggcgccagcgacggtggcgatgagtgcgcccgcgatcgaagcacccagcgccactcgagtcggcacggtgccgtcgagggctgcccgcacgcgctcgacgagtgcgtactcggtcccgtagaagcggcgggcggcacgcgcttcgatcgcaaaggccccacgcacgcctgccacctgacccacgcccggcgagacgctccagagtgcccggtgcacgcgggccaaccaacgtgcctctgcgatcggatcgaccgcgaccacccggccatcaccgaggcgggcacgcaccatgggggcacgtgccccgagggggatcccagcagctcgagcacgggacccgacggcgacgacccgatcgcgacgatcgacgacgacgtcgaccgcatcagcaccaccatgtgcgatgagctcgagatcctcgatccacgcaacgacccctggccgcgcagcgaccagctcgatgccgtcgaggtcgatctcgtcgaggtcgatcaacccgccacctcgacggccgtgggcgtcgtcgtcaccagcgacgaacgacgcaagctgacgcgcacctcgcgcggcaggccagactcctcggcgaccgtcatcgaggcgacctcgagcgcacggatcgatcccgctgcggccagcacgcggtggcgctcgcgactgcacgcgcgttccagcaccacaacgatccctcgtcggcggcgcacacgcccgagaatgcgcggccaccggacgtcgacaacccgatcggagacgacgagcacgtcgaccacctctgcaaggttggacgccacgaccgccagctgcgctgtcggcaccgacacctgtgccacgtgtgtgagcgaccacccagccgcttcgagcgcggcggctggcaggtcctcgagaccgagcagcgccaccgccctgccctgatgagtactcggcgcgatcgcctcgagtgcaccccaacgcgcacccgggccgccgtgcatcaccagcgcggttccaggcgggacgccgtccccgaggcactggcccgccgagccgcccagctcgagtcgctggtctaccagctgcccagcagacaggaaggaggtcacatcgtgattttagaacatttgttcgttcatcacgacggctccccctccatgcgcccccactgcgcgatgaagtggatccgctcgggaagcagcagcgaccgccgatactcgaccggtcgcgccccggcgaacgtgcgccgctcgaccagcaagagcgcttgaccgacctcgacaccgaggagacgagccacctcgccgtcagcgttgacggccgagacctcgtccatccccgccgacacgtgcacgccggcgtgctgctccaagatctcgtagatcgatccctgctggagcttggcctcgagcaacacctcgccctcggggagcacgacgctcgcctcctcgagtgcgacgacgtcctcttcgacgccccggaggcgccggaccacgacgaacgactgcgcagggatctccaggcgctccgcagcccgagcatcgtcgcgcacctcgacactcagcagcgtcgcgacctccttgcccacgtcggcaaggcgcgccgccagcgagaatcgctgctgctggtacccctcgaactgcctcctgggcactacgaaggtacctcgtccctggcgagcgtcgaggtagccctccatgcgcagctgacggatcgcctcgcgaacggtcgcgcgcgacaccccgaaggcatcgcgcaattcgggctcggaggggagacgatggcgcacccgaccatcgtcgatcgccgagcgcagctcatcggcgagctgcacccacagcggcaccggcgaccccggatcgagacgagccggctgtagtcggtcagtcacgagatcccccatccgttcgaagcagccctgcaggtgtgctcacacccggcgcgctgatccgcccaacccatcggtccagcatacggtcggcgctcaacctgcaccgtcgagcgctccacgcgccagacatcccagctcgttgccccaccgcctggcggcgacacgagtcactgagaccaatgcatcgagacctcgtcacggagggcgatcgacacacgacgcctacgcgatcgcgaccgaccgctccggcgtacccgtcgcagagacgaccacgacgacaccggcgctccagcctcagcgatcgatctgacgcagccgtccttgatgcacctcgatgcggcgctctcccgcgaggatggcctggatcccacgtcccacgacgtcgtagcgccacccttcgagcaggctcccctcgccccgagacacgaagagctccacctcttcacgcgaaccgagcaacgagggctcgagttcgagctccagcgccactgcatggacgagcgcttgtgccgtgagcacgagcggcacctcgtggggatcgagcgcgcgatccatacgcacggcgccccgagccacgatggcatcgtcgtcacgcgcagctcgtacgacctcgagtagctcacgagcacgttccttcgccatgcggccgtcgaagccccgcacgctgcgcagctcggtgagcgagctcggacgcgccttggcgacactcgccacggcgagatccgagagcaccgtgcgcaccggaacgtcgtcgcgttgggcggtgcgctcgcgccaggccgccacgctcgctgcgatccgtctccccgtaggatcgaggccacgacactcccggatccgtgtccatgcgagctccggttcgatgtcccgacgccgccgctccacgagacgagccatctctgagcgagcccagtcctctcgtccacgagcgtgcagttcctcgagaagccggtcggcgagcgcagcgaggtagcggacgtcgttcgcggcgtaggcgagttgcccgggctcgagaggacgacgcagccaatccgaggtgcgctcagccttggagatgctcacgccgaggtagcgatcgagcaacgcgccgagactcgcgtgaccggccccgaggaatccacctgcgacctgggtgtcgaagatacgccgtgggcgtgcgccgaccgcgcgctcgatgatctcgaggtcctgatcggcagcgtgaaatacgagctccacctcgtcgaaccacgctgcgatcggcgagagatcgacccgcagcggatcgatcaaccacaccctccgatcgatcgcgacctgcaccaacgcgaggcgtggatagtacgtccgctcccgatggaactcagtgtcgatcgcgatgcgtggcaccccgagcccgacgccgacgagttcgtcgaggtccgactgtcgatcgagccagacgggctcgtcatcgctcacgaccgacgcactcagcgccatcagcacgacccgcccgtcgcccacacggcgctcgccgtcactctggccacgcctccagcctaggagcccttcgaaccagccctcccgtggggatggggctggtcagaggtgacctcagctcgcgagcaggccgagagcatcgtcgtgacctcgcctacagtccttggcaactcgggcaccatcgcaagatttccggtgttcgcggcggccaacacgggttgcctgctgcaccacaccacggcgaagacgttccgagtcgagagcgatcacctgagcgaccgacccaatgagccaccgccgcaggctgggcttccccccacttgcttgacagcctgattgaggccacggccgcctcccgacgggtccaggagagctcgtactcgacgggtggcacgtacccgaggctcgggtgcggtcagaccgcgctgtcgcacttgatccagacaacgagagcatgaccgagctcagggaggttcgccaaccgacgccgagtgaccagctcccgaatcgcgttcgcgaacgcgatttcggcctcaacgcaccaagcgcccgggacgaagcacagccccttcacgcgtgcgcagaccgccgtgccacgagagctcgtgcctgcgtccgtccgagcatgactcggccacggcggtcccccgccctacgctgtggccgtggaaggttgcgtgttttgtcatctccttgccacgagtgacccctatctcgtcacggcggaccacgacgtcgccgtcatcttggatcgcgcgccggtggctcccggtcacgcgctcgtcatcccgaccggccacgtccccaccttcgatgacgcgagccctgctcagttggcttccgtcacggtgaccgctcaacgactctcgcggggcttgcgctcgcacggcatcgcggacggcgcgctgatcctgaccaacgtggtcgtctcgcaatcggtgccgcactggcactgtcacgtggtgcctcgacatcgcggcgatgggcttcgaggcttgctctggcctcgacgtcgctacggcagcgacgatgaggtcacgctctggcgcacgaccctgcacgcgctcgtagcaccacagagctaggaaccctggctggcgcccctcaaacaagaccacccgcttcgtgagcgaccagaatggacgagtgggagggagaccacatgaagggcccgaagcgccataggccggagcagatcctccggaggctggccgagggggacagctgctgaaggcgggcgccacggtcgtcgaggtcgctcgggccttcgcacatcaccgagaccacctgggagcggctggctggccttcccccctccaggttgacacctgctctaggaggaagggatgagccagacaccgaacccaccaccgggcgacagccccgctcggcgacgacgcggccgctacccgagccagttcctcaaaggagccgcagcattggtcctcgaccagcgtcgcaccatcgctgaggtcgcccgcgagcttggcgtgaacgagcagacccttggcaactcgcgtgcaccaggaacgcatcgaccgcggtgagcgcgaaggtctcacgagcgccgagcgcgaggagctcactcgtctgcgccgccagctcaagcaggtgacgatggaacgtgagctgccgaagcgttgcccggcctttgcggatcctgcgagggcaaccagtgacccgctaccgctccggttgctcgtcaggaggccgatgggttctccgtagcggcagcggcacgagtcatcggagtctcgcgccaggcctacgacgcctggcgacgctggcgcgagcgcggccctgaccccgagcacctggtgctcgcgagcgagcttcgcgccatctggcgcgagagcgacggcacccacgccaagtcccagagtgacccacgagctgcgacacgcggtgagtgcgtcaaccacaagcgagtggaacgcatgatgcgcgagctcgagatagccgcctgcccaccccggcgcttcgtgcgtaccacgacgcctgcagaggacgcacccctcccggacctggtccagcgggacttcgcccctggcgagccagggcgttgctctgcgagcgacatcacctgcgtccgaaccgatgaggggttctgctacctcgccacggtggcagaccttggctcgaggcgcatcgtgggctgctcactccagcatcgcatgcctgatgacctggtggtcgaggcgatctgcggagctcttcggacccggggcagcgtggctggggcgatctttcacagcgatcgcgccaaccagtacctctcccggaaggtttgccagctctgcgcgacgctcgggcttcgccagtcggtgggcagggtcgcgacctcgcgacgacaacgctgtcgccgaggccttcttcggcagcctgaagcgcgagctggtgggtcgctaccgcttcgcgaacctcgccgaggcccgccctgccatcgcgagctggattcagcgctacaacacggtccgcctgcactcgagcctcgggtaccgaccgccaatcgagtacgagctcacctgggcccgtgcggaggcggccgtggcctacattcagactgtcaagcaaatggggggaaggccagcgatctggacccactagtgggtggtcgccactttctcggcgacctcggacagtcgggcctggaccttggacagattttcagccctgacaggattctcggtactcacatgcagaccaggtctcatgtcggcactatcaccgcgacgccgtactgggaggccgccgccgccatacggttgtcgtaggtgacgatgccgtcgagctcgtcacccagttccagagctgcggcaagatggagcgcgtccagactccgcaactcttcggggtcaagggtggccgcccgttcgagcgtggcagaggtgaggttgaacaaggtgagagcgtcaagtactgatcgagcgcgctgcatccgatcgggggccgcgcgccgggtcgcccgaaggagctcggtgcgcagcaagtcactggcaatcacctgggtttcgtggctggccgcccacgatgccatggcttctgacgccggttcggcgacaacgagcttggccgccgccgacgtgtcgaggtagaagaccatcagtagcgctccccgccacgcatggccgctacgacctccgacagcctgggctgctccgcacccgcgtcgggaggcgcgccgagagctgcgagcgagcccttcgccggccgagcccgacccgacgcgacgaaggcagcgactcgcccctccgggaccggaacgagctgggcgaccggtcttccccggtcagtgatggtcaccacctcgccggcggcggctctggccaccacctgcgaggcgttctgcttgagggcgcggatgcctaccgtactcatgttctacattgtagcactctgtcgctgaccgctccagggatcgatgtgctcccaggcgtgttgaaccgccccgggtttcgtgcacacttcgttatgtgtgaacggtctcggactcggccgccaggcggccatagtactcctgctcgacctcgacgggtggacggcgccccagccggtgcatgagcctccgcgtgtcgtaccagttcacccaggctgaggtcatctccttgagctccctgcgcagcctgatgagctcggtgcgctcctgcgccgtgaggggcgggctgccagtggcgctcgctgcctcgatccgcctgcgctcctcccgcacccatcgaaagatggctgtactccccgatcgcgagctcccgggccacctccccggcacgctccggccgctatcgataacccggtgggccgcctcgatgcggtactccagggtgaactgaccttctcccctccttctgacatcgtacgtgtgacgaacgacgtgtctacggaatctggggcggctcagacgtcggatctcacagtgagggtggactcggtgtggggggacggtcagagcgaatcagcgcacagcgcaagcgcaagctctctggggcgaggctgcgctaccgaggactcgtgcgcaaccgcctgcacttcgagctgctctgtgcgacctggaacctgagggtgctcccgcgtctcgggctcacccgagtaggtggcggctgggtgcttgccacctgagaggcgctcgggcccctcccctccttgcctccgaaggaggggacgaagagaagagggtgaggagctgggcgagcacgggtcagctggatccgttctctggcagggttggtgccctcagccaccacccgggaggggcttggtggggaggctgctagttcgcatcgttcagccgcaccaccacccaatcgcgcttgccgcgacgcagggtcagatggccatcggtgagatccgcctgcgacacacgctgaccctcgagtgctcgacgtccgtcgacatagaggcccccttgtgcgatgaggcgtcgtgcctcggaccgactcctcgcgagccctgctgcaagggcgagatcgatcacatcgatgccgtcgccaaacgccgcgcgctcgagggtgacgacgggcgcacccgcctccgcacgtccaccctcgaagagcgcacgagcggcctctgcagcctgatcggcagccgcctccccatgcacgaagcgcaccacttcccacgcgaggcgccgatgggcgatgcgccgagagggatcgtcctcgtgggcagttcggagcgcagcgatctcatcgaaagagagaaaggtgtagagggccacgtactccatgactttctggtcctcagcccgaacgaagaactgatagagctcgtacggcgacgtgcggtcttcgtcaagccagacgttaccccccatcgacttgccgaacttggtcccgtcggccttcgtcacgagcggccacgtgaggccgtggacctcgtgcccgtcgagacgtcgcacgagatcgatcccggcggcgatgttgccccactgatcggacccgccgagttgaagcgtgcacccgtagcggcggtggagctctacgaagtccaccgcctggaggatcatgtagctgaactcggtgaacgacaggccctcaccgccgaggcgcgtacggatcgactcgcgcgccagcattgcagagaccggcacgtgcttgccgatgtcacgcaagaacccgatcagggtgagcggctcgagccacgttcgattgtcctcgagcgtcacggcccccggcaccacgtcgccgaggagtcgttggagctgaccggcgatgcgggccgtgttgtgtcgcagtgtcgccggatccagcaagacccgctcgctcgagcgacccgagggatcaccgatcatgccggttgcgccgcccgcaacgaggatcgcccgatgacccgcatcgatcagtcggcgcgccagcacgattccgagcaggttgcccacgtgcagtgagtcggcggttggatcgaagccgatgtagaagacccgtggcccggcatcgaggagctgctcgagtggcgccgacgcatcttgaaccgcgccacgccacctgagctcctcagcgagcgacacttgatccccctgtcacgaccgtccggcagcctggtagagcctatcgagctcggcgttggtcgcctcgcgagtcgtgcccacgcgggccacgacgaacgcgcccgctcgggcgcgcgagagggccgtcttgacagaggccgcatccttgagcgtcatcacctcatggccgaggccttcgaggatgcgtcctggcgagtaccgtggcggcgtcacgaagaaggagcgctgcgtcgtggggtcgagcaagcgcgccggagcgacgcggtcgaagatgacgcctccttggttctcgagcaccacgaccagccctcgctcgggcaacggcagttgccacaaggccgagagtccgtagagcgcggtgaggtccccgacgacgaggacactgagcgctctcgacgcgtgggcgacgccgagccaggtggcgagggtgccgtcgatgccgttcagacctcggttcgcgaggacccggacgccagcaggggcgcgaccgccgaagacctcgaggtggcgaatgggcagcgacgacgcgacgacgagcgactctccgtcgtgcagtccctggaggacgacccgggcgagggcgacttcgccagtgggcccatccgcgaccacctgctcgagcgtcgccgcgatggtgcgatcgcgctcacacaacccacacggctcgcccgcgtggccgcccggcacggtcagcagcgcacgccgcagggcgtcgccgacgtcggcgaccaccgccgtcgtggcgaggcgcgctggatcgcgccagcgcgatcggctctggatccacgccacagggatgccccgtcgtgccgcaacggcgatgcgctcggcgaccacacgcgaggcgtgtggggcgccgaggacgaggacaacctctggggaggcgtcggggagtgagcgcaggacgagctcggggtgctcgaggacccacgggccgcgctcgacgccagcgagcggatcggccagcacgggccagcccaggtgcgcggcgacgctggcgagggcatcgacatcgatcgtgtcgtcctcaccgacgacgagccagcctcgacgctgaggatcgaaccactgcgcgagccatgcatccgccaggctgggacgactcgggatcgtcaccgagcgcggatgccaaggtccgatccgaacctcctcgtcgacgagaagcggttcggcgatcgcaagattcagcacgcacggcccagggccgaacggcgcggcaaccgtgcgcacgaggagctcgtgcgcgacgccagcgagctgctcggcgtccacgacgtcggagagctccagatcgatgacgctggccaccgacgcgagcgtctgggcctgctcgaccgtttgtgcagcgcccacgccatgggcccagcggggccggtccgccacgatcgccacgagcgcgacgcccgcctcgcgagcctcggcgagcgcgggaacgagctccagcgcagcggtcccgctcgtcgtgacgaccgccaccggtcgacggagtgccttcgcccacccgagcgcgaagaaggcagcttcgcgctcgtcgaggccgacgacgaccgacgcatcgctcgcactcagcgctgccgcgatcggcgtcgaccgactccctgggcagagcaccgcgcccgcgagcccaccgagggtaagggcctcgacgagcaccgtacactgagcaacgctgcgtccaaggagagacgatgaccaacgctcgtgcacgcaacctcctcggaccgaccggtgctgtcgtcgaggtcacgagcaccggcggacccgagcgacgcgccgtcgtgctccacggcttcactcagtcgcgctggagcctcatcggcacgctgcttcccgtcgccgagggcattgccagcgagatcgtgttcctcgacgccccaggtcacggcgccaacctagggccctccagtgtacgggcgttcctcgacgccgttgcggagctcgacccagacatcgtcatcggctactcgatgggtggtcgcctcgccctctggctggccgcggtgcaccccgagctcgaggcggaggtcatcgccttctccgcgcatcccggcatcgaagccgccgatgcccgcgccgaacggcgccgccgagacgaggccctcgcagaccgactcgaccagctcgctcgaccacgagccctcggtgccgatgcgagcaacgtcgacgccttcctcgacgagtgggactcccagccgctcttcgcgcgccgccggctgagcgagcggcgacgcaggggccgggccctggccgatccgagcgggtgggcccacgccttgcgtgcctacggcacgggcagccagcccgacctcaccgaggcgctcgctcactcacgagcgcgcctcgcactcgtcgtcggcacgcgcgacacggcctacgtcgcgcacgcagcgcgcctcaggcaccgtgcgcacatcgtgaccgtgcccaacgtgggccacgacgtgctcgccgaggcgcccgagatcgcccaagggatcgtgctcggactcctcgccgcccggcgcgcaccgacgtcggctccctaagccgcgagccacgctgccagcgcaaaggcgaggccgagcacgagggtcagccgcccggttgcagccagcgaagcgacgagcggacggcccttggcaccgccaacgaccggcgcgatcgcgctcggagccgcgacgagcccgaccacggctaccgcggccaccgcaaccagccgatcggtggcgagccaggttgcgagcgccacggcaacgacggaggccgccacgagcgtcacgaagagcgcgcgagtcgtcgactcgccgagccgcacggccagggtgtgcttgcccgcgagacggtccccgtcgacgtcacgcacgttgttgaccatgaggatggcgctgatcgcaagcccgagtccgatcgccaggatccagccatcagccgggagcgcgtggacctggatccacaacgtcccgagcgtggcgagcagcccgaagtacgcgaaggcaaacagctcaccgagacctgcgtagccatagggtcgtggtccgccggtgtagaaccaggctgcagcgatcgcactcgcgccgatcacgagcagccaccagctcgtctcggctgcgacgaccaccccggccgccgcggcgacggcgaacgaccccagggcggccgcacgaacgtgcgcggggctcgcgagcccctggccgaccaggcgaaccggtccgacccgagcctgatcggtaccgcggataccatcggagtagtcgtttgcgtagttgaccccgacctggagcgcgagcgcgaccaccgccgcaaggatcgcgcgcagcacgacggcgtgatggagatgggccgcgaggccggtcgcagccagtaccggagcgaccgatgccggcagtgttctcggccgagctccagcaatccacgcgcctacctgcgccatcgttcctcccttcgcaccatgccagtctacggaaggttcggccctaccatgagagatcatgtcgtcgccgtccaacgtaggtcgacgcctcgtcgcgctccccgcccgtcaggacgcctggctcgtggatgccatcgcgaccgcgtgggaacgtggcgaggccgtgtgtgtcgtcgacgtctcgtcgccgatggttcgccaacgcctcgacgcgctcggcgcccacgtgcttcgcctcgagtcgtcggagatcacgctcgacccgtcggcgccacccctccatgacgacgcctggatcgtgcaggtcacctccgggacgaccggcgcaccgaaggccgtggtcctcaccgagtccaacgttcgggcctcggcccatgccgtaggtgaacggctcggcatctcgagccacgaccactggaccaccgcgctctcgcccgcgttcatcggcggactcgccaccatcgcccgcgccatcgtcgcgggcgtgccgatcacgctactcgcacgtcaccgacccgagcacttcgcccgtgccgtcgccgctggtgcaacgttgaccacaaccgtggcgagcgccctgctcgagatcgatacccgtccgttccgggccgtcatcctcggcgcccagcccgccaccggcaacctggcccccaacatgcacacgagctacggcatgaccgagaccggctccggcgtggtgtacgacggcgtcgcgttaccgggcgtcgaggcgaggctcgtcgacggcttgatcgaactccgcggacccatgattgcgcagacctaccgcactggcgccccgatcctcggccccgatggatggctcgcgaccggtgatgtgggcgtgctccgagcagggcggctcgaggtccttggacgagccggcgacctcatcaactctggcggccaccacgtgccccctgacccggtcgaggccgtccttcgccgcaccctcgcagaccgcgtcgtcgatctcgcggtgtacgcgacggccgacgatcgactcggagagaccgtgaccctggccgtggtcgccgagcgcccaccgagcccagctgatctgcggaggtcgctcgaaggtctcatcgagaccccatggatcccgcggcgagtcgtcgcggtcacgtcgatcccgaggacggaaaccggcaagccactgcgcagactgttgcctggcgcagtggctcgcacaccacaagcgtccacgaccgacggctccgccgcgtcgatcgccgcggtctcctagtcgacgagcggttctggcgcctcgccgacgtcgtcgaggtgcaccacccgctcctccgggctcggcatgcggaagtagggccggcctttggcccagtaaatggcgatagggatgatgccgagcgcgatggccccgataccgaccaccttcgtcgtggtattgagccctgggaggctctgctcgaacatcaccgccatgaagatcgctccagcgagcggccagagtccggcgaagatgaaatacgagagcttcgtgaacaggagcttgcggtacaagatcaccaccgagaaccctgcaaggccgtagtacacggcgatctggagaccgattgcgttgatggcgtccgacaagacggtaccgacggagccgacgtagttcgacgcgatgagcagcccgaccgagacgacggcaacgacgagcgtggcggccacgggcgtgagccgcgtccgatgcgtacgaccgaggatcgagggcatcgtgccgtcacggcccatggcgaacaacgtgcgtgacacctggatgatcgtcgtctcgagcgtcgcgatcgtcgagagcgcgacggcgacgacgatcagcttgcccccgatcccgggccagaccacctgcccgagcgcatccaggacgtcaccggcgttctggctgatctgatggcccgtgagcaccatgttggtgccgatggtgaacacctcgaacaagatgaacaccacgatgacgccgttgatggccccgagacccggggtgacccgcgatcccttggtctcttcgttgaggttggccgtaacgtcccacccccagtagtagaacgccgccaccagggcacccgcgaagaaccctgccgaaccgtggaagatcgacggggagaaccagtgccagctgaagctcaccaccttggggctgtgcaccagcatcaagatcgcaaagagcaccaagatcgcaagttcgatcgtggacatcgcgacctggagcttggccgtgatggtcaccccagcgatgaccgcaccgaccatgatcaagaacacgacgatgccgaggaacgtcacccacccggtcgagttcgcgagccgctgcgagaacaggccgaggatggtcgatcccgccgggaccgaacctgcaaccatgaagatgagcgccgacaccacgaggcaccagccggcgatgtagccgagcacgggatggagcgcacgtcgcacccacgcgtacgtcgcgcctgcgttcgcctccgatcgcccgaggtagttgaacgcccagacgataccgaacatggcgattccgcagtagagcagggccgccggccctccgagcgccacggcgccgatcagggtcgccgtcgatgctgcgatggagtaggcgggggcgacgcctgcgacccccatgaccgacgagtcgaagagcgagagggcacctcgccgcaggcgatggtggtcccgactgttggcgtgctccagtgaatccatacctcccccttctcgagtccgacgccgaggctccccgaggttccggcgttactcgattcgcggggaattctacgctcgaccatcgaaatcggcaaggatttcacgaattacgcacgaattcgcaacaatcacggccccccgagccgaccgatcgtcagcgtcccgccgtcgacgacgaggttggcccccgtgatccagcgcgcctcgtcggagacgaggaacgcgaccgccgccgcgacgtcggcgggctcaccgatccgccgtgccggcaacgagcgagccagctgcgcctcgagcgcatctacgaggaccgccgcaaaggatgtgcgcaccaggcccggcgagaccgcgttgacgcgcaccggtgcaagctccgtggcgagctggcgggtgagatggatcaacgccgccttggagacgttgtagagcccgatgccgggctcgggctcgagccccccgacgctcgcgatgttcacgatcgccttgtcgtcaccaggcgcgctcgcgaaccgagcggcgagcaatgcgggggcacggacgttgaccgcccagacgaggtccatcgcttccggctccatctgggcgatcggaccgaacgtcgggctcgccgcagcattgttgacgaggaccgacaccgacccgaacgcagcgacggctcgctcgaccacgatggtggcgacctcgggatcgcgcaggtttgccgccacggtggtcaccgcgacgccaccggcgcgcaggtccttctcgaggctcgcgagctcctcctcgcggcgcgcgaccccgacgatcggatagcccttcgctccgagcgtctcggccacgctgcgaccgatcccgcgcgttgccccggtgatgatggcggcacctcgatgcatgtccccacgctatcggtcacgccgagcgctagcctggcatcagtcggcaccacgagggaggcgccggtggggaatcgccttgccaccagcgacagcctgtatctgcgcgatcatgccgacgatccggtcgactggtggccctggtcgagcgactcgctggcgacagctgctcggctcggtcggccgctgttcgtgtcgatcggctacgccgcatgccactggtgtcacgtcatggccgagaccacgttccgcgatcccgcggtcgcagcgctcatcaacgagcacttcctccccgtgaaggtcgaccgtgaggagctccccgacatcgatgctcgcttcatggcggccgcgctcgcgatcaacggcagcggtggatggccgctcaccgccgttgccacgtcggatgggagacctgcctgggtcgcgacctacctcccgccacgctcgacgagtaacctgcccggcctgatcgagacgctcaccacgatcctggacgcgatcgcacgcgacccccgcgcgctcgagcgtgctgccgacgaactcacgcgcgcacgcctcgagcctcgcagtcggcgaccaactgcgccaccgaccgacgagatcacgatgcgcctgcggacggacctcgcacgtcagctcgatcggtccgagggtggcttcggaacggcaccgaagttcccacaggctcacgcactcctcgccctctgggagctcgtgcgcaccggggatggcgtcgagacagtccgcgtgcgagagctcgtcctcgcgagcgtgcgccgctacgccgagagcggtctcgtcgaccacctcgacggaggcatctttcgctacgccgtcgatcgcccgatggtggacgtgcactacgagaagatgctcgtcgaccaagcctggttcatcctgctcctcgcggtgatcggtcccgatcgcgaggatctcgacctgtacttcacgctcgagcgcacgatcgccttcgttcgacgagcgctcgtacgcttcgacggcctgctcgcaacctcgctcgacgccgacgcccacggagtggaagggggcgcctacctcctgcgcgccgaggaggtccgtgccgtgctcggcgacgaggccgcctgggtaatcgacgagcttcacctacctcccgatcgcccccaccacggccaccggatcggcgcttcgacgctccgattggaagggaacgcactcacccgcttcgatgcgctcgccgcatggcggcgcgggcgcggcagtgcgcgacgcgacgacaaggccttgtgcgaccacaacgccgccgtcgcgaccgcactcctcgtcgccggtcggcgctcgggacgcgacgagtggatcgtctggggtctcggcctcgcgcgtcgcgtgcatgcgacgttcgtcgatgcgagcggcgcccgtcacgtcgcctacggcggcgaggcccgcggagcaacgagctccgacgagctgtgggtctcgatcatggccctcgccgcatgggaggtcacgggcgcgactgcttggctcgagcgcgcgcgcacgagcgccagtcgcctcgtcgaacggttcctcctcccagggctcggcatggtcgtctcgagcacggagcctggtgaggccgtccccgaccgcctcgacggcgcccacccgtccgtgagctcactcgccctgtggcacctcacgcggctcgtcgcggtgagcgcggacgaccgcctcgcccacgcacgcagccagctcgccgatgcgctcgccgatgtcctggaggccgcgccggccgcagctgccctcggcgccctggcgatgggacacaccgaccgcgtgcgcaccgtcgtcgtcgcgacccccaacctcaccgaactcgcccgtgtcgccctcgccgctgctcgtccgctcgacgtcgtcgtccgcgatccgacccacccactcgcgaccggagcggctggcgaccgggccgaggtgtgtgttgctcacgcctgcctgctcccgacgagcgatccacgcgtcctggctgacgcgctctggtccacgctcccgtgatgcgcaccgaagcccagctcggccgcgagcggtctcgtccacggagcggccaacccgagctgtgacgccggccgagcctcgacgaccaccgttcagcacgccgactcgacgacctccggcggcaccatcacgtcggcatcacgacccagtacggagccccccagagcaccgtcgactcgccgccgccatcgcgcaccagctagcctgaggtccaccacagtgacctgcggaggagggcgcgtgcatcgttggccgccggtggaagcctgagatgtccacaccgtttcgacatgtgctcctcgggacactcgacgtgcctggccacgaacgcgagttcatcatcctcgaccgggccgaactgcgcctcatccgcgtgatcgcacagcgctcgggcgagctgacgaacttcggctacgtcgtcctcgagcacgagcacgcacccgacgaggcagatccggctcgccccgatctgcgtatcgccgccgaggtctccccgaccgagcaggtcgccaagcgtcgccacctcgtctcgtggctggaacgcctgagcgcgagcgagcgcctcgccccacttgggcacccgggccccagcgtgccgtacgcccgcttcgatgggacccgcccctcgctcgcggtcgtggccctgcgcgatcccacgcttgggcgcggacgcaacgacgaggccgtcctcgagttctcctggggatcccttcgtcagctgatgccggtgaccaaggagctcgaggcgcgactcggtggcgggccgaccattacgcatcgcaagggttggcagcatgcgttcggacgcgtgccgcgcttcgcgctcgccgcctacacgccgccggatcacggctactgccgcaagctcatcgtcacgctggtgtgacgagcggtgaacggagaacggagaggcctatgacccgcataccagagtggttcggccgcctggaccccgaccccaacgcgcccgacgatgtccgcgcgcgcaacgacgccgtcgccgaacggaccggctttctcccgacgatctttggcgccctctcgtggcggccggaggagtatcgagccttcttcggctaccacgatgcgctcatggaggtcccgagcggtctcacgaaggctgagcgcgagctcatcgtggtcgcgacgtcggcgggcaaccactgcctctactgcgtcatcgctcacggcgccattcttcgtattcgggcacacgaccccaccatcgccgaccgggtcgtcgtcgatccagagcgcgcagacctcgacgaacgatcactcgccatcgtgcgctttgccttcaaggtgcgcgacgaagccaacgcgatcacgcccgaggacttcgcgccgctctacgaggttgggctcgatgacaccgacatctggctcgttggggcgatcaccgcgttcttcgctctctccaatcgtctcgccggcttcgcgaagatcctcccgaattccgagttctatgccatgggacgtacgccgcgaagctcatagcgcagcgaagtggcgtcccaccacgtcgtgcactttccgggcgccacgaaccccaagagggcgggccaccgggcgatcgctggcgtgtcagccaacagcgagccagaggagccacgcgagtggccccgacccgttccgactgtacccgcgtgctctggcaccatcagggcaggcgatgacatcgacgtcatccgagaggaggtccagctcgtcctccaagccctcatcgagcaggaggcagcagcagtcatcggcgctcgccgcgaaaacgagacgagggacgccagatgcagcgccacggtgagcgcagaccgtctgctcatcaccaaggccggcacgtggagctgcgtatccgcacggctccgccagaagagcgtgtcccgagcatcggcgagcgctggcgcctgtgtcgatcgtgccctcgacgccttggtcatggaggcctgcgtctgagggcgtcagcacccgcacggtcgatgacctggtcgcggccctcggtgggacgggggtcacaaggagcgaggtctctcgcatcgtcgcaacctcagacgaggagctggcggggttccgtcgccgcaggctggaccatcgctgcgttctgctccctcctcgccgatgccaccgacgcgaagggccgccttgcccaccgggtcatctcccgcgccgtggtgaccatcacgggcgtgcatgccacctgagacgcacgaggtcctcggggtcgtgcgtcggggacgggcagaccgagagcttctcgcccgagtactcgagggagctcaggggtcctgaggcctcggtggtgtgtgcctcgtcatctccgatgtgcgagcgcgggctcaccaccgccatcgcgaggtgcttcatcgggacgagctggcacaggtgccggatgcagcgtgcgcgacgtgctcgctcgcatcgaggaaggggagcctgggagacatgaacctcgcctcagatccgcacgatcgtcgctcgagccttcctcggcagcgctccgtacccaggacgaccaggtcatcgactcccttgccctcgaagctccccgcggttgtgaccgtgctcgccgaggccaaggaggaggtcgctcaccttctgagagcttctcggagggttgctggggaacgatctggtcgacgaacccgctcagagcgagtgaaccatgagatcaagcggcgcaccaacgtcgtcggggacttcggcaacgacgctgctctcctgaggctcgtcaccgctgtcgtgctcgagcagcacgaggactgggccgttgccgagcgacacggccgctaacaggagtgaatggcagagctcggggctgcaacgagccgcgacgacgacacggcgggcacctcgccgacgcttggggcccctggcgctccttgcgtgctggcgtcgctcgccgaggcggcacctgctgtgagaggaggaccagggagtgaactgacaccactcggtgggacgtgatctcgttgcccgagaacctcagaaccgctggcgggccagcgcccagtacggcgccgggcgatccggggtaagacttcccccctcggccagcctccgtggatctgctctggcatgtcgagctccccgcgctctgtgtggtctgccttacgtgtccatgctgatcagagtcctcgcacggcgggtgggctcgatggggcggccagcctgagtggttgcgattctggcgatttctacgattctggcgatttctacgattcttgcgattcttgcgattcttgcgattcttgcgatttctgctacagtgttgtcgtggtgtcaaccaaccaagtcggcaacgaagcctcgaccactctcatgcaccccaggccgggcgaagacgtcgtcctgccccccacggacctcggcccgctcgtccacctggctcggttcctggaagctcacaccgaaccagcgatgctccgtggtccagacggcgagaacatcccactaccacctgaggtctacacggtcttgcgccaggtggtcgaggtcatgcgacagggtaaggctgccctcatcgccccccaaggactactcctcaccacacaggaagcagcggatttcctcggcatcagtcggcctaccctcgtccgactcctagaggaaggggccataccgttcgagaagccgaaccgtcaccgccgcatccgcctcgaacacctcgtcgacttccagcatcgtcgctcgacagatcgtcgcgcggtcctcgaccaactcacggagcaagccagcgagctggggctctacgaggagacggaggccacctacgccaaggcgctgagggaggctcgtcggagcctggccaggaagaagatcgcggactgacgtcgtggctcgctacgcggtggtcttggacgcgtgcgtcctcgtgccggttacgctcgccgacactctccttcggctcgcagagctcgggctctatcggccactctggtccaagcggatcctcgcggaggccaccaaggccaccgtcgaggtccaccccaacatccctcgggaggtcctcgagcagcggttccgcgagatcgagcgcgcattcgaggatgcttgcgtccggggctggcatccgctcgagcacggcttgaccctccccgacccggacgaccgccacgtcgtcgcagctgcgcttgccggcggagcagacgccatcgtcacgaggaacctccgcgactacccgaggggcgccctcgccgatctcacgatcgaagtcactcaccccgatgacttcctcctcgaccaactcgacctcgcgccgaaggcagtacttgacgccatcgagcagcaggctgccaacacgcggcagccctcgctcacgccacgcgatgtcatcgcccgactggcccgctgcggtgtgcccaccttcgccgacaagatcggccgaatgatctgaccgaccggcacccgaaaccgagtccaccttcactgtcgaaccgacattctcacacgaccgctcactggtcccgctccgcttccgtgacgcagagcgcgccggacttctgacacctggtcaataccgcgcaagtccgtcgccgtccgcgacgtcatgctgattcagacaaaccagctcgagccacctcggacgtgaggcctcagtcgaatgagtgctcgagccgggctgcgcctcacgcggcacgcgggtcgtactgtgagccattggtcactcacgcaccgtcgagcgctcatgtctggcgcgacgagccctcgtgcgcgcccgcatcgctttgcaacggacctgcctaggagcgtcccgagcgagatccacgtggtcgtcgatcagcgccgacggatcgtcactcgccgctgcaagccgaacgatgggcaatccgagccgttcgaggcgtcttcgccgctcacgacaagccatccgctcacgccccggagacgtgctctctggtgagtcggcccctaggtgcaaccgaagcccaccacgcgcatgacagccgccaactcccggcgggaggcttcgagtccgtcaggccgtctcgagagcattgccgatacactggcgcggaccagtcggcgcaccgttaacccggccacccgcggcgacggacgacacgatcgccagcaggctcgtaccggtcaatcgagcgcacacgccactcgacctctcccagcggcccctctcaacaccgcgacgacagcgacgaaggccagcaatcgctcccctcccagcacgacgggagctaccagcgacgacgaccccacaacgacgagcgcccgagccgcggcaggatgcgaaacgccatccaccccatccaggcgaacgcaacgaccatgaggagcatcggtcgcaccatccatggtgccgttccaatgaacagcacggcggcatacaccaggagcaccgtcctgagaacgtgcgtccgatggcgacgctgcacccgtacgggagcttccgcagccacggggagcgtgcccggagccgtaacggggggaaggaacgggagcgcgtgcggaacgtcggtcacgagtgcgccgagatcacggtaggtccgcgcgacgtggagatgctcgagtcgctcttcgaactccatgggatcgagccggccctcttgaaacgctgagcgcagcacctcttcgaccgcatcgcggtctgcttgcgaacaccgcacctcgtcgaagtcgctcacgcagccatcgtatcacgaccgctcgtcacgcgtacgagagcccgaaccgaggatctcacggcgacctcacgagacgggccacccgtcacaggcgaggccgcggggcgcaggtagcgtggtgccgtgcgctcgttcgtccacctccacactcacaccgagtactccatgctcgacggcgcgtcgcgcatcaacgatctcctgcgtgccgcagccgccgacggccagcccgccctcgcgatcaccgaccacggcaacctctacggtgcgctcgagttctacaaggccgccacacgcaccggcgtgcgccccatcatcggcctcgaggcctacatggcggggggctcccggttcgagcgcccgcaacgtcgcggacgcctcgacgacacgggcggcgagagcgagcgaggtgagaagctctactaccacctcacgctgctcgcggagaacgagaccggttaccacaacctcatccagctctcctcgcgtgcgttcctcgagggctactactacaagccccgcatcgacttcgagctcctcgaggagcaccgcgagggactcatcgcgctcaccgggtgtctcggtgggctcgtcctccagcacctccttcgcggcgacgaggagggagcgcgcacggtcgccggaacgctgcgcgagatcctcggcccggacaacgtcttcgtcgagctccaagatcacgggctggccgaacagcgccgaaccaacccccaactcctcgagctcgccaagcacctcgggctgcggaccgtggccaccaacgactcccactacacgcaccgcgaggaccacgagacccacgatgcgctgctgtgcgtccagaccggcgcgaccatcaacgaccagaatcgcttccgcttcgagggatcggagcactacctcaagagcgccgaggagatgcgtgagcgcttccgcgaggtgcccgaggcctgtgacgcgaccctcgacatcgccgagcgctgctcgttggagctgacctttggccagccggcgcttcccgagatcgacatcccggtccggatcacgggtgcgacctacgacgagcgcgcaggtgagtacctcgccgagctggtctggcagggcgcgcgggcgcgctacggcaacgatctcgacgagaccacgagcgagcggattcgctacgagctctccgtgatcgagtccatgggctttccgggctacttcctcgtggtctgggacctgatccgtcatgcccgcgaggctcacattcgcgtcggcccgggacgaggtagcgcggcgggcagcgtggtcgcttactgcctcgggatcacccagatcgatccgctcgcctacgacctcatcttcgagcgcttcctcaacccaggccgcaagcagatgcccgacatcgacatggacttcgacgagcgctaccgaggcgagatgatccgctacgcggccgagcgctacgggcatgatcacgtcgcccagatcgtgacgttctccaccatcaaggctcgagctgccgtacgcgacgccgcacgggtccttggctacccgtacgccgtcggcgacaagatcgccaaggcgatgccgccgctcgtcatgggacgagacacgccgcttgctgcctgcctcgagctcacgcccggccacgaggacggctacgctcaagcggcggcccttcgcgagatggtcgagagcgatccggacgtggcgcgggtcgtccaggtcgccaagggcctcgaaggcctgcggcgtcaggacggcatccatgcagccgcggtggtgatctcgcgtgacccgctgacggagtacctgcccatccaacgcaagcccgatccaggccaggatccatccgaggcacccatcgtcacgcagttcgagatgcatggcgtggaggaactcggcctcctgaagatggatttcctcgggctgaggaccctctcggtcatcgatcgcgccgtggagctgatccgggcgacgcggggcgtcgacctcgacatcgacgccatcgccctcgacgacgaggccaccttcgcgatgctgcgcgcgggtgacgccatcggtgtcttccagctcgaaggcgggccgatgcgccagctcatgcgccagctcgccccgagccgcttcgaggacgtggccgcgctcgtggccctctaccgtcccggcccgatggcggccaacatgcacgtcgactatgccgaccgcaagaacggccgcaagccggtgagctacctgcacccagacctcgagccggtgctccgcgacacctacggcctcatgatctaccaagagtcgatgatgcgcgtcgctcagcagatcgcgggctactccctcgaggaagccgacaacttgcgcaaggcctgcggcaagaagatccggaccctcatcgccgccgaacgcgagaagttcatcgccggttgcgtcgcgagcggctacggacccgaacttggtaccgcactcttcgacatcatcgagccctttgcggactacgccttcaacaagagccacgccttcggctacgggctcgtcagctatcagacggcctacctgaaggccaacttccccgtccagttcctcgcggccatcttgacgagtgtgcgcgacgacaaggacaagttggccgtctacctcgccgacgccgcagcccaccacatcgcggtcctcgtgcccgacgtcaacgcctccgacgtcgacttcagcgtcacgagcggtcctgagggcgagcagatccgtttcggccttgctgccgtgcgcaacgtcggggagggcctcgtgcgctcgatcatcgacgagcgcacgcgaagcggtccgttcacgagctttgccgacttcttgctgcgggtcgatgcgagcgtcctgaaccgccgcaccttagagtcgctcatcaaggccggggccttcgactcgttcggacacccacggcgggccctctacgaagcgctcgagggcgcgctcgaacgggtcaacgagcggcgccgccagcgcgaccgaggcctcgggtccctcttcgaagagccctccgaggacgagagcgtcgtcccggatctgcgcctcgacatcggttcggtggagtggagcacgccagagctcctcgccttcgagcgcgacatgctcgggctctacgtctccgcgcacccgatgcacggcgtcaacgtcgaccggctcggacgggacgtcacccccatcttggatctcatcgaggccgatacgcctcccggcgaaccggtgacggtcgtcggggcgatcacagcgctcgcgcaacggacgacgcgcaagggcgacctcatggccaccttgcggctcgaagacctgcaagctgggatcgaggtcatggtgttcccgaagaccatggcagatcacgggctgcacctgaagcaggatgccatcgtcgcgatcaccggccgtatcgacggccgcgaagacggccgcacgctggtcgcgctcgccatcgagcccgtcgatacggccgcgctcaccagtgacgacgcggcggacggcgccactgacgcggtggtgctgcgactgcccaagcgcctcgccgtcccagattcgctcgttcgactgcgtaacgtgctcgcggatcacgtcggcacggcgcgtgcggtcctcgacatcgaaggcatgcgcttcgagctcgccagcaccagcgtccgccccggatcgagcctggtggggcacctgcgcaacgtgttcggagatcaggtccgtgtcgactgacggcccacgcatcgccctggtgggatcgggcgagtacctcccggcgatggcgcccctcgaagcgtcgctcatcggtcggggtcgcaactacgtccagattccgctcgcggctggccaagagagcgatgaacgcttcgcctactgggtcgacctcggacgtgagcaggccgcgcgcctcggcgtcacggcgcacacggtcctcgcacgctcccgagccgacgccgacgaccctcgctgggcacgtctcgtcgccggtgccgatctcgtctacctctcggggggcaacccattccacctcgccagcagccttcgcggaagccggttgtggtcggcgatcgtcgacgcgctcggtcgcggtgtggcgctggcgggctgctcagccggggcgatggtgctcggcggcctcatcggatcgctgcgctcacccacgcagcacgccgagcccgggctcggtgtgctgccggggaccagcattctgccccacttcgatcgagctcggcattggatgccgaccgagctgggggccgtcgccggcgccgaacgaacgatcggcatcgacgaactcaccgcgctcgtcggcgagggcacgacgtttcgtccctggggaaccgggcgctgctgggtcgtcgaggggacctcgacgacaccgatctccgacgccatcgacctgcccgtcgtcatccccgccacgtagccgcggacgaatcgctcagtggtggaaggactcccgcacggtcggatgcactggcggcggggtcccgtggcgctcgagcacctcgacacactcggcgaggtcatcgaggaacagcgttgccatgtccgcggagaactcgctgcgcaccacggcgcgcatcaccgtgacgtcgctcatcgcatcaggcatgggataggccggcacctgccacccataagcgcgcagctcgtgtgagaggtgattgaggtcccacggtcgcacctcacctggccgcagacgccacgccacgacagggatgtcacgcccgtcgccgatcacctcgaacggtccgagcgatgccagctcgtcggcgatcatgcgagcgactcgttgggcactcgcgtgcacggcggtgaagccctcgcggcccagtcgcaagaaggtgtagtactgcaggagcacctgcgcccccgggcgagagaagttcagcgccagcgtcggcatgtcaccgccgagataggcgacacgaaagatcagctcttcgggaacgtccgtcgcttggcgccatacgacccagccgagtccgggatagacgagcccgaacttgtggcccgatgcgttgatcgagacgactcgcggtaggcggaagtcccagtcgagctgtggctcgaggaacggcgcgacaaacccgcccgaggcgccgtcgacgtggatcgggatgtcgagacccgtacgctcgtagagctcgtcgagggcacgcgcgatctcggcgaccggctcgtagacccccgtgtacgtcacgccaaggatcggcacgacaccgatcgtgcgctcgtccaccgccgcgagtaccccgtcggcgtccagcgtcgggtgctcgggcgtgaccggaacgtaacgaggctcgacctcgaagtagttagcgaacttctcccacaccacctgcacggcggagctcacgacgatgttcggccgatccgtcggcgcccccgtggcgcgacgggcgatctgccaacgccgcttgagcgcgaggcctgcgagcatgcacgcctctgacgaacccgtggtggagacaccgatcgtggtgtcgggatcgggcgcatgccacagatcggcgagcatccgaacacagcgaccctcgatcgctgccgtctgcgggtactcgtccttgtcgatcatgttcttgtcgaccgcctcggcatagagacgatcggcttgcggctccatccacgtggtcacgaaggtcgcaaggttgaggcgcgcgttgccatccatcgcgatctcgtcgtgaatcacctggtaagcgaggtcgggaccgagaccatcgctccgcagccgtgcacgtggtacaccctcggtgagctcgcggacgaagagcggattgatcgggaggtccttcgagaacgtgtgtcgccgtggtgacgagtgccgtcgagccaacctgatcatctccttcggtcatccagcaggcaccgcccggtgctcccgatcacgtgacgtgagaggcgcgagcaacgctggaacccgctgcgaccctagcaagcccgtccggtgccggtcggtcagtgcgtggtcgatggcaggccggaccttcagcatgcgagcgctgcgccctctgcgcgatcgcggcccgcagccacggacggcaccgtgcgagcggccctgtgagcgcggcgcgagtcacgcaccggcgaacatggccgggagccgtcgtcgcgcggcgtgcgagcagcgtggcgagagttcaccgacgacaagccaccgctcacgcctcgtgatcgccgcggcggccatggacgtccgtgacgtcaccgacgtctcatgctcccctcgccagttcggcctggatccgggcaaggacctcggggtcctcgaggccggtgacatcaccggtcgccttgccatcgacgaccagttcggcgagcaggcggcgcacgatcttgcccgatcgagtccgcggcatcgtcgacaggacgtacaccgcgccagggcgcgcgatcggaccgatctcgcgctcgagcgccgcagcacacgtggcctcgtcgacaccggtggcgccggcggcaaccgtcacgaaggcgacggggacctggcccttcagtgcgtcactgaccccgacgactgccgcctcggccacacccggtacgaggaggagcgcactctccatctccatcgtcgagagtcggtgtcccgcgacgttgatgacaccatcgacgcggccgacgacccagacgtggtcatcgtgatcgaggagggcggcgtcggcggtgtcgtagcgttccgcaccgaagcgcgtgaagtactgcgcccgatagcgcgccggatccccccagatcgaccgcgccagcgtcgggaacggcgccgtgagcagcaggtagccgactcggtctcgacccaccgttgcgccttcatcgtcgacgacgtcgaaccgatgaccagggagcgccatcccgcacgacccgggcttggcgggcgtgatgcccacggcactcgaggtccacgccgaaccggtctcggattgtccgtaggtgttgttgatctccacagtgcccgtgccaacgtgctcacgcacccagtgccaggtcgtcgcgtcgagcggctcgccgacgagcgagatcagacgcagcgacgagagatcgtggcgctctgcccagctcgcgcccgctctcgcgagcatgcgcaagaacgtcggggcggtgaagaccttcgtgacgcggtagcgctcgatgatgtcgtaggcgcgatcgggctccggatagtccagcgcaccttcgtaggccagcatcgtcgccccggcggcgaggccaccgacgagctcgaagatcgggaaggtcagccatccggtgtctgcggtgcaccagtacacgtcctccggcccgaggtcgagcgcccactggacgttgtggtaggtcccgatgagaaagcccacgcctgcgtgcacgagccccttgggtttggccgtcgtgcccgaggtgtaaatgatgaagcccggctcgttcgcctcgaccggcaccggctccgctccgtccggatgcgcggcgatgagttcgtcccatgcgtgatcgcgccccggttgcatcgggacctcaccgtcgccgagccgacgcacgacgatgacgttgcgcaccgacggcaaccgatccaggatgccgtccaaggtctccttcaatgggatacgccgcccccggcggtaggtgccgtctgcggtgatcaccaccttggccccggtatcgacgatgcgatcgaacagcgcttgcgccgagaagccagagaagatgatgttgtagatggcgccgatccggtagcacgcgtggaccgcggcgaacgtctcgagcaggttcggcaggaagatcgcgacgacgtcgcccttcgtcacgccgagatcagtgagcgcggccgccatgcgtgcggtctcggaggcgagctcctggtacgtccagctgcgctcggcgccatcctccccgatccaccgaatcgccacgcgctctggctcgcgcctcgcatggcgatcgatgcagttcacgctcacgttcatacgagccccggcaaagaaccgaaatccatcggcaaggctgccctcgagggcgggggcttcgtcgaacccatcgatccactcgaacgtggctgcaaccgaacgccagtagcccccgagatcctcgatcgagcgttcgtagagcgctcggaactcgtcgacgttcgagaccggcagtcgaccagacggtgacagggacggctccaccagttcggcggttcgcaccatcgggggtagctctggcattggctcgctcatgggcagcacctccctcgctccacgctgggcggatgttaccacggcacggcacgcgcggcgaggacccggggcgcgacgcgccgtgcgaggcaggcggccgcggcgaccgctcgtggctcgctggtcgcgaggaactccacgccgagcgaccggtccccacgtcgtacggggatgctcgtggctgcaagcttcgccaggttcgccacgtgcactcgacccacctcggtggtgtcgtcgtccgtcacgacgacctcaccagctctcgtcctcgccccgctcgacccgacggtgctcggtgcaagcagcgcgtcgaactcgccggccacccgacgcacacgcgcgctcgccgctcggaccgcgttctcggcggctacgaatgccgccacgatgccggtcgcgacctcgcgagcggtgcgctcggtctgcgtcgttgcgatcgcctcgagcgcgcgccgtgcctcgacgagcgaccaccacggtgcgcagaacgcgtcgtcgacgtcgatgcattcgaccccgtccgcttccagcgcggaggcggcctcgtcgaggactgcgtcttcgtccgtgcgagcgcgtccgggcgtcacgcggccccagaccccgatccgcgtcggacgccactggccgagcgtgaacggggtgaggagccgtccccgcccctctgggtctcgaagcacatcgatggcccatgcagtctcggacagcgtcgcggcgacgacgccgtcgctcaggcgctcggcgtcaccgagcacccacggtcgcacgtgcacgctcgcgagtccgacgtcggctgctgccacccgcagcgacccgagggcatcggggaccaacgcgagcgggaccgcaccgagtgcgacccggctcaccgcagcgtcgaggacacgggtcgcgcaagactcgtccacgacaccgggatcctcgagagcaggaagcggccccgagcccgtcgtcgaccacacgcgaccgacaacgacggctcccagactccgggccctcgcgacgactccctcgccatctgacagacgagcatcgacgagcacggggacaccagcgagcgggcgagacggcgacggggcgacaccgtcgagcgcacgagcctcctcgagcgccgcgtcgtcgagcgacacagcgatggggtcggggcgttgctcgagggagcgaagctgcgcgcgagaggcaacgacgacctcgctcgcgcagcgacgtcggtggacgaggtcgtcgaggacctcgaagagcacgtgctcgacctatgcgccctgaatcggcgggaggctgccgtcagcaaggccctcggccatcgcccagccgaaggcgatgagcacgtcggcgtcaccctctttgcagcaggtgaacacctcatcgaaacccgtcggcgtcgcgtccgagagacggtagaccacgaaaccgaccggccgctctccgctcaccgcacccgaggtgcggtcgtcaaggccagaatcgagcccaaagcgcttggcgagccgtcgcgaccaggctcgctcctctcctgtcggacgatgcccgggtcgcggaaccacgtcctcaagaccagcaagcaggtcgtagccggtcggggagccgagcttggccgcgacgagcacatcctcgtcagggaacgcgagcagcgcgcgctcgtaggcctcgtggagcagactggccaaggtgaggggctcgtgctccttcggcgtcgtgaccgccagctcgatgagcacgcagggcgtgccgccgatacgttcgagggtgaagagcatcccgccaacgagctgctcatcatcggcggcgagggcacagagcacccacgcttctcgctcggcctccaagaactcaggggtcaaggtcacgccgtgcgctgctgccagcgcaccgagcgcgtgcagctcctcgtccgtcagtgcggtgcaatccttcgtgatcgtctcgatcgccatggcgctcctgctccctcgagtcgacggcccctccagtttacccgccctggcgtcgcggcgagggcgatgccacccgcgccgtaggctgggatcgtggacgactcgatcacgctgcaggcactgggttcatcgcggcagacgtatgcctacgacgaccctgacccatctgtgctcgagaccttcccgacgccacagccctccggcgggctcgtcatccggctcttcgccctcgagttcacgagcctgtgtccggtgaccggccagcccgactatggccagctcgacatcgtctacgtgccggggcctcgttgcgtcgagtcgaagagcctcaagctctacctcatgcgctttcggaaccacggagccttccatgaggcctgcgtcgcgcaggtcgcgcaggatcttgcctccgtcctcgctcctcgctatcttcgggtaatcggccgcttcaacgcgcgcggaggcatcgcgatctggccgctccgtgaggtcgtcgccgaccacgaggacccggctgccctccgagcgctcgtcgatctggacaacggagcgcgtccatgagaggcatcgatcgatcgcgtctcgcactcgccatcgcgggtgcggcggtctacgtgggatccatcgtcctcgccaactggatgctgctccacgtcggcgctccgggcccgggggcacgtgtgctccccgtgggcttcgggctcgaggccccgagtggggtctacgtcgcagcactcgccttcatcgcgcgcgatctcgtccagcgctacgcgggtccgagggtcgccgtcgcggccatcgtcatcggagcggcgctctcagcgctcgtctccacggcgacgctcgcgttcgcatcgggcgcgacgttcctcttgtccgagtcgaccgacttcctgctcttccaaccgctccaacgtcgcacgctccccggcgcggtgttcaccgctggactcgcagcgatcgtggtggactcggtggtgttcctcacgctcgcaggcattccgctccacgctgcgcttccagggcaactgctcggcaagttctggatcgtcctcgtgggcagcgccgccaccatcgggctgcgacgcgtgacccccgcaccgtcgcttcgtcctcgcgccgcgtcatgaaccacctcgaccaccgtcagcgaacgctcggcatcatcgccctcgctggtgcctcggcgatctggggcggcatgtacgtcgcgaccgccgccctcatgcgccagaccccgccactcgtcgtcctcgagctgcgcgaggcgatcgcaggtttgatcctggttccgatcgcatggcgatcagggcggttgcgcatcgctcgcggcgacctcgcccttgcggcagcgatcggcatcgtgggtttcaccgtctcgatcggcctgcagctcgaaggcacgcacatcgctggggccgcactcggttcgctcatcaccgcatcgtcgccggtgctcattgcgctcctcgggagggtctggctgcgggagcgactcccatggcccaagctcgtggcgatcctcgtcgccgtcgggggtgtggcgctcatcgccggccatccgccagggggaccccaggtcgagcccgggatcatcgacctcgcaggggcggccctcgcttgggcgatctacacggtcggatcggcgcacctgacccgccgctacgacgccctcggagtcttggcgatcgcctgcatcgtcggctccgtgacgagcctccccttcgcactggcgtcggccagccacgcagcgcatccgctcccgacgacgctcgtggcgtggctcgaagtcgcctacatctccatcgcaggaatggcgctcgccttcttcctctggaactgggggttcggtcgagtcgatgccgccgtcgggggatccatgctgctcttccagccgctcgtgggcgtcgtcctcggcatcgtactgctcgcagaaccgatcactctcaccctggtgttcggcggcttcctcgtcgtcgccggcgtctcaggagccgtggcgatcgccacaccgagagtccagcttgcgacgaacgcgtcacctgaggcaccccagtcggggattcgcacgtagccgtcaccccgtcaggccccgaccacatgctcgaccgagttcgcgacgctcgcgagaccacgccggagcgggtacggccctggctcggagcacatcgtccttgtcagcgagatcggagccatctcgcacgagcaggacggaacctacggcagccccaggatgacccacgagatgcgactcgtggcggctgcttcttcaaccaccagtgcccgtgaccggccctgcgaccgagtccaccctgaaggcgagacttgacgccctcccgccacggctcggtcacggcgggcgccgatgaccgagagcgcgtcgagcctccgactcccggacgcgaggatccgtcgctgggtggcggcgtcggggtggcagcgcgtggccgagctgaggcaggcgacagatccgtgggctcgcgtcgtgttggcgcgatgccgttcgtgtgcgacgagcgcccggggctcctgcacggcggcggacggtccccgtcgagcacctcctctcggacctgggcgttcagcggcttgcctcgcagaggccgcgctgccacggcgatgcggcatcggggagccacggagtcaccccgagttccgctgctcagtgagcgagcacgcccgcgacggacaggcgcaaggtggagagcgggtcggagtggccaggtcggacggccatgttatccgtgacgaagcggaccgtgacgcccttgtcattgagctgggggacgagggctcgcaggtcgtcgaggttgcgcgccgaacgatccagcgagtggacgacgacctcgtcgccctcgcggaggtaggcgatgaggtcgcgcagggccgggcggtcgacccgagcgccggagacgtggtccacgaagacacggtcggtgtggacgccgaccagctggcgctcgaccgaccgatcaaccgaactcacatgaacgtagccgacgacccgccctgaggcctcgctcacgagagcgcgcctaccctcagcgtgagccaggagacgagtgccacggtcgggagtggacggtcgcggcgacgaaggctcgcaggtggtgggccaacgtctcacggtcgatggctccctcggcgaccttccagacgaggtcctcgagctcgttgtcggacgccagcagcacgtggccgttgagccggacaaacagctccgtcgtcacgaccgcacagcgcttgttgccgttggggagtgggtggttggcgaccaggcgctcaagcagcaccgcggccttggtaggcacggtcgggtaggcctccacgcccccgaggccggctcgaggcgctgcgagcgctgagtcagcgagttgacctgccgggccagcgaggatcgaccttaccgtggcctcgtcgaggccgagcgtggcctgcacgacgacggcgtagtcggcgaggtcgaggtagcggaccgtcacatcgtggcgaggcgctcgaggagccccttgcgctcctcgatgatgcctcgtagcatcgccaagtacccggggtcggcgcggcgctcgcgcgcacgagcgatgacgtcgtcgatggtctcgacgggcctgggtgcagcctcgacacagcgggtgaggtcctagctggccatgatcgaacacaccccctccctgcgccgacgtccgccaactcatcgagccgatgtcagcacaccgtagcagaacgagctggggggcgtcggcggctgctgtcgcctttggtctacaacatcgccgcgacagctgtcgccacaggaggagtgaatcccacggcgacaggatcccgtggggagcgcgagatcgcggccggtacaccctgaggcgacgtcggtggaagctcattgctgggggcgaccatgtcgtcgacgagtttgcataccttggtcgagcgctcgaggcggtagtcaagttccgaccacgcctcgccaagttcctcggcgcgtcggccctggtagctcttgatgaagcgcccgacgcgggcgtcgaactggatgcgatcgccaggctggagctcgaggcgcgcgagcgacgcgccgtacgtgaaccagaggtggtccgtgactacctctcccgtcgtgacgagacggacatcgaggagcagaatcgagcgctctggccccatccagccaggtttggagtcgaagagccctacgtcgcctcaaagcgtgatcgttgtccgacgtgtcgtgccagtcgttccctcgtgtccgtcccattagggcgggcctggcctatatctccccgggcaagaccgatgcgctcgctgcgcggccgtcctcagggatttccatctgcgtccagggctcgtcacgcacactctcgcgagccacgaggtcaaagagggcgtaggcaagggcgcagagcgcgtagcgggcgatcgtgcaagcgtcacgtgtggagcgtggcggcacgacgatctctgccgcgttgtcatcaagcacgccaacggtgatcgcgtcgtcgtccggtcgctcggcaatcctcgtcgtgacgaggcgctgggtccactcaccgaacacgcgacatgcgatgcccgcctcgtcgcagagggcctcgatcgtccgcgcaccgtcgagatcgatgtgctcgacgtagcgaggcgccggccagaacgaggtggccttcttgcgctccgagttcgacgagtgcggcaagagccgctcagcggtagaccgcgcgctgcgcgccctcgtcgacgaggaggtgctcgtgcgcggcggctggggcatctacgtgcgcgcgaggcgcgtcgggcatcgctgctcgcgccgaccggcacgatcggggcatctacgtgcgcgcgaggcgcgtcgagtacttcggcaggaccggcatcggcacggcggtgatcttcgatcgccggtaccccgaggtgctcgccaagctcggtgtcacttgggaggccgacagcgcacgcaaggcgtacaacgaggggcgcaccacccaggtcccggcctggaccgcggtcaacgtcggccgccagcgcatcaccaggcggatcgcgttcgggaagcgagtgttgcagtatgagcggaccacggggactcgacgacggaacgtggcgagcgctcgaggaggcgcgagcgaacggtcttcttccgctacttcctgagttcttcgagcagaactcgcccgtctgaacaggaccatcgacttccgggtggtgctgccggacgacctgcccggcaccaaccactgccgcagctacacggtgtgctggaatacggcctgctcgagccgacggaggcgctcggcgacgctcagctcgccccctccctcctcggtgcggagccgatcgagtgcccagatgcggagcagcgtggagactggtaggtgctcctgagcggcggcccgttggagccgggcatgctcgtcagcggacaaccgtaccgacaccacggttgggcgagtgaggttgggccgtgcgaccgtgatgtccgtgggcatcgtgtcggcgaggtcgtgctgctccgccgctgccccctcttcagccaggatttcctcgatcttgctgctcatcggtcctcctccgcgtagatccgtcgatctcgtgggcctgcgacccaggcgttggcgccccaccactccccggcaggccgctccgtctcgtcgacgtcggcggcgaccaggatcacaacgaggacatctcgagcgctcggcgagtagccgatcactcgtaccgatcgaccgctccggctcgcagggtccggcgtgagccagaccgcatggtcctcgttgatcgcttcgtcagcccagcctggttcgatgccgtggcgtgagcggatgtaggcggctcgcttctgccagtccactcgcaccacacctacatagtactacactcgactacgcttggtggctcggcgccgaccgtgagaggacggttgtgaggttcgcggcagcagtagcacccgctcccagggagcggctcggaggtcgtcacggcgcagctaccactcgtagagtggcgtcccaccaggtggtgtaatttccgggcggcctgaactccaggagggcgggccaccgggcgatctctggcttgtcggtcaagagctcgccagaggaggtacgcgagtggccctgactctttccgacttcacccacgtgctctggcgccatcagagcaggcggcgacatcgacgtcatccgagagggggttcagctcgttctccaagccctcatcgagcgagaggctcgagcggtcattggagctggccgcgacgaacgaggcgagggacgccagacgcaagcgcaacggtgagcgcgaccgtctgctcgtcaccaatgctggcgacctggagctacgcatccgcaaagctccgtcgggggagcgtgtcccgagcatcggcgagcgccgccgcctgcgtcgatcgcgtcctcgacgtgcgtggtcatggaggccgacgtctgagggagtcagcacccgcacggtcgacgacttggtcgcggccctcggtgggacggggatctcgacaagcgaggtctcccgcatcatcgcatccctcgacgaggagctggcaggatttcgtcgccgcaggctggaccatctctgagttctgctccctcttcgccgatgccacctacgcgaagggtcgcctcgagcaccaggtcatctcccgtgccgtggtagtcatcaccggcgtgcacaccgccggggaccgcgaggtcctcggggtcgtgcgtcggggatgggcagaccgagagcttctggaccgagtgcgagagggagctcagggatctcgggcctcggggtgtgcgcctcgtcagctccgatgccagagcgcaggctcaccaagccatcgccaggtgcttcgtcggggcgagctggcacaggtgccgagtgcagcgggcgcgacgtgctcgctcgcatcgaagaaggggagctcgggagatggacctcgcctcagatcccaacgatcgtcgctcaagccgtccccaggagcggtacgtacccgctacgaccaggtcatcgactcccttgccgcgaagctcccagcggttgtgaccatgctcgccgaggccaaggaggaggtctgcaccttcacgaacttcccggaggcccattggcgaacgatctggtccacgaacccgctctgagcgggtgaaccacgagatcaagcggcgcactaacgtcgtcggggtcttcggcaacgacgccgctctcctgcgccttgtcaccgctgtcgtgctcagccagcacgaggagtgggccgttgccgagcggcaatacctatcacaggagtccatggccgagcttgtgactgccacgagcgacgacgacacggcgggcacctccgagacgcctcggccccctagcgctcctcccgtgctgccgtcgcccgccgaggaagagcctgcagtggtaggctgagagcggccagggaacggatttacaccactcggtgggacgtgatccatcgcaccctgctgtcgcatctggtccgagatttcaccgcgatagctgtcgccacaggaggcgcagatcccacggcgacaggatcccgcggggagcacgggattgccccgccggtacgtcaggagacgaagccggtgggcgcgtcgagatggcagcttcccgggtcgggcgtgatccgggagggggcgtggggaggtcgtcgggcgaggatgcagcagtgctcgtcgctgcgcgaccagtcccgcctcgtcgaccaccacgactcggacgcacgcaggcaatggagtctcgaggagatcgaaaccgatgggcgaccgaacgcgaccgctcgacccggcctcaccgattgagcgcaccagagctgcctaggccttctccggggttgcgttcctactcatcgacgagaaaacgccacgcgagctcgcccccgcggctcagcccgattcggccagtcgccagaacacccgtcctgcgttcgtcggccggctcgaggtcgaccgccccgccgagcacgaggccattgtgctcgcccgtcatgccgagcgctcgtgcgacccgccctggaccgagcactcgacgcccgtcgtcgagctcgatgccgcgcacgaggacggcacctggcactccttcgggtgccacgacgatgttcaccaaccagtgcaccccgtagcacaggtacacgtagaggtggcccggaggaccccacatgatctggttccgcggtgtcgatcctcgccacgcatgacttcctggatcctcagcgccttcgtacgcctcgacctcgatgagtcgacctgcgccgagcggcccgacgagacgtgcaccgaggagccgcggagcgacgtcgtgtgccggaccctcgagcagctcacgcagggcgcgtgtgcctgagtgcatggaggcgctcccgacgctcgccgagccggacgcgcagctcgtcgagctgacgccgcaccgactcaagactcgccatcccgttcgcgccgcgccgctcgatcgcctcgtgagcctcgatgaggcgcaccgcctcctcgccgagctgcggatgcgccgccacgagctcggcgagcgcgacgtggcgctccagcgagtcacgcacgagccctgccgccaccgcatgcgcacgtcgaaagggcatccctcgacgtaccaggtactccgcaacatcgatcgcttgcaggtaggccgatgacgccgcctgtcgcatggcgtcgaagtcgaacgtcatcgtcgcaagcagcccctgcatcgccgacagctcgaggcggaactggtcgaccgcgtcgaagagcggctgcttgtcctcctggagatcccggttgtaggtgagaggcaaccccttcaagacggtcaggatggtcacgaggtcgccgatgtagcgaccggccttcgcgcgcgagagttcggcgatgtccgggttcttcttctgcggcagcatcgacgagcccgtggcgtaggcgtcgtcgaggcggatgaagcgaaactcctcggtggtgaagagcacgatctcctccgcgagcctcgacaggtgcacccccgccatcgtgatcgcaaagatcccctcggcgacgaagtcccgatcgctgaccgcatcgacgctgttcgcaaacgaacgcgagaacccgagccgggccgcaacccacggtgggtcgagcggcaaggtcgaacctgccagggcaccggcaccgagcggcgagacgtccatgcgcacgagtgcgtcgagcactcgggcgatgtcgcgctcgaccgcccaggcgtgagcgagcaaccactgtgcgaccgggatcggctgagcgcgctggagatgcgtgtagcccggcatcactgcgctgcccgcactctcggcgagctcacgaagcacgtccgcaaacccgatgagccctccggcaacctctgccagtgcgtcacgggcccagagccgcagatcggtcgcgacctggtcgttgcgcgagcggccggtgtgcagcttggcgccgacgtcaccggcgagctccgtcacgcgtcgctcgatggccgtatggatgtcttcgtcggaggggaccacgacgaaggtcccctcgccgagttcggcctcgacggcccggagcgccccgagcagcgtctcgagctcatcgtcgtcgagcaagcccgcgtggtggagtccctcgacgtgtgccctcgagccctcgaggtcctcgcgccagagacgctcgtcgatcgagaggctctcggtgaacgagagcagggcatcggcgggcggcgcacccatgcggtgctgccagagcgtcacggccgcagccctccctggcgttcggcccaggtacggatcccgagcccgaagatccgtacgaagccctcggcgtcaccatggcggaaccgatcctcgctggcataggtcgccagttcgtagtcgtagagcgacgaggggctgcgacggccatccacccagaacgcgttcggcgcaaagcgcacccgcacctcaccggtgacgggcttggacgcttcgtcgatgaaggcgtcgatggcgtgcttcaggggcgagaaccacagcccatcgtagacgagggttgcccaccgcagaccgagttcgatcttggcgtgcgccacctcgcgctcgagggtgatgtcctcgagctgccggtgcgcctcgagcaacacgaccgcggctggtgcctcgtagacctcccgcgacttgataccgacccgtcgattctcgaccatgtcgatccgaccgacctgccacgatccggcgatccggttgagacggtccacgagagcggcgagcggcaggcgctcaccgtcgagcgacaccggcacaccctgctcgaaaccgatgacgacctgatcggggagcgacgcaaggccacctgcggtgtaggcccagacgtccgatggtggcgccgcccagggatcctccatctcaccgcactcgaccgcacgaccccagaggttctggtcgatggagtatgggttctccttcgactgggtgagggtgaccccgtgcgcgcgcccgtactcgatcgtgtcctcacggttcatgccccaatcacgcacgggcgcgagcaccgtgagatcgggagcgagtgcggcgagcgcaacctcgaagcggacctggtcgttccccttgccggtacagccgtgcgcgacggcgctcgcaccgtagcgccgggccacttcgacgagccgctccgagatgagcggacgcgacagcgacgagacgagggggtagcgattctcgtagcgcgcgtccgccttgatcgcacgcgcgatgtagtcgtcggcgaaggcgtcacgcgcatcgaccacctcggcggcgatcgcgccggtcgcgagggcgcgggtccgcaccgcctcgaggtcttcctgctggcccacgtccaccgagagcgcaacgacgtcgaaaccacgctcgacttggagccacttgagcgccaccgacgtgtcgagaccccccgaataggccagcactaccacttcagccacgagtcgactccttgctgttccgtcttgtcttcgtcctgtatcgagcgcgctccgtgcgacctggcgccacgaccaggtcgatcccgtcgatcgatccgagcagagccgacgcgcgcagtcacgggagccagatccgcgccgatgcccgcgtcagcctaacctctgggttcgcccgggagtccggcgaggttgtgcagcaacgcggcgacctccggggcggtcgagccctgcgacaccacgatgagcagggtgtcgtcacccgccacggtgccgagcacgccatcgggcttggcgcgatcgagggcagcggcaacgacatgcgcgcaccccggcggggtcttggcgagcacgagatccctcgcaaccgcgacctccacgagccactccgacagcacgcgacgaaggtaatcctccgacgtggtctggtcccgcgggagatccgggatggcatagacgctctgaccctgcggaccacgaaccttgatcgcgccgagctcgtcgagatctctcgatacggtcgcttgcgtggcggagatgccctcgacggcgagtaggtcgacgatctgctgctgagagctgatcgcctgctgactgatgagcttcgcgatccggtactggcgctggttcttcgcgaccatggcgatcaccaccgctcgatcgagccggagccggcacgatcgacgaggaacgccaacagtcgcaccatggccgtcacgcgatggccggcctgacgaaaggcccacgagtgcgggccgtcgaggaccgacgcctcgatctcctcgccacggtgcgccggcaaacagtgcaagatcccaacctcgtcgctcgcctcggcgaccaacgcctccgtcagggcccagccctcgaaggcgctgcgtttggccgggtcctcgcccatcgagacccacacgtccgtggagagcacatcggcaccgcgtgccgcactcgtcggcgagtcgaacagcgcaatcgccccccgcgcccgccctgcacgctcgaggtaggcatcgatctcagccatgtcggcctcggagaactgaaaccccgccggcgccgcgatgcgcacctcggctccgagcgcgccagcggccttggccagcgatcgagcgacgttgttcgcatcgccgatccacgcgatccgcacaccctcgagcgtgccgagcgcctcgtggatcgtgatcacgtcggcaatggcctgagtcggatgcgcgcgatcggtgagcaggttgacgaagggtcgctgatgcccagcgaacctgggagccatccgctcgaacgtggcgtgacgacgaagacgcgccccaaccacccgatggtgacgcgccagcacctcggcgacgtcctcggccgcctcccgcgtatcgatcccgatctcgtcgccggtgaagaacacgggcgtcgccccgagcgcagccgcagcgacgccgagcgccgagcgagtgcgcatgctcggatgctcgaagacccctgcgatggtgccgcctcgaagcggcccgctcgctgcgaccgcctcggtgacgaggcgccgcatgtcctcgggagcaaggtcgtctacgtccccgaccacgagcgacgtcgcgcgctccatgttcagacctcctccaggacacgggccagggcacgaccgaggcgggcaaacccctccgcaagctcgtcggccgtgatgatgagcggcggcagcagccgcaaccgcgtcggaccggtggcgttcaccacgacgccctctgcgagcgccacgtcgacgacgcgcgctgcgaccggagcggcgagttcgaggcccaacatcaggccagagccctcgacgagccgtaccccaggcagcgcccccgccaacgcgacggcctcgtcacctcgcgcgcgagcaagcgcgggcgcgtcaaggcgaaccagctcgttcgccaccgcctcgacgaccgccatcgcgagggcattaccgccgaaagtagagccgtggtctcccgggcgtagcgcctcggcgaccggcgcacgggccacgaccgccccgaccgggtacccgttgccgagtgccttggccagcgtgatcacatcgggctcgagcccgaccacctccgaaccgagccacgcacccgtacggccgaggcccgtctggacctcgtccacgacgacgagcgcgccggagacccgccgtgcccgctcgatcgccgcgatcgccgccgctggcagcggatggacgccggcctctcccgcgatcggctcgacgaccacggctgccgtcgcctcgtcggcgacctgcgcctcgagcgcagccgtgtcgtgcggatccacgtgcacgacgtcgggcaccagcggctcgaacggcgcttgcttgtcgggctgacctgtcagcgagagcgagccgaaggtacgcccgtggaacgcgccggtcatcgcgaccacgcgggtcctcggagcgcgcgcacgccggacgagcttgaacgccccctcgaccgcctcggtccccgagttggcgaagaacaccgacgcgtccccgagcgaggcgagcggcgtctggagcgcggcgagcgcgcgctcgcgcgcgtcagtgtcgaagtagttcgacgcgtgccacagacgcgcagcttgggccccgagggcctcgacgagacgcgggttcgcgtgaccgagcgacaccacggcgatgccggcaagcaggtccacgtagcgctggccgtcggcgtcgatgagccaggagccctcgccacggacgaaccgccgcttgggctgcccgtagacgccgatgagcccgagcctcgtcatgacgcgctccgacggatcatggttccgacccccgcatccgacaacaactcgacgagaagcgcgtggcgttcacgaccgtcgacgaagtgcacctcgtcgaccccggcctcgagcgcggcccgtgcggcagcaagcttggggaccatgccgccccgtacgctgcccgagctgagccaatcctcgagctcgccgagggtgagttcggagacgacgctcgccggatcgtctgggtcggcaagcaggcccgggacgttcgacaagaacacgagcttcgtcgccgagagcgccggcgcgagggcggcagcgaactgatcggcgttgacgttgagttcacggccctcgtcgtcggcggcgagcgacgccacgatcggaatcatgccgtgtgcaaccagcgcctccacgaggtcggcacgcacctcgaccacctcgcccacccgaccgagcgacggatcgacgacacgcgcacgtgcgagcccaccgtcgacgcccgagaggcccacccctctcggcgctccggagacctggttcacggcgcgcacgatggtggggttgacggcaccgagcaggccgagcctcaccacctccagcatcgcgtcgtcggtgaccctgaggccgccgcgacgctcactcgacaccttgagtcggcgcgcgagatcatcgatctgcggacccccgccatgcacgaggaccgggtggatcccaacgtgagcgaggagcacgagatcggtagcgagcgaggcgagcgaccccgcctcgtcgccgagcacgttgccaccgtacttgatcacgaccgtgtgacccgcgaagcgctggatgtagggcagagcctcgacgaggatcggggcgcggagacgaggatcgaggtcgatcacgaggtcctccggttctcttcgaggtaaccgtgaccgatgtcgctggtcaagacggtggcgctcgccgatccacgcccgagtgcgacggcgaggtcgacctccggttgggccatccgccgcgtgagctcctcgtgctcgttcgcactccagccgcctcgggcctcgaggccaccctcggccacgagcatcccctggtaccagatgcgcacaccgctcggatcgacgccgcgtcgcgcggcccccacctcggccaggacacggccccagtagggatccccgccgagcaacgacgccttcacgaggagcgagtttgcgatctgtcgcgcgatcaggagcgcttcgtcctcgtcgcgtgcctcgagcacgcgcaccaccccgacgcgcgacccaccctcggcgtccgcaacgatctggtgcgcgagctgcgcacagacctcgcggacggcctcttcgaactcctcgccaggcgagcgtccccgaccagaggcgagtgcgacgaccgtgtcgttggtcgagctgcatccgtcgatcgtgatccgattgaaggtcgtctcgaccgccgcgcgcagcgcagcgtcgagacgctccgcctcgaccgccgcgtccgtagtgatgacggccagcatcgtcgccatctgaggcgcgatcatcgccgcacccttggccaagcccccgacgcgaaaaccatccccctcgacgagcgcggtcttcggatgggtgtcggtggtcatgatggctcgagccgcggtctcggcgctccgctcgtccactccgaccgacgcagtgagggccccgaagcccgcgagcgccgcgtcgatggggaacgagatcccgatgaggccggtctgagcgatgagatagtcctcggcccggcctccgaaggcgtgggctgcagcctcgaggaggcgccgagcggctgctcgtcccgcttccccggtggcagcgttcgcgttgcccgaggtcagcacgacgccacgaacgcggcggcccgagccagcgaggtgcgctctcgacacctcgatgggtgcggctggcgagtcagtcgtcgcgaacaccgccgccgcgacgaccggctcaccgtcggccgatccgacgaaggccgcgtccaacgcgccgcccgccttgatgccgatccacgctccacctgcacgaaagcctgccggcgcggtcacgctcacggccacacccccaatccctcgagcccgagtacttcatccacaccgaccatcaggttcgcgccctgcactgcgtgctgcgccgcgcccttgccgaggttgtcgatcacgctcgtcgcgacgatcacgccgacctcgtcgtcgaccgtggcggccagcacggctcgattggacccccgcacctcacgcgtcgacggaggcgtctctcgcacctcgacgaagggcgaggttccataggcccgagcgaggacgtcgcgcaccgagtccgcatcgacggttgcgtcggcgaccggcagcgtgatcgtcgcggcgataccgcgtgaatagggcccgagatgcggcgtgaagcgcaccgggaccccgagcagcgagcgcatctcgggcgtgtgtcgatgccccccgagggcataggcgcgcactccctcggcaacgttgacgaaatgcgtcgtctccgtggctgcactgcccgcgccggtgacgcccgagatcgcgtccaccacgacgaggtcacgacgagcgagaccagcgtcgatcagcggcttcgcggcgagcaccgtcgcggtgacgtagcaccccggaaccgcccagacctgtgcgctcgcaagctccgtgcgcacgtgctcggcgaccccgacaacggcagacccgaggagctcgggcgcggggtggtcgtctccgtaccagcgccgccaggtcgcctcgtctgccaggcgcaggtcggcaccaagatcgaccacgcggacaccccgagcacggagttctcggatgatcccaccactgtgaccgtgtgggagtgcacagaaggcgagttcagcggcgacggcacgaggatcgatgggctcgataggccgctcggccaagtcgacactgaggccaggcacgagctcgcccaggcggcggccagcgcgctggtgggcctggaacgcgacgggctcgaagacggggtgccgcgccagcacccgaacgagctcttggccaacgaagccgcttgcgcccaccaccacgacgtccatgtcgagagtctatgtccactactgcataatcatgcgcaccctgcccgaagaatcggcgccgagctaagcttccttcgatcgagggaggcgcccgtgggtccgttcgtcgcctatgaacagttctggctgcgctacgtcgacttccgaggacgctcgagccgggccgagtattggtgggtcttcctcatcaacctcgttctcgagctgctcttcaccttgggtgcacgctccacgtcactcgtcagcgatctcggtctcctgtatgggctcgccgccatcatccccaacctcgcgctcgtcgttcgacgtctccatgactccgaccatcgcggctggtggatcttcatcgcgctcgttccgatcgtcggcgcgatcgtgttgctcgtcttcgaactcctcccgggcaccccagggccgaaccgctacggggatccgtcgacgccggttcgctctccccggttctagatcggctatatcagcatgggaacgcttcgctagaactccagctccccggctgaatggatcgttgctgagaacgaatccactcgcgtcggagctcttccccgaacgaaccgcccgacggcgggtagggtgggcactcgtgcgcggttcgtcgggcctgagcggggccacctcgcgatggctcgaacgcttcgaagtgcttgcagtgcgagccttcggcgccgacacgctcctctacggcgtctccgcagtcatcgccgggctgaacctcgtcgtcgcctccgggggcgactaccgcgcctgggcgatcgtcgcgacaccgctctatgcgatcgcagcactcgccagcctccttctcgaccggatcggcgacgtcgagcaagcgacgcggtggcgtcaccgtctcgtgctcatcctcctcgtcggcgtggtcgtcgtgccgctcggcgatgcggtggcagcgcgcgcccttgcgctacccggcatccacgcccaagccgaggtcgtcgtgatcgagcgctgcggcgaccgcgtgctccacggccacgactgctatctcacccacccgacgaccgctggcagttccgtgtcatcggcgtcgcacgcactcgacgcgaacgcgttcgtcccctacctccctgggatggccctcttcggcctcccgaacggcctccccctgccgaccgtgctccgcgacgcccgagtctggatgagcaccttcaccgtggcggtgctggccttcggcgcgtggctcgctcgactcgcgcctgcacagcggtggcgcctcctgctcctcgtcgtcgtgctccccgcaggagccctccccatggtcaccggcggcgacgatctccccgtcatcgcgctgctcgcgaccggcctgctcctcgtcgagacgaagccgcgcacggcggggatcgcgctcgggctcgccacggccttcaagctcaccgcgtggccgatcgtcgcactcctgctgctcgttcgcgatcccaccgtgaatcgtcgccgcctcatcccgccgatcgtcgccatcggtggcggcctcaacctgctcggtgccgccatcaacctgcgagcgttcatcaccaacgacatccgcttcccactcgggcttaccagtgtgcgctccccagcgcagagtcccctgcttggccaggcattggtgcagctcgcaccgagcgagcaccgcctgatcgtggtcggcctcgtcgccatcggtctcgcgggcacggcgctgctcattcgagcggcttggccgctcaccgtcgatcgggcgatcctcgtggcagccctcgtgctgctgcttgccacggtgctcgctccgcagacgcgcttcggctacctgctctatccgttcgatctcctcgccgtgctcgtgctacgtcgaaccacacgcgtgccgatcgacagcgaccagatcaatcccgacctcagacagacagcgctcgcgcgactagagcgctgacaggcagactgcgcggccacgactggaggcgcgtcgccgacgtgtcactcagtcgtcacgaatccgggccgggacgacgcccacgacgaggcagagtcgaggcgtggttcgcgttcgtccctcgactggaccagactcacgggtcgatcaaccgtacgacgagttctacgacgccgacgggtgcgttcggcccgtctacgaacaactcgctcgcaccgtcgcgagccttggcgcagacgaactcgcggtgcgcaccatcgagcgcgacatggctcacgccgatcggggcgtcacgtacgatcaccaaggggtcgaggccgtcttccccttcgatcccatcccgcgcattctcaccgagtcggcctggcgtcacatcgcagctggcgtgcgacagcgcgtacgcgccctcgaggccttcctcgacgacgtctacggcgcccagcagatcctcgccgacggcgtcatcccgagggcactcgtgctgcgctcgacacacttccgccgcgaggtccacggcctgcgacccgcgaacggcgtacgcgtccacgtcagtggtgtcgatttggtgcgcgacgccgacggcaccttcctcgtgctggaggacaacctccgcgtaccctcaggcgtctcctacgcgctcgacaaccggcgcacaacgacgacgcgtttcccagagctcctgcgcggctaccacgtggaatcgatcgacacctacccgtcgcagctcctcgccgcccttcgtgcgagcgctcccgacggggtcaacgaccccaccgtggtcctcctcacacctgggccctacaacgctgcctacttcgagcacgcgtacctcgcgaggcgcatggggatcccgttggtccaaccctccgatctcatctgcagcggcgggcgctgctatctccgatccacgcgacgctcgaacgaggtgcacgtcatctaccggcggatcgacgatgcctacctcgatcccgtcgcctttgatccgacatcgctcctcggggtcgccggcctcatcgtcgcggcgcgtgagggcaccgtcaccatcgcgaacgccgtcggcaacggcgttgccgacgacaagctcatcggcacgtgggtgccgaccatgatcgactactacctgggcgagcagccactgctgggcatggtgccgacctaccgcctcaacgatcccgacgaggtcgcctgggtcatcgccaatctcgaccgactcgtcgtcaagcccactgacggcgccggcggtaagggtgtcgtcgtcggtacgacggcgaccgacgaggaactcaccaacctcgctggagagcttcgcgcccatccctaccgcttcatcgcgcagccgatcatccctctgtcgacccaccacacgctcgatggacgcgcgctccacgtcgacctccgccccttcgcgatcaaccacggggaccacatctgggtcatgcccggaggccttacgcgcaccggtccggcaccgggagtcctcgttgtgaactcgtcccagggcgggggatcgaaggacacctgggtcctgcgtccgggcaatggtcgagtacggacgagtcgctccgtgatcggcctcgtcgaccaggtacgcgccgacatcgacacgccgaatcccgaggcgacccagtgatccgcccccgcgcggcggcctccacgtactggctcggtcgctacctcgaacgcatcgacgcaacggtacgggtactcgaggtccagatcgacgcctccgtccagcaccgaagcggtctcccgtcggctgcgctcgcgaacagcttggggatcgccatcccagagcagctcgcatctcgcgacgacctcgtccggcttcttctcaccgacccggcggtgcccggctcggtaccgttctgcgccgccatggcgctcgcagacgctcgggacgtacgcgacctgctcacgagcgagctgttcgaggcgatcaacgccaccgcacgagccatcgccaacacggctcgaaccgcgagcaccatcccgtgggcacgcgtcctcgcgaccggacgcgacgtccacagtcgcgttgcgacctgcttcggtctctgcgagatgacgctcgcacgcgacggctactgggcgctcttcggcatcggctccagcatcgagcgcgtcgagatgacggcccggatcctcggcgcgtggcgagcacacgcctccaccgaggaggattggcacaccctgctgcgctcggtcggctccctcgagatccacctgcgacgccacgggatccgcgggagcacgccccaccgtgtgctgagcgacctcgtgggcgcgctcgacaacccgcgtgcgatcgccttcggcctgaacgaggttgcgcgtcgagcgcgcctgctgccacgcagcctggtcggggcccgtgtcgccaagacggcagccgagttggcacacgagcttcaccgcacccccgagaggatcggcacccgcagcggcgaggtggctgcccttgaggcgagccgaaccctccatcacctcatcgagaccacgatcgccctgccgagccagccgccccgctggcagctcagcgatcagctcgcctccgaggtcacccgatgaggagatcccgttccaccctcgccacctggcacaccaccgaactcagctacgacacccctgccgttcggtcctattccgagctgcgcatgagccccacgacggggagcagccagcgcgtgctccgacaccgcatcgagctctcccagccagcgcaccgagtccgctaccgcgactactggggctcggtcgtcacgtacttcgacatccaacgcccacatagcgagctcacgatcgtggccagctcgaccgtgcgatgcgcgccctggagcacgggatcggtcgtgacgctcgcgacgctcgcgcggcccgagacccagcgagcactcctcgagtacctgctcccgacgcccttgacgaccattgctgagcccgcgatcgacctcgaggtgggcacggacccactggagcgggcggaggccctcgccgccatcgtccatgacacgatcacctacgctccgggaacgacgaccgtcgacaccacggccgacgaagcgtgggcccgacggtctggggtgtgtcaggacgccacgcacgtactgtgtgcgctgctgcgtcatgcaggcatccctgcgcgctacgtctcgggttgctttgctccgcatgctctcgaggtctccgaggccgccgagggcgcaagtcacgcctgggtcgaagcgtgggtgggccactggcacccgctcgatccgaccaacctcttcgcgccgtcagagcgctacatcaccgtcgcccgggggcgcgactaccgcgatgtggccccgctgcacggcatctacgaaggtccagggcgacagacgatgcgctcgagcgtacgcatccagcgcgtcagctgagacgcgctccaccgccgctccctcgacctggttgcccctgcgacgcgaccggcgggcagcctggcgatccgcacggtgagtgagcgagcggacagcatcgcatgtgtggagcctcccggagaggccgctctctgccgtgaaccagccccgaccggtcaactccgaacgatgagccccacatcggccctccgacctctggttccctggtcgatccgacgaccaacgcgcacgcatccgcgtgcaccccgtgcaaccctgagcgccagcacgcgcaggttccaggtcgcgctgggacgatcgacgtcgagccgcttacgccatcgccggcagtgcggccgtacgacatgcaccgcgggacttgcgctcgagccgcccgcagattcgctcgacaggaggcgggtggctcgcctgccatctgaggtgacggtgacgaaggtgcgcaggtgcccccggagcgagcggggacggcgtcccaccgaccggaccgtggcgagaaggccgaggctcacagagccgcgtgcacgccgacctcgtgggccagaggcggcccaggtgccgctcggcacgcgagcgggaccctggtgatcgcccggggcagccctccacgtaggaccgcgcgagcgtgtcaggtaccgaaaggtgagcccatcgctcctcgtctgtcgcgggagcggaacgtcgggctagaggacgaccgcagcgaccacgaggatcgccagcaccaccgtcgccacagcagccatccgtccgacgcctgcggtcgcaaagccgatcacggacgccacgacgccagcgaggggggtcgcgagcaggatgaccgcgccgagcagcacgatgccttccccgcggccgtgccgaagagcccgtaccagcccgccgagccccaccggaaagtgcgcacggcgcccgacgaggacgtggtagctgatcggaccgacgacgaagtgaggatggctgacgagggtcaccacgagcccggccacgaccagcacgaccgcgatgacgacgccagccccgaggacgcgtccgacgacgttcgcgacctgcgcgtccggatcctcgacgcgtcgctctcccgacgcgctcatccgatgcccttctgcaacatctcgacggcgacgaccacgagcaccgcgatgaagacccagcgcaccacggtcacgttcacccgcgtgagcaggcgagccccgagcgttgcgccaccgagcacaccgaccgcgatggggccggcgaggatggggtcgatctggcctcgcgacaggtagatcgccgcactcgccgcggctgtcatgccgatcatgaagctgctggtcgccgaggccaccttgagcggcacgcccatcaacatgtccatcgtcggaacgttcaacgcaccagagccgataccgaggagcgccgagaccacgccggcaccgaacatcagcaccagaccgaggaggctgcgctccacccgatgggcaacgaggacgccgccatcaccgatcggcgctgcgccatggagttggagggcatcggcgatgcgatcgtcgcggggctgctcgatgcgatccccactgcgtcgacgcagcatggcgacggcagagtagacgaggatggctgcgaacagcaagaagaggaaccgcgtcggcaccgcgcgcgacaggagggcaccgacgatcgcgccgagcgtggtcgcgatcgcgagatacagcgcgagacgcacgttcaccatgccgcgacggacgagccgcgacgcgccggtcgccgaggtcgccaccacggtcacgaggctcgccccgaccgccaggcggatgtcgacatggaagaccagggtgagcaccggcacgacgacgattccgccaccgagtcccaccagggacccgagcaggccagccacagcggcgatcactatcagcgcgatgatgaagacgagcggtgtgatgaccatcattgtaccctcgtgggtatcagatcacgacgccggcgccgtacgaagcgcggctccgagtgccgcacccgcgtgccgggccacctcgatcacctcgcgaaccctcgcctcactgatcggcccttcggggtcctcgagccgtaggcgcaggccgagcgagcgccgaccctcgcgaacgaacgtgtcgaacgctgccacgtcgcgcaccaccgggccgatctcctcgcgcacccgagccgcgaggcttgcggccgcgaggtcccagggcacctcgaacgagaggtcgagctcactcgccgcgaaggcgccaagggtcgaggaagccgtgaggggtcggggctcggcgagccagtccgcgtccagctcgacaacgccgtagcgccaccgtcgagcacccagcgcagcggccacatccggcgcgagctcaccgaagacaccgacgaccagcccatcatcgatcaccgccgcctggcggctcggatgcagtcggggccacccaggaccaccagggccgagctgcaccgacccaggaccaagctcgaggccggcccgagccacgagcctcgcgagccaacggcccgcctccacgccgccgtcatgggcgtgggcgacgatgagcccgagtcgctgtcgctcgttgacgacgcgtccctcctgccagaagaccggaccccactcgaagaatcgcgcgggctcgagacggcgtctgaccgcgtgatcgagcgcaccgacgaggcccgcagcgaccgtggtgcgcaacacgctctcttcggggcgcaagggattggcgatcacgggtgcgacgcgctcgctcccgagctgctcctccaccgagggcgacaccatggtcacgctccaggcttcgaaggcgccctcgtccgcgaggagcgtcgagagggcacgttcgcgctgctggcgtagcgtcgggccatcgcgtcggggaccgatgaggggcgtcggggccaccgcgtcgtagccgacctgacggagcgcctcctcgacgacgtcggcgacgtcggtgacgtcggggcgccaggtggggaccccgacctgccagccgtccccgtctggctcgaggtcgaacccgaggcgcgagagcccggcatcgggttcgaacgactcgagcaccactggatcgcccgcgatcgccaccgcgctctcagcacgcaccgcgatccgtcgcggcgtcgtggcgtacgcaacgtcggcgaccagcatcggcgtcgcgacacccacgagagcggcaacacgggcgcacaccgcgtgcgcgacggcggggtccaccccacgctcgaaccgccacgacgcctccgtccgaagacccgtggcgcgcgccgcgcgcgcgatgcgctctcgtgggaacgccgccacctccaagaggacctgctcggtctcggcgttgacctcggtctcggcaccgcccatgatgccagcgagccccaccgcgcgatcgctgccgtcgacgatgacgagttcaccaccggcgagggttcgttctcgatcatcgagggtgacgagccgctctccaggacgagcactgcgcacccccaccacgccaccagccaaacggtcgcggtcgtaggcatgcgagggctgacccgtctcgagcatcacggcgttcgtggcgtcgacgatggggctgatctgccgcatgccgctcagcacgagccaccgcgccacgcgcggctcgagcaccgcgccacgcacctcgaggctcgcgagcacgagtcgatcgacggcgccctcttccaccgtcaccgcgcggggatcctggcgcgtgagcacccccgtgacgtcgacgaagggggcgcggaagcgcgcagcgaggtcgcgcgcgacaccgcgaactccggaggcgtccggtcgattgggttccacggcgatgtcgaggacgacctcgtcacggacccccagagcctcacgcaccggcacgccgagcgggagcgacggcgagaggatcgcgaggccgctcgcgtcggagccgagacctgcctccggagccgagcagagcatcccttccgacgtcaccccacgcagacgccgggccccgatctcggcgccgttcggcaggcgcacgcctggcagcgccagcgggacgacatcgccttcgacgaagttccatgcgccgcacaccaccggacggatgcgacccgatccgtcgtccacctcgacgagtcgaatgcggtccgctccctcgatccgatggatggcgagcaccttggccgtgaccacgccgtccgccgcgaccgggtgctcttccacgccttcgacgacgagcccgagggagtcgagcgtgcccaccagcgcgcgaacaccctcgctgtgcgcacgcagtgggtccgtgaggccgagcgcctcgagcggcgtgaagacctcgagccaaccgatgggcaacctcatacttcacccctcgtgcgcaccagcagccggaggtcgttctccggcaatacccgcatgtcggccagcccgtagcgcatctgcaccagacggtcgatgccgaaaccgaacgcgaaccccgacacacggccgggatcgagcccacctgcctcgagcacgcgtgcgtgcaccatgcctgcaccgccgagctcgatccagcccgtgcccgagcaggtgcggcaccccgccccgccacagatcgtgcacgtcacctcgaactcagccgacggctccgtgaacgggaagtacgcaggacgcagtcgcgagtggattcccggtccgaagtacgccgtcgtgaaggcctcgatcgtccccttcaggtgcgagaaggtgatcccctcgtcgaccacgagcgcctcgatctgatggaaggccggcgtgtgacgtgcgtccggggtgtcgcgccgatagacgcgccccggcaccaccgcgtagatcggcaacgtgcctcgctgcatgagacggatctgcgctggcgaggtgtgcgtccgcaggagcagcggaggcgaggcgtcgacgtcgaggtagaagctgtcctgggcggcccgtgcgggatggtgctccggcacgttcagcgcctcgaagttgaaccactcgtcctcgacctctggacccgaagcgacctcgaagccgaggcgccagaagacgtcctccagcgccatgcgcgctcgcgccacgaggtgcctcgccccgggaccctcgaggggttcgacgagcaggcccacggagggatcagagcgctcgcgctcagcgcgctcgaggagctctgctgcgtcgagacgtgcctcggccgcctcgatggccgacgtgagcgaggcgcgggcctcggccacgacccggccgagtaccggccgctcctcgggatcgaggttgcgaatcgaccgtgacagcactgccagtgggctctgcggcccgagcgcagcctcacggatcgcagcgagctcgtcccgatccgcgaccgtcgcaaggcgctcgagcgctccttgcacactcgccgtcacgagagcggtgtctgcggcgccctgaccgtcgccaccctggtctcgcacgctcgcccccatagaccctcgtccttcctcaccaccgcgacctgcggccaaggctagccccgggtcgacgcacccgccccgccaccgagcgacacccagagcgcgagtgcacccgccaccgcagcgttcagcgactcgagccggggcggcacgaccaacgccgcgcgctcgtcgagctcgccgtcgaccgccgcactcaggccagcgccctcggcaccgacgacgagcacgcgccgctgtgtctcgggcgcgagcggcgacggtgcgcgcgggtcgagcccaatgacgcgcgcgccccggactcgcagctcacggagcgcaggcgtgagctcgtccacctcggcgatgggcacgcgctcgagcgccccggccgccgctcgagccgccttgggattgaacggatcggccgatcccggaccgacgagcacgcccaccgcgtccgagagcgcggccgcggtgcgcaccaaggtgccgacgttgccgggatcttgcacgccgtcgagggcaaggacgacgagacggtcctcgagcgcctcgaccggaaccgtgacccgtcgcagcaccccgacgagaccctgcggagtcgtcgtggcgctgatggcggccagctcgcgctgcgtgacgacgacgaccgaacgcgcagaggccacgaggtcggcctcgcgacggatggcctcgtcgaccccgacgagctgctccacgtgcgctcccgccgccaccgcggcacgaaggaagcgtgcgccttcgagcacgtagcgaccgtgtctgcgccgcgcggctgccgacctcacgagctcgcgcagctcggcgcgggcgtcaggacgcagcgcgctcctggttggcttcggcaagccgcaccaacgcgccgaacgcgcccgggctccgcaccgccaggtccgcgagcacgcgacgatcgaggccgacacccgcgcggcgcagaccagccatgaagcgcgaatacgtggtgccctcggcacgcgccgccgcattgatgcgctggatccacagccgacgaaactcgcccttgcgcgcccgacggtcgcgataggcgtactgcagcgagtgcatcacctgctcgtgggcggctcgatagcttcggctcttgttgccgtagtagccgcgcgcgagctcgagcaccgcacgacggtgcttgcggctgtgcaacgaccgcttgactcgtgccacttgtgtcctcctccgaagccctagcgtccgccgagctgacgcaacgcgcgacgggtgtcaccccgcgacaacacaccctcgcgatgcaggcgccgcagccgcgacgacgacttcttgccgagcaggtgggaggtgaaggcgtgccgacgcatcagcttgcccgtgcccgtgcgcttgaaccgcgccttcgcacccgtatccgtcttcatcttcggcatcgcaactcccgtctcctgccggcgtcacccgctcgcgatcggtccacacccaacgagcggcgctggtaaccacgcatccatccccgaaaccccgtctgcgacggagcgctcgagcggtcatggctgcctcgacaagctcgcgccgggtgcggcgcggcctatcagcgtagtgtgtctgtcgaccgagttgggcctcaggcgcgcgccggtgcgggtcggcgatctggtgcgagcaccatcaccatgttccggccatccagcttcggcatcacctcgacgtgagcgacgcccttgaccgcctcgacgactctcgtgaggatctcctgaccgagttccgggtggaacacctcacgaccgcggaacatgatcgtgaccttcaccttgtggccctcggcgagaaacttggccacctgtcgcgtcttcgtgtcgaagtcgccctgcgagatcttggggcggtacttcatctccttgagctgcgacgccgaggccttgcgcttctgctcacggactcgctgggcttggtcgaacttgaacttcccgtagtccatgatcttcgcgaccggtggcttggccatgggtgccacctcgacgaggtccatgtccatcgctcgggcgatttgcagtgcctccggagtcggcttgatgccgagctggttgccgtccggtccgacgaggcgcacctcgcgaactcggatctgatcattcacacgggccccgtcctcgggtgcagtggcgataggagactccttccgtcggaaaaccaccagcgtggcggccagcagccgcgcctcacgattgtagcccaacgcgacgaggcaagcctcgattccccgaaggccacggcgctagactcatggcccgtggccaccgacgaacgtccgccatccgacctcgctggcgaggtgcatggtccttcgtccagcgacggctccacggcgagcaccgcggcgccctcggatgcgcgcgccgaggaggaggccgcacgcctcagggccgagctcctcgacgccgacgttggggatctcatcgccaaccacgcctacggtctgttcgagctgacgcggatctacctcgccgccgaaccaccccggctcgctgacgctaccctcgtcatcgacgccctcgcaggtctgcttgccggcgtcgccgatcgcctgggcgagcgcggccagctgctcgaagccgcactccgccaagtgcagctggcgttcgtgcgccttcgggacctcacccacgacgagaccgcctcctgagcgcgcgtcagtcgagcttgtgcacccaggtggcctcagaggcgcctcgaaaggacggcgcgacccgaaccagcacccgctggccgacacggacctggcgcgacccgtcgtcgaccacgatgcaatgaaacggcacctcgactgacccctcgaccgcgatcgccccgaggccgacgtgggcgtcgaacgccaccaccgtcccctcgcgcacctcgtagggatcgacgacggcgcgcgctggcgcctcttccagactgccgcggacgcggcgccgagaccgacgcaccgctacctacggcacgatcttcgacagcgggatctcgaggatgtccgtcgcgcccgcgtccttgagcgacgggatcagcaggttgatgcgctctctcggcaccaccgcctcaaccgcgaacccatcgccgccgtagagctcgctcacggtcggggccttcatcgaggggagctcggcgatgatctgcgccaacgccgccgctggggcgttgagcttgacgagcaccgacccgcgtgccgccagtgcgcccaccaacaacgtgcgcacctgctccatggcgtggcgccgctcggggtcggcggccgcgacgggattggcgatgagctcggtataggacacgaggagctcgtcgatgacgcgaagtccctgggccgcgagcgctcgaccggtctcggtgatctctacgaccgcatcggcgatctcggggaccttcgcctcggtggcgccgtaggaggcgagcacgtgggccttgatgccgagcctggcgaagtagcgctcggtcaaacggggatattccgtcgcgacgcgaacgccatcggggagctgtgcgggttcggtgacggcgctctcaccggcgaccgcgagcacgacgcggatggggcgcgacgacgccttcgagtagcgcagttcgcccagcgacacgacgttcgcgccggtctcctcgacccagtctcgcccggtgatgccgagatcgaacagaccctcggcgacgtaggtcgggatctcctgtggccggaggatgcgaacctccgcgatgcgcggatcgtcgatcgtcgcgcggtaggaaacctcgctctcccgctcgatcgtgagatcggcggcgcggaacaagtcgaaggtagcccgctccagcgagccctttggcaccacgaccctcagcacgaaccgtcatcctccttgagtgcatcgatgcgtcgatagacatcggccatgcgaacggccacgagggctgcctcgtagcccttgttgccgtgcttggccccggcccgatcgaaggcctgctccaaggagtccactgtgaggagtgcattggccaccggcaccgtggcctcggccgcgagacgagccagctgggcgctcgcctgcgtcgcgacgacctcgtagtgatcggtctcgccacgaatgaccgcgccgacggcgatgatgcccgcgatcggcgtgcctgccgtcacgagtcgacgcgccgcgccagcgatctcgagcgctccgggaacccacacgacgatgggctcagccgcacctgcctcctcgagcgcccgccgagccccatccaccagcgcctcgccgaccagctcgttgaagcgcgccgcgacgatgacgaagcggtcagtgggctcggcacgtggtcggccttcgagcttcatcgttctcccctcgcgacgtcgagcaggtgccccaacttgcgcgccttggtctcgagatagcgcgcgttctcgggtcgcacctcggtgacgatcggcacgcgctcgacgatctcgaggccgaatccagtgagtccacggtacttggccggattgttcgtgagcagacgcatgcgtcgcacaccgaggtcggcgaggatctgggcaccgatgccgtactcacgcgcatcgaccggcagcccgaggcgctcgttcgcctcgaccgtatcgagcccctcgaactcctgcaagtggtacgcgcgcagcttgtgaccgagcccgatgccgcggccctcgtgcccacgcaggtagaccaccacccctcgtccttcgtccgcgatccgtgcgagggcggcgtggagctgcggaccgcaatcacaccgatacgacccgaagatatccccggtcaagcactccgaatgcacccgcacgagcaccggttccgtgtcgtcgatctcgcccaggctgagcacgagatgctcgtccccgggctcgaggacgctccggtacaccaccgcatcgaacgctccccattgggtcggaatggtcgcctccgacccctcgacgcgtgcgacgagcgtctcgcgcgccgcccggtagcgaatcaggtcggcgatggagatgagcgggacgccccaggcagcggcgaacgccgccagttcggggagccgggccatggactgacgatcctcggtcgtgatctcggcaagcatcgcggcaggccgccgaccggcgaggcgggcaagatcgacccctgcctcggtgtgtccacctcgcttgaggaccccaccctcacgcgcgcgcagcgggaacacgtgaccaggtcgcacgaagtcgctagggcgcgcgtccgggctcgcgagcagcgccacagtgcgggctcggtcctcggccgagatgccggtcgtaccgccgcgcgcagcgtccacggtgatggtgaaggcggtcttgcggggatcggtcccgtgctccaccatgagcggcagctcgagggcgtcgaggagctgcgactcggccgacacgcagatcatgcccgaggtgacgcgcaggtagaaggcgacgtcgtccggacgcaccgcgtcggcaggcatgatgaggtcaccctcgttctcacgatcctcgtcgtcgacgacgatgaccatctcgcctcggcgaaacgcctcgatggcatcctcgaccgacgagaaaggcgtcgccgctgttgtctcactcatgcatcctccgcttcgcggccaagccggaccccctggagccgcgcgacgtacttcccgatgacgtcgaactcgatgttgagcaccgcaccgacctcgcaggtcccgaggttcgtgcgacgtcgcgtctctgggatgagagcgactctggccgaggccggcgcgagctcggcgaccgtcaacgcaaccccgttcagcacgatggtgcccttctcgacgacgagcggctcgaaccgctcggggtagtgcaccacgatgccttcgtcgtcgacgtccgtcacggtcgcgacggcgtcgacgtggccgagcacgaggccgccatcgagcagcgtctggagcgtcaccgaccgctcgacgttcaccagcaccccgggctcgagcgcaccgagattggttcgccgcagggtctcgggcacgacgtcgactccgaccacctcgtcactgatctcgacggcagtgaggcacgccccgttgaaggcgatggaactccctggggcgatggcgacatcccagtcgctgcggtcgaacagcaatcgcccgtcacggcgctcgaggagcgctacggtccgttccacgatccccgagaacacccgactacctccgggcgctccaccggatcgaccgcgccccgtcgaccagcctaccggcagccgatcgctccgaggacctgcgactccaagccccagtaggcatcctcgagcgccgtcgcggcggggagtcgcacccaggcgacgagatcctcaccgacccgtcgatgcgcacgccaggccccccgaatggcatcctccaggagccgcccctccccgaggtcgaccgcgtgccgagcatgctcgtcgcccaacaggatcggtgcgatggcgacgagcagctcgtcgaccagtccctcggcgagataggcaccgagcagggtcgggccgccctcgacgaggacctcgacccacccgcgagccgctccggcagcgagcagcgcaccggggctctcgctggcgaccacgaagccctcggggacgtccagcgggcgacgactcgcgaccaccctgaccggttgacgccgcgcgagtcgcccgcccggtcgcgcggtgagttgcggtcgatctcgctcgaacgtcccccgaccgacgatgatggcgtcgacctcggctcgaagtcggtgcccgagctctcgcgcagcttcctgggtgatccacttcgactgcccccaccgatccgcgacggcgccgtcgaggctgcaggcgatcttgccgacgacgaaggggcgcccgcgcagccggtgcgagaggtacggggccaggtcgtcggcgagcctcgcgcgcatcgcccggggcgcgagtcgcacctcgaccccagcggcttgcagggcctggatccctcgacctcgcacccgtggatctggatcgatgaggcccacctccacacgtgccacgcccgcctcgatgatcgcatcgacgcagggcggcgtgcggccatggtgggcgcagggctcgagcgtcacgctcatctgggcgccgcgagccagggcaccggccgcagcgagagcggcgacctcggcgtggggacccccgggatgggccgtccggccgacgccgaccaccacgccatcgcgctcgatcaccgcaccgacccacgggtttggcggtgcgaccgcacgggagcgacgtgcgagccgacgtgcacgctcgagcggagcgatcacggcgccgcgtgcgggtgcgcgtccccgccgtcgatcaacagcgccaacgcatgatccaggacgggcagcaccgcctcgagcgactccaccgcgccggtcgccgacccggggaggttcacgatcaggctacgcccacgggtgccggcgaggccacgcgacagcgcaccgagcggactcgccgcgcgcatcgcctcgcagaagccgggggcgtgacgctcgagcacctcggccgtgccctcgggagtctgatcgcgcggcgtgaaacccgtcccacccgtcgtcacgatgagccccgcgaatcccaacgatgcctcgcgcagtgcgcgtgccaccgatccggcgccatcggcgatggcgctccgggcctcgagctcgaaccccgcccgctcgagtgccgccgcgagcgcctcgccggatcgatcgacgcgcgtcccgcgcaccacaccgtcggagaccgtgatcaccttcgccttgcgcttcggctccatctagaactcctcgctcgggatcgctcgaacgtgcagctgcgctgcccgaagcccgcgaacgaagtccgcaccgctcatcggtcgcccgccttcggggatgacctctccgagctcgtaagcacctcgtgccgtgtgcacgatggcccgaccgtgatcgagttgcacggtcccgagcggatcggccgcctctcgctcgaggggacgacccgagcgtacgatcacgcgacgccgtccgacgaagcagaaggctcgctccagacgcacacgccgatcccacacgatcgcggcctcggcgggacgcagacggaggtcctcggacgtgatccgcggagcccaactcgccgctccggcctgggggacccccgcttcgagggatccgggctgttcgaggagaccgaggaggagcgacacgccggcgtcggtaagacgacggcgagcctcgctggcccggaggccatcgatcagcaccgagcgcatcgcgaggatcgggcccgcatcgagctcgggctcgagacggatgatgctcacaccgctgcgatcgacgccagcaaggatggcacgctcgaccggagcggcacctcgaaactcaggaagcagcgagtagtgcacgttcaccaccggaacaccggtgagccaggcggcaggcagcaaccggccgtaagcaacaacgacgcagacctcggccccgaggtggtcaggagggagcgcctcgtgcacctcgacgccgagctcctgcgcgcggcgcgccgccacggtcccggccaccgcgccgccacgcccacgtcgcttgggtggccgagtcacgaggccgatcacgtcgtgacccgcctcgacgaggccatcgagatgtcgcgccgtctcctcggtcgagccgagcaggagcacgcgcatggtcagttgccgagccagcgctcacgcgcgatgcgttgcttggcctcgcgccgctcctcctcgtcgagtcgctcgatgagcagcacaccatcgagatgatctgtctcgtgctggaacacgcgcccgaggaggtcgctcccctccaactcggcgacctcgccgtcacgggtgacgtagcgcaggagcaccgtgcgagggcgctcgatcggccagaagtagccaggaacggagaggcaaccctcctcgtagcgccacgtccccgtacgctcgacgatctcggggttgatcgcaacgtccggaccgtcaccgatgtcccagacgaacaggcgcagatcgacacccacctgcggggccgcaagcccgactccgggagcctcgtgcatggtcacgatcatgtcctcgatgagctgatcgaggcgagcgtcgatcgtctcgacctcgcgagctcgatgcgagagcaccggatcgcctatggttcggatcggcaggatcggcacgccaccacgctagacggccgaggcccgtcggggcgctaaccctggttcacggtgggggtcgttgctgatgcgatctctcgccacgagccctgatcgagctggaggaggccgacaccggtcagattcggattgcccgccacgacctcgaccgctccgcccgaggtcacgccgaccccttgggcccacgctggtgccgcgatcgccctcgtgatcaccccgccgcttgaggtgaccggttcgaactccaccaatgttgcgcgagccccatgaggcacgagcgcgaccgcacgggtcccggaggctgcgagcgacggaccgagcgaggcgtcactgccgagtgacaccgttgcgaccacgcggtcaccgacgaggtcgacgagctggagccgctcgcgatcgttcgtcgcaacgatgacggcgaccagcggacccgtcgccccatcgacgaccgcactcgtggcgaccacatggcccgcgagtgccacggtgcgagcggtgcgcgccgcgaggtcgaccacggcgagacgcgcactcgagccacagctcaccacgagcgtctcgccgtcgggtgcgagggagcgcgccacgggcgagacgcaccccacctgatgctcgagcgccgcgagggacgcagacgagaccagcgtcgtcgcgatcgtgccgttcggcgccagatcgacgatcgactggtcgccgagcccaaaggagcgtgtcccgacgatcgcctcgccgccaccggtggtcgcaacgaccgatccagggaacggcgccaccgccgtcgtgaactcctgtggcgtccaacctgcgctgtccgccgaccacaggaccgagtagggccaggtcccatgggcgacctcgccggcatacaccggcagacccgccgaccccccggacgcaagcacgatgccagctcgggtcgacacgccgagcggggtggcgagggagagcgagttcccttgttgcacgagcacctggccgtgttggtagctctggacctcgatcagctcgccaccgctcggacgggcgacgatggccgcaaaattctcaggcgccggaggggcttgcgtcgctgcactcgtggctgttgcgcaggccgcaagcaacgcgccgagcgacgccacgaccgcgactctggcacctcggccacgcgtccagcgcactcagacctcctcgaccaggtggacatacagcgacgagatgctggtcgccaccgatgcattcagcgacggatccatcggtatcaggtagcgctcggtgaggttcggccctaccacatagccgatgtcctcatgctgggtcatcacgccatccaccggctgggacacgccgaaaccgagcgcctgccacaccttcgacagctgcgtgagcgaggggctggtcaagaagtaccagttggacagtccggtcaggttctctcgttggtcgaagatcttgaccgcctgcaccgaatggatcacggggttgaccgcgacggcaacgaacaccgtgttggcgcgcaccgacggaggcagcgccaagtccgccgtgcggagttcttgggcaatcaacggacagtcgaaggtgcacaccggatccaggttggtgagcaccacccgcttgccggcgaactggtcgatcgagaccggaacgcctcgctgatcgagcaaggtgaacgagggtaccgggcggtcgatggcaaagggcgtgtccgaagccgccagcgcgagcgccggcgaggcggtctgattgatggcggcataggccagcggaccgatgcccatgagcgcgaccaccacggtccacgtgccgagcaaccgcccagcgatccccacgccactcggccacagaccgcgaacatcgaccgactctcgagcaggactcacgacgccgacgacagcagcgccagcgagcacgagaccgggcaccatggagttcgggtccgtgccgacgcccccgaggaacccgaagtcctggacgaaccaccacgccaggagcgacaggaccgcgagcacccagaacgcgggccataccaagcgcttggccagaaaggcaaccccgacggcaatgaggacggccgcgacggcagcgttcacgacgaccgtcgtcgtgccatggagtgcgttcgcgagatcgaccatcggccgcgccaggaacgatggttggggcgtcccggccatcgtccggatcatcgcggggatctgtccgtgatagaagccacgaccaggccaagcctcgaggaccccgaacacgaagagttcggcgcccacgaggccgagcagccagcgtggaaggcgatccggttgccacgcgctccacggcgcaagcagcgctgccgccgcgaccacgtacaggaggaccgccccaggggccccgaagagccacgaggcccccggcgcgaggatgccacccatcgcctcgccacccacccacacggtcaagccccagaggatggcggcgacgtagccgaccttggcgaacgcccctgacttgccgaggagcaaccacacgccgatcgcgagctggatccacaccgcacccgtcgctgcccagagcggatggcgctgccacgcgtcgatgccgagctgaacgaggtcgaccagccagcggggactgccctgcgcggctggctggatgacctggcccacgagcgacgtcggcatggcacgctgcatctggagcagcccatcgacgatccacagggcaccaaagccccaacgcaggatcgctctcgctcgcggctcggcgacctcgtacaccccctcgtccgccgaaccagcgacctggacgcgtgccgggttggtggcgcccgcaaagaggaaatagcgggccgcgacgagcaccaacccgatcaagacgagcgcaatcgcctcgagccccaaacggtggtagaacggccccgcaagacccgaactgctcagggctgcactgcccatacccgtcattgcctaagcctccttgggctcaccgaccggcacgtaccgagacccgcggttcccgacagagcctgtcctgacaaccggattctagcggccgaaggccgaggctacggggccgctctgtgcaccaaagctcagagttctcgcgggtcgagttcgacccgaaccgcgcgcgcatcgagcgttcgcggcacggatccaaggacaacgcgcagctcacggcgggtgggagcggtgaggagccagcgatcgggggcgagctcggcaacctcgaaccccggcacgctcacctcgctcagtgcatgcacaaaggccgccgcctccggtccggagacgacggcggtgccgtggtctgggtcgagaccgagagcggcacgctcgtcgcgtatggcgcgcagcgcgcgtcgcgcgtcgcgctccgcgagcacctccgggagccacgctggcgcgtgctcgaccacgagatccacctcgccgcggttcgatgcgacgagcgccactgcccggtggatccagtagaggcccagctcctccgcgaggcggccatgagagccgaagagacgctccggctcgacgagtacgaccagatctaccgagccagcactctcgagcgcctcgatcgtcccgacgaccacgcccgcccgtggatccgggcccttcgcgatcggctggcgtaccaccggctcgaggcgtgccgcaacgtgctcgaccgaccagcgagacacccgcacggcgggtgagccgcacacgccacagcgcagcggacgtagcgcctcgcacgtccgacaccagccccgttccgggacaccgcgcctcgcagggagcacgaccaagcgcccaccgcaggcggcacacgtgagcgttgcgccacacgcccgacagaccggagcgtgccccggacctcgagccgggacgacgacgagcgccctcgggtccgcgcgccggcgccgggctaccgcgagcccatcggcgacgaccccctcgattccgcggtcgagatcggcggccccgaacgtccgcacgacgggccagggtcgaggcgctcgagtggggacgcgaacccgggcgcgcgccaggatgtcggcgggcggcaccgcactcacgaccacgagtcggctccggctgacggacgcccgcaccccagcgagatccagtgcctcgaggtacggactcgactcgtcccgcgcgttcggatggatcgggtcgagcaccaccaccgcatccggcgtcgcgagcggcgcgagcgcgcctcggcgaccaccgatactcaccgtcgtacgaccgcacgcgagctggtcccagtcgtcggggaaccgtgccgcacggaccccgacccgggcgagcgcgtctgcagtgtgtgcggcgatcgctccggtgggcgccgcgatgaccactcgctcgccgaaggcgccagccgccatgaggcggccgacctcctcgggcgccgagacggcgagcggcacgaggaagacctcgggtgtgacctcgctcgggtcgacgaggcgctcggcgagctgaccccgggcaggctcgagcaccggtgctccccgcaccttcgggcgccgcgcagcgcgcaagagcgtgacgggactcgccaccgcccacatcgccgcggcgagcaccgcctcgatcacctcgggaggggggcccggtcggacacgacggagcaccgagcgcaacgaggtggccgacgggtgctcgcgcgctcgggccgggcgcgcaacgacccatccgctgacgcgtctcgcaccgaagggcaccacgacctcgtcaccgagaccgacctctgcctcggggtcgacggcgtaggtgaacggcccgggccggccgaccacgtcgacgatgacgtccgccgagtccgcgggaaggtcgccctccacctcagccagtgatgtcgagcgcgctccgcagcgcgtcgagccgatcgagtcgctcccacgggaacgtgccgtcggagcgcccgaagtgcccataggccgcggttcgccgatagatgggttgacggagccgcagcgcatcgatgatcgccgctggccgcaggtcgaacacctctcgaacggcatcttcgatgcgacgcggatcgacctgctccgtaccgaaggtctcgaccatgagcgacaccggatgggcgacgccgatcgcataggccacctggagctcgcaccgcgacgctgcgcccgaggcgacgatgtgcttggccacccagcgagccgcataggccccggatcggtcgaccttggacgggtccttgcccgagaacgcgccaccgccgtgacgcgccgatcccccataggtatcgacgatcaccttgcgaccggtcaggccggtgtcggcgtgtggtccgccgagctcgaaccgtcccgtcgggttcgccaggatcttgaggcccgagacgtcgaggtctttgggcaccatcggaccgatcacgacgctctcgagatcagggagcagcagggtggcgagatcgatgccgggctggtgctgcgtcgagaccagtaccgtgtcgagggcgacgggtcgaaacccctcgtagcgtacggtgacctgggtcttgccgtcgggtcgcaggtacgggagcaccccagcccgtcgcacctcggcaaggcgctgcgcgatgcgatgggcgagccagatcggcaagggcatgagatcgggcgtctcatcgcacgcgaagccgaacatcagtccttggtcaccagcgcccagggacgaatacggatccgcctcgccgctcctggcctcgagcgcgctcaggacaccagaggcgatatcgggcgactgctcatcgatcgtgaccacgacgccacaggtgttgccgtcgaaaccgtaggactcacggtcgtagccgatgtcgcagatggtccgacgaaccaccttgggaatgtcaacgtagctgtcggtggtgatctcgccggcgacgaccacgagacccgtggtcagcagcgtctcacacgccacacgggccaccggatcctgcgcgaggatctcgtcgaggatcgcatccgagatctggtcggccatcttgtcggggtgaccttcggtcaccgactccgacgtaaacgcgtagctgcgcacagcgctccttccttcgagggcgctcgaacaacctagtggagccgatgcgatcgcgcgtacgcgacggcgtgcgcgagaatgcccgcagcgatctgctccttcgacgccaacgccagctcgccccaacggccgtctcggtcgagcagcacgacctcattggtcgccaccgcgaagccggcgtccgcacgggacacgtcgttgccaaccatgatgtcgacgtcgcgggctgcccgcttgcgctccacctcggtgcgcggatcacccgtctcggcggcgaacccaacgatgatttggtgcggctcgcgatgagcgctgagctcacccaacacgtcgggtgtcggtccgagttcgatcgtcagagacgaacggccggcccgcttgatcttggaagacgccgtcgccaccggagcaaagtccgccaccgcagccgcctgcacgacgacgtccgccgacggctggcgctcgcgcatcgcagcgaggagctcctcggctcgctccacccgcaccacctcgacgagctcgccgaccggaccggcatcctcggtcgtcaccaacgtcaccgtcgctccagcgagcgccgccaccgcagcgatcgctcgcccctggcgaccagacgagcggttggccacgacacgaaccggatcgatcggctcccgtgtgccgcctgccgagacgagcaccttccagccggcgagatcgagctcaggtgccgcctcgagcagctcgagccagagcgacatccaccacggatcgacaaggcgtccgagccctcgatcgcctcccgcaagccgaccggtcgtcggtccgacgagcacggcgccgtcggtgcgcagtgtcgctaccgagcgttgggtcgctggcgacgaccacatctgggtgtgcatcgctggtgcgagcgctctcggcgcgctgctcgcgagcagcgtcaccagcgcaacgtcgtccgcgatcccggcggcgaccttggccatgaggtccgcggtcgccgggtacacgatgatgcgctcggcccacgacgccaagcgcgtgtggaccgatggctcacgaccgaagagatcgtcgttcaccatgcgtccggcgatcgccgacagcgacgcggcaccaacaaactcccgagcggcggccgtctggatgacctcgacgtcgtgccccgcatcgatcagcagccggatcagctcgagcgccttgaacgctccgactccaccgccaacgacgcacagcacgcgtcgcgtcacgccgttactccgcttcgtcctcgaccaactcggtcacgtcctcggccacgacatccggaacgatcatgccggcagcgatctcctcgaacgccagcgacaatggcttcgcgacgtccgactccacctgcggcggaatcatcgcgcccagcccttcaccgagatgggtgcggtagtcgttgatctggcgggcacgccgcgcggccaaggtaatcagaacgaacttcgagcccgtgtgctcgagcagctcctcgatgggcgggttcaggagcgaacgcccggcttcagccaccacaacctcctcgacggacctcggagcctacctgctcgagccgactactcgggccgaagggctgcgccgcggacgatcccggccacttcatcgatggcccgctcgaggcgatcgttgaccacgatatggtcggcgaggccgatcatcgcctccacctcgttcgccgcgatggcgagacgggactcgacgtgcgcgtcgtcgtcgcctcgagcgcgcatgcgacgctccagttcgtggaagctcggcggcaccacaccgatgatcgccgcctcgagctccagcatgcgcacactcctggcaccctggacatcgatctcgaggatggtcggatccccgcgctcgagctccgagcgcggggtgccgtacaagcgcccattgaacgacgcccactcgacgaacatgccctggtcgatagccgactcgaagtcctcgcgcgagacgaactcgtacgcctcgtccccctcaccgggacgacgaggcctcgtcgtccacgatctggcgaggtgggccgatggcagcgacccagcgagccgacgagcgatcgtacccttgccgaccccgccggggccgcagatgacgacgatcagtggcccttggtctcctcgagcaggcgctgacgctgcaccgatccaagaccctggacgcggcggctgtcggcgaccccgacctccgccatgatgcggcgagccttgaccttgccgatgcccggcaacgactcgaggaccgacaggaccttcatcttgccgacgatctcgtccgactccgctcgctccaggagctgcgcgagactgagcgagcccatcttcaggcgctccttgatctcggcgcgggctcgacgggcttctgcagccttctggagcgcagcttgacgctgctcagggctgagcgatggtggcaatggcatacagcgcaacctagcagagcttctggccgtctagggctcgatttcgcctgaatgttgcctacgaggcctctcccgtcgccgctgcgaacagcctggcggccacctcgaccgggtcactcgcctcggtcaccgcacgtccaaccaccagcacgtcggcacctgcctcgagcgccgctcgtggcgtgacgacctgccgctgatcgtgctgggcacccgatggctcccggatccctggcacgacgcgaacgagctccggccagcgctcggcgacggttcgcaggtgatcggcgccgacgaccacgccctgacagcccgagcgtacggcgacgtccatccggcgctccaactcggagaggtcgagcggagcctgcgacgtcagcgacagcacaccgagcgcgatcggtgtcggagcaccgacacgttcagccccctcgaggaggccctccacgccagcgcggagcatggcctcacctcctgcaacgtgcaaggtgacgagtgcgacgccaaaggaccccaacacccggctcgcgcgatgcacggttgtcgggatgtcgtggagcttgaggtccgcgaagatccggaatccttggtcggcaagggccgacagcaccgtcggaccggcggcggcgtagagctcgagccccaccttggcgatggagaaccactctcgcaacgacagtgccagccgttgggcctcgacggcatcgtcgcgatcgagcgccagagcgaagcgctcccgaagcgcctgagcctgcatcatccactccctccttgacgccgaagcgcccttgcgtagcggtcccagctgtcgacgccgctgcgcgcgagccgacgttcgatctcggcgagcacgaggacgggacgtcgtgggtcgacaaagagcgcggtgccgatctggacggcatcggctccagcacgaacgaagcgctcgacgtcgtcggcggtcgcgaccccgccgacgccgatgatcgggacggtcggcaacgccgcacgcagatctgcgaccgcccgaagcgcgatcggctgcacagcgcggcccgacaagccgccccctcgcgccgtgccgagggcctcacgaccgtcgtcgtaccactgcgcaaagagggtgttgatcgcgacgagtccgtcggcgccggcagccaccgcggcgtgcgccacgtcgacgatgcgatccgtattcgccgagagcttcacgaggatcggggtcgcaacctcgtcgcgcaccgcgcccaccacgcgagcggtggcgttgggatcgtgcgcgaacaacgcccggtcggcctcgagattcgggcacgacaggttgagttcgatgtagaccagcgatggcgcgatccgagcagcgcgccgaacggtctccccgtagtcgcgcggctgacgtccccagacgctgagggcgaccgggatcctggcgtcggccaaggagggccacgtctcagccagccatcggtcgatgcctggacccgccaacccgaccgagttcaccatgccacccggtaccggagcgaggcgaggcgctggattgccctcggtggcaacggtcgtcagcgacttgacgacgtgggcaccgagtcgctccagagccacagcagccgcgagctccgtgccgtaaccgccacacccggccgccgtgaggatggggttcgccaagacgagccgaccgcgtgcaaccgagaggtccgccactcaggtttcctcgtgataggcctgcagcggccgcacggtcagcggctgacgtgcgagcgcctcgaccgctgccacagccgcgcgagcggcctccagcgtcgtgatcaacgggatcttggcttcgagcgctgccgtgcggatgcggtaaccgtctcgccgcgggccactccctctcggcgtgttgatgatgagcgcaacctcgccggagcgcaccagccgtacggcatcgacgaaaccctccggcgcagcacgctcgccgagatcctcttcctcggtgaccttcgcgacgaggcgcgcaacagggacgccgtgagcctgaagccaggaggcggtcccctcggtcgcagcaaggtcgaacccgtgggccaccagtcgctcggcgatcgggacgagcgcctccttgtcgcgatcggcgacggtcacgaggaccgtgccctgctggggaagacgcgtaccggcggcgagttgtgccttggcgaacgccatcggcatcgtgcgatcgatccccatcacctcaccggtcgagcgcatctcgggcccgaggatgctgtcggccccgcggaacctgccgaacgggaggaccgcctccttcaccgcgacgtaactggtgacgcggcgaggcacgaagaggccctctcgttcgagatcacgcagggtcgatcccagcatgagacgcgtggcgatcttgacgagcgcgacacccgtcgccttggcgacgaacggaaccgtccgcgacgcacgcggattggcctcgatgacgaacaccgtgccgtccgccacggcgaactgtacgttgatgagcccgaccacatcgagtgcgtccgcgatcgcacgcgtctgggcctcgatctctgcgacgagggcgggagcaagtgagaccggcgggatcgtgcacgccgagtcacccgagtgaacgccagcctcctcgacgtgctccatgaccgcaccgatccagcacgcgccctcgcgatcgcgaaccgcgtcgacgtcgacctcgatcgcaccttcgaggaagcgatcgatcaggatcggtcggtcctgcgagatcgcgccctcggccgccagatcgacgagccgagagaacgcgctgcgcagctcgtcctccgagtagacgatctccatggctcgcccgccgagcacatagctcgggcgcaccaacacgggcaggccgatcgcagcgaccaccgcctccgcttcggcgagcgaggtcacggtgccgcccgggggctggcggatgccgaggcgctcgcacagggcagaccaacgccggcggtcctccgcgacgtcgatcgagtccggcgaagtgccgaggaccagcgacggatcgatgtctcgagccagcttgagtggtgtctggcctccgagcgacacgatgacaccctggagtgagccgagacgctgttcctcggcgatcacgtcgagcacgtgttcggtcaccaagggctccacgtacaggcgcgaggaggtgtcgtagtcggtcgagaccgtctccgggttcgagttgaccatgatcgcatcgacaccggcctcacgaagcgcgaatgctgcatggacgcagcagtagtcgaactcgatgccctggccgatgcgattcgggccagcgccgatgatgatcacacttggccgattcgatccgacggtctcgctctcctcctcgtaggtcccgtagtagtacggcgtgcgtgctgggaactcgccagcgcaggtgtcgaccgccttgtagacagcgcgcacccctacggtgtgccgatgctcgcgaaccgccgtctcgtccacaccgagcagccacgcgagttggagatccgagaagccccatcgcttcagatcgagcagttcgtcggcaccgagtgaggcgagatcgcggccacggatgtcggctgcacgcgcgacgatgcccgccatttccccgatgaaccacgggtcgatccggctcagctcggcaacgcgctcgatgctccaaccgcgccggagtgcctcgccaacggcgaagactcgctgctcggtcggcacagcgacgagcgtggccagggcgtcatcggagtacgcctgccaggtgacctcggccggatcggcgccgaaccctccccgcgaccgctcgataccgcggagcgccttctgcagcgcctcggcgaaactacggccgatcgccatggtctccccgaccgactgcatccgcgtcccgagaataccctcggcaccttcgaacttctcgaagacccagcgcggcaccttgaccaccacgtaatcgagtgccggctcgaaactggctggcgtgacacccgtgatgtcgttcatgatctcgtcgagcgtgtagccgatcgccaagcgtgtcgcgatcttggcgatcgggaacccggtggccttcgatgccagcgcgctcgagcgcgacacacgggggttcatctcgaccacgaccatgcggccgctggtcggctccacagcgaactgcacgttcgagccgcccgtctcgacacccacgcgtcggaggatctcgaacgagagcgaccgcatgcgctggtactcgagatccgtcagcgtctgtgcaggagcaacggtgatcgagtcaccagtgtgaacccccatcgggtcgacgttctcgatcgaacacacgacgacgcagttgtcattcgcgtcgcgcatgacctcgagctcgaactccttccaaccggcgatcgactcctcgaccaacacctcgccgaccggcgaggcgatgagaccggcccgcagcatcgcctcgaaggagctggggtcggtcgcgatcccggttccggctccgccgaggatgtacgagggtcgcagcatgagcgggtaaccgagctcgtcggcgacgtcccttccctcctcgagggaccgcacgagccgcccgcgcaccgccagctgctcgtcgatgctcatgagcagctggcggaatgcatcgcggttctccgcgagctcgatcgaggccggtcgcgccccgagcatccgcaccccacttcgctcgagcacaccagacgcatccagctccatcgcgagattcagcgccgtctggccgccgagcgtcgggagcaccgcatcaggccgttcggcctcgatgatgcgctcgagcacctcgagcgtcaggggctcgatgtaggtcgcgtcggcgaactcgggatcggtcatgatcgtcgctggattcgagttcgccaaaatgacgcggagcccttcctctcgaaggacccggcacgcctgtacgccggagtagtcgaactcgctggcctggccgatgacgatgggaccagacccgatgacgagcaccgactccaccttcggatccctaggcatgcgaacctccaccgagcagtgacagcagctcgtcatggatctccgacgactgctcgagcggaccgggggcggcctccggatggtactggacgctcacggcgccaagtgccggcaaccgcagtccctcgacgaccccgtcgaacaggttgcgccgggtcacctcggccggcgtgtcgagccggccgagcgacgcctcgtcgaccgcgtacgagtgattctgggcggtgatcgcgacgcggccggtctcctccaggcgaacgggatgattcgatccgtggtggccgaacggcagcttgatcgtctcggctccggccgcgagggcgaggagctggtgcccgaggcagatcccggcgatcggcaccacaccgagcaaggaccgaacgagctcgatgggacccgtcagtgcggcagggtctccaggcccgttcgacaggaacaccgcgagcgggtcgagcttctcgagctcttcgagtcgtatggtcgccgggacgacgacgagccgccatgggccacgcagggtctcgagcatccgctccttcaccccgaaatcgatggccacgatcggtcgactggagcgcgcgtgacccaagggctcgagctcgcgaggttcgcgacgggtgaccgcgcgcacgagatctcgcccttcggtaccgacggcgacccgaactcgctcggcggccgcgtccggatcaccggtcgtgatgatgcctggttcggcgccagcggcccgcaccaggcgaacgagtcgcctcgagtcgaagtcgacgaagagtgggacgcgtgcctcccagagccacgccgcgagggtggtgtcggccgcatggttcgacgccaccaccgagtacctcggcgccaagaccgcactcacccacggccggacgctttgcacgtcggccctgcggacgccgtaggttccgaggtgggccgtggtgaagcacaccatctggccgtagtaggacggatcggtgatggcctcgacgtagccgctcatcgcggtgttgaagaccacttcggcctcgacgtcatcgaggagcggctcgacaccggcggggatgaccacagcgccacggaacctcgcacccgagcgcagcaccaaccacgccggtattcgctgtaccgactcctcacgcacccacatagcggccttcctcgacaaccacctgacctcggcgcacgacccagcggatcgacccgaccaactccctcgtcgcccatggcgaattcgtcgaccggtacgccccgtcgccgccgccgatggttctcccacagggatcgatcacgacgacatccgccagctcgcctcgtcgcagctcgcgcgaacgaccgagcacgcgggccgggccgatcgccaacgcctcgaggacacgcacgagggcgcgccgcgcctcgtcgccaaggtgctcagagctctctggccgcgcatcctcgatcgagccacggagcacgagctggtcgagcacggcggtccaggtcgcagggaacgcctcgacgagaccgagcatgccgggtgctgccagctggaccggcaccgtcttcgctcgctccggatgcggggcgtgatccgtggcgatcgcgtcgaacgcgcctccgaggagcgcttcgagcagtgccatacgcgtcgcacgcgtacgcagcggtgggttcacgcgaaagcgcgcgtcgtggctcaggagttctgactcctcgaggccgaggtgatgcggcgtgatttcggacgtcaccgccaagccctctcgctgcgccgcacgcacaacattgacgctctcgcgggcgctcacatgctggaggtggtagcgcgcaccggtcgcacgaacgagagcgacgtcgcgcgcgaccagtgcaacttccgcaacctccggaacaccgtcgtagccgagacggtccgccagcgctccggcgttcatgacgccgcggctcagttccgggatggtcgcatgctgcgccacgacgacccccgtgctcgcggcggcctcgaggaccgcgaccgcgacgtcggcacgccagagggggtcaccgtcatcggagatgatgcgaacaccggccttcgccaggctctcgacgtcgacggcatgatctcctgcacgctccatcgtcgccgacgccgcctgcacgacctcgaccgggagcgccgcaaagcgatcagttgctgcgcgccatcgctcgacacggtcgatcgcggggaccgtgttcgccatggcaaccaccgtcgtaaagcccccacgcagcgcctggatggcgatgtcctccggcgtgtcggccacctcaccacccggccaccggaggtgggcgtgcaggtcggtgaaggcgggggccacgacggccccgggagcctcgatcacccggtcgccgcgctcgggaccctcgaatccggcaatccgtgcctcatcgatccgtatcggcacccgttggaggctcccgtcgacgaggacctctgcgcctgtgactacaatccccaccctgcctcctcggcgagcgcttcgagaacggcgacccgagtgggcacaccgtaggcgtactgcaggccatcgagcatccgaggggacgagagcacgatatcgtccaattcgaccccccgattgacgggcccgggatggagcaccacggcatcgggccgcgcacgctccaggcgatgcccgctcagctgaaacctcgcccgatagcccgacagatccacgcgctcgttcgctcccacgcgctcgtgctggatacggagcatgtagaagacgtcgacctcgtcgaggacgtcatcgattccatccgtgacgcccacggcaccaagggccttcggatccaacgaccactcacggggagcgacgccgaccacctccgcccccaccgaagcgagaagccgccctaccgaacgcgcgacgcgcgagtggcgcagatcacccacgatcgccacccgacacccctcaagcgcgccaaacgcatccgcacgcccgccccgagtccgagcaaggacgcagacgtcttggagcgcctgcgtcggatgctgaccgacaccgtcgccagcgttgacgacgatgccatcgaagaatctggctaccacgtcggccgtaccaacccacggagcccgcacgaccacgccactcgtcccctgcgcagccagcacgcgcaacgtgtcgcgaagactctcatccttgacgagcgagctgctctccggatcgatgcggacggtccgcccgccgagccgatcgattgcagcctcgaacgacagcgccgtacgcgtcgacggctccaggaacagcaacgcaacccgtcgcccctccagacaccgcgacgccgccgcgccatgaacgagctcgtcgacacgcgcgcccagcacgccaaggcgccccgcatcgagctgctcgacccccaggaacgttgcgctcatcgcccttccgcctcgatccacacaccggccgcatcgacaaccacgtactcgttacgcgctgtcggcaggttccgacccacgatgtcgggccgaatcggcagctctcgatgtccccgatcgacgagcaccgcgagcagcacacgctgcgctcggcccgcacgcaagacggcctcaagggccgctctcgccgtacgcccagtgaagaccacatcgtcgacgaggacaacggtccgtccctcgaccttgatcggcggcaaccatctcggatcacctgccggctccgcatcgtcgcggaactgcgtcggatccacgacgaccaacggtaccgctacggagcgaatcgactccaacgtgtcgacgaggccacgagcaaccgggacaccgccgtcggcgatcgccacgaccacgagatccgctccaccgcgcgtcgcctcgacgacctcatgcgccatccgacgcagtgaacgaacgatgtcgtcagcgtccaacacacgccgccgacgcatcgcaacctccgtttcggcctcacaggaccgtccttaacggctaccacgacgagcctagcgtgtcggctctcgccgcggcacggacggacgaacctcacacgcgcgcccgagaacgatcgatggcggggagcttcacgccccccgccatcgtcagcgaaccagcgagatcagccggaccctaccggcggctaccgagccgccgccgagcgaaaaatccgaacaccaacgacgctgcgaagatcccgatcggaatcgcgaacgtcatgtcagccgctgctgagtatccggtgacacttgcgaacattgacactccctcttgttgtcgtcagccccaacacgaaagacccatgacgctcctactgtatcgcgacgagaccagctcgggcgaccactaccaggagcactacaggaacaactctaccgacccacggcagcgaaccaccggccgatctacgggcgccgtcgcaccgaacgaccgatccgcacaccaccagtgagacgccccttgagcccgtcccgttcctcggcgtccaaccacagcttcatcttctgcgccccgagcacgaaccacacggccccaccgccgatcaccaagatcgccgccgcgatctgctggtcggtcatcgcgccaagaatcccatcctgatggaccaggtagccgtaccaggtgcccggtgcgaggcccatcgcgatacccacgcccatgatcaccatggccgaggtccacgcgacgatgacttgacggatgtgggtgatctggggcctgccgtctcccatcagcaccgccattgacagtgctcctgcagtcccttgggcaagcaacgtcgccgtaccgacgaccggcacggcgtggatccatgactgccagaaaccctcgaactgacccacgaccaacaggtcatcggcgacggcaaccagccagacccatcgcaccgcccacgcgacgagcggcccacgcccagcgagcggctcgtccgactgcgtcaactcgtgccaaaagagcgcgagcggcaccgccaggaccacaatgctcaccagtgcatgcaccgcgaccacagccgcggacgccaccatgaggagcggattcgccaccagaccgagcgccacgacgacccaacccactcgacgccacatcgaaacgcgaccgcgtcgaatcagagcagccccaacggcgacgacccccacgctgaggagcgccgcaacaacgttaccgatcacgccagcacccccttgcgacaactcctcgcccgacgacgaccctctgcatccaggccatccgtcgccgggaatcgtgctggcggggcacccggaaacccgcgtgccccggccaacactcaactcactcgagttcccaccctcctagtggaggatgaagtacacgtaccacgaaaagatctggaccaacacgaagaagatggagaaggccccgaagccatcgaggtttgctcggaagttctccgccaggcgatggctcgaaacgccgacgccaccgtcgacccggaagaactggtagctccgaatcgcccgcatcaccaacacgaagatccagtaggccgccaggaacaaagccaacgcattcatcacagcgaacgcgatgtacaccccggcatagccggaatacccaggcgggaacggcaatctcgtcaggctccagatctggaaccccatggcgagcagcagcaacagcacattagcgaggcctgccacgatgaagtccatcgtgaacccacgccgcaggcgccgattcgcaaacagctgcaccagcagaccagccagcgggagcagcatgacgaggaagccaaggatcttcgaggccgtcaatccgtgtggatcccacaggccgttggagttcaacgactgaaggtagaagaacgagaagtagatcccgccgtagaacgcagccgcaaccgggatcagcgttcgagacgccgtccacagcgcacccagctgcgcatcatggtagtactgctcctcatcgatcgcaggcggctgggcctgcacacccgtagccactactcctcacctccagcgacgacagcggcctgctcagccgacggatggagctcggcaaccggaccccgatccttcacgccgtactggtacgggctgcgaagcacgaccggaatctcctcgaagttgtcggccggtaccggatagccaacctgccactcaagaccctccgagcgccacgggttcggaccagccggcgtccgccagacggcgagcgaccagatcagattgaacacgtagagcaggattccgaagccgagcacgtacgaggagatcgacgcgaactggttcaggtgctggagccgaagggcgtactcgaacacgcggcgcggctgacccagcagaccgaccatgaagagcggcaagaaggtcccattgaagccgagcaggatgagccagaaggaccacttcccgagcttgtcgttcaaccgcacaccgaacagcaacggtgtgtagtagtagatcgcgccgagcacgatgaacacgagctgacccatgatcgtgaagtggaagtgcgccagcacgaagaagcttccgtgcaccaacgtgtccaccggcacgtccgagttgaacactcccgtcacgccgccccagaggaagttccagaacacggcgagaacgaagagcatcgggacctcgaagcggatctttgcgcgccagagcgtgcccatgctgaccaggtacaagaagccggtcgggatcgagatcagctccgtggtcagcatgaacagcggacgcatgtccgggttcatgcccgacatgaacaggtgatgctgccacacgaagaagctcagcgcagcgataccgatcatgcccgccgccgaggtcttgtaggcaaagaccggcttgcgtgcgaagaccggcaagagctccatggtcatcgcgaagccaggcatcgccatgaggtagacctcgggatgaccgaagaaccagaacagattctcccagaggaagctcgagccgccgtggcccgcatagagcatcgacgtgcgcacggcacgatcgagacccatgatgaagaggccatctgcgaacaccggaaccgagagcaacatcgtgaaggccgtcgtcagcaaaccccacaccaggatcggcatccgagaccacttcatccccggcgcgcggtagttgatgatcgtcgccaccatgttgagcgaaccgatgatcataccgatgccgaccagagcgaaaccgacgtcgtaatcggactgtccgggtccaccctggatcgagagcggtgcgtagccagtccaaccggcctggaatccaccctgccacagcgccgagatgatgaccatgtacgccgcgacgaggagccacagcgacaccgcctcgaggcgggggaaggccatcttcttcgacccgatcatgagcggcaccaggtagttaccgaacggaccgagcacgagcgacgtcgccatcgccatcatgatcgttccgtgctcaccgaccacctcgatgtaggtatcggccgcccagatgtggtacgtcggcgacaagagctccgtgcggatcgcaagcgccagcaaaccaccggtcaggaagaacagcagcgtgacgaacaggtactgcacgcccacgaccttgtggtcggtcgagtacgtgaagtgctcccagaacgtccgcttctccgacttcggcgggtccttcggttcccatccgagaagcttctggatcgggtagttgaagaccccgagtccagcgagaaagcctacggcaccgaagatgagtgccaagtacacggcgatctcgttctggccggagttcactaccaccgtatagcccgaggcaatgaagttgccgagccaatggccgaacgcgtagaagatcgcgcctccaacgaggccagtgaagaagttgcccgtgaaccacgcacgtgcgaacttcaaccctcgagcctcgaggtcacgctgatcgacgatcgccgcgctcggcgacatctcaacagccatcgtttcgttcccttcctcagcgttcctagtacgcaaccgagtgaccgttggggtcgtagctcgggtagtagccaccaccggcccccgagtacgacggcgtgtacgtcaacgcgaacggcggcaggagcttggtcacaccagcgttcgcagcctgcatgttcgtcgcccacgtctcgaacgacgatgctggcaacacctcgccgtagttgtacatcgcaccatgccagatcccgcaaagctcgtcgcaacggacggtgatcttgcccgtctggctcgtcgtctcggtggtcgcgacgttgttgacgcccggattcgcatccgccttgactccgagctgatacgcccagaagtcgtggatcacgtccagagacgtcacatcgaagaccacgcgcgcgttggtcggcagatacagctcagtggtctccatccccccgaactgcgggtaccgataggtgaaccgccactgttgcgcgatgacctgcacgacgagcggcgtcgagcctcccggcgtccacgccccctgcggcgttgcctttgcccatgagtagttccagatcggcgacgggccagacccactccccatgtcatggttcgcgatcagctcgtaggtaccgaataccgccaggccgagcacgagcacggtcgaggccacgtaccagattccctggatcttccgattgccgaagaggacaatgccatcctggtcctcttcacccttacgggctcggaagttcacgagtgcaaaaccaccgtacacccagaccatgaacaggactgggaccacgagcaccatcagaatcttgaagtcgaactgctgggccgcagccgacgtcgtcatggtgccgggcggcatgtggggcccccacacgaaccacgtcagatagtcgacgatcgccgtcaggacgaaccagaccgcaaagatctgccaccccttggatcgcgcgaaagccttgcgctcctcacgctcctgttgtgtcagcgccatcacgccaccaccttgaagaagccagccatgtagccagtctcggccataggaccaccgttaccttcgaggtagccaacgccgcacgggatgaagcactgccagcggtaggtgtgcgtcgtgttgccggagtagaacgtgaaggtgatcacgttgtgcgcctccgacggattgcacggaccctgctggcagaagttcttcgcattgccgttgacgccccacaccgggatgttcaggccgagcgacggggcatcgatggtgtgtgcgacaccattccccgaggcagcatcgagaacgctgaccggcttcccgttcagatactcgacaccgccctgcgtccccaggaccttgccccagtaggggttccgcaacggcccgcccgagtcgtactcgtagaccgtcacgtgcacgtacgtcttctcaggaacctgatagatcgtcgtgcgtacccacttgccagcggcatccttcgcgtaccagcccacccattgcgggtgaggaccggtgccgacggcaccctcgacctgcaacgtcaggtcgacggtgttcggctgtgtcggcgacggagttgccgccaccgtcggcgggtacgttcgcaagtatccgaagatgccaaacaggatcaacccgatggcgatcgccgcggatacaagaacgatgcccgcccttgctcccttagacaacctcaaccccctatcacctagggccttccccactgcgcctccggcgaggctgcgagcgcagctgctcgaacgagctcactgcacccggacgaacctggtgctaaccgtggtgggccagcgcgtccaacttccgaagccagttctccaaggtggacgacgaaatttgaccctgcaccgcaccgatgacgcgaccgtcgggtgcaacgaagaaggtgtcagggatgcccacgagcaggtaggacgactggagcgatccggcgtcgcgcacgactggatacgagacccccgtgcgcgccagaaaggcgagtgcagccgatcgctggtcattttcgtccacaccgaggaatgcgacgctcccggcggaagccgccgccgccttggcgagcatcggcgtctcggcgttgcacggtccgcaccacgacgcaaagaagttgatcaccaacggacgcccacggaaggatcccggtccgagcttcgacgcgctcgaatcgttcgcgaggaccggcagcgaaaagccaggcaccgtacgacccacgagggccgaaccagacgacgaggccgtgagcgaggccgaggccccgttcgttgcggatcgcgcaacacccacggcgtacacgacgtacccaaccgcgaccaagagcgcaagcaccatcgcgaacatgaagacgcgggggcgccggcgaaggtcggactgctcgtaggtgctctcactcgtcgtccgcgtcacctcgacctcacgatgacatcgacagccatcccgacgaacagcaaggacaggtacgtgatggagtaggaaaacacgcgcatcgccgccttcggagagagggagcgcaggagacgtaccgcataccacacgaaccccgcaccgagcaggaccgcagcggcgtcgtacacgaggccgagcccggcgaccgggcccaggacgagggccaggagcaccagcacgaccgagtaggccacgatctgccacgccgacgcgcgacgcgaggcgaccgaaggcagcatcggaacccctgcagccgagtagtcgtcggcatagcgaaacgccagcccccagaagtgcggcggcgtccacacgaagatgatgaggaacatgagccacgcggcgagcgagagctcgtcacgcaccgcagcccatccgacgaggaccggcgccgcaccggccgctccaccgatcacgatgttctgcgacgtcgatcgcttcaaccacatcgtgtacacgccgaagtagaacagcgccgccgcgagcgcgatcgaagccgcgagcacattggcgcccacggacaggatcgcaaacgcggcgacctcaagcgtgacagagaagatcagggcgccccggggcgacacatcaccggtgacgagcggacggcccttcgttcgccgcatgaccgcgtcgatatcacggtcgaaccacatgttggccgcgttcgcaccgcctgccgcaagggtgccaccgaccacggtgatcgcgatgagcgagagggatggcaggccacgcttcgccacgatcatcgccggaaccgtcgtgatcaacaggagctcgatgatccgcggcttcgtcagcatcacgtagccgcgggctgtccgcacccagctccgagagtcttcgaccagcaccggcgacacccctcctcatcacagccacctgtccagtcattcgggcaggacggcgtgctcagcactcgttatcctaccaaccaggtcgtcatctcgtcaaccggaagcaggctttcgtgcatacgcaagacacatcgcctcggcgttcgctcagcttgaacccagccgcgctcgaccgcgcgccgggtccctccatggttgggcaggtcaggggcctgctgtccggacaagctgcgacgacgctggtcgttgtcgacccagcatggatccgctacttgacgggattcgacggttcccacggcaccctactgatcgatctgcgcgatgaggatcggcaccttctgtgtacggatggccgctacgtcgaggctgcgggtcgggcacttggggcgcgagggctcgacgggctcgttgaggtgctcggagacgaccccctcaccacgtcgcatcaccgagacctgctgcgcgcaccactcgctctgctcggctcgtgttggtcgctctcgaccctacgactgctgatggagatcgatccgactcccatcgacgcacagcctctcctctggccgcttcgggccgtcaagcaaacctgggagctcgagcgcatccgcgcggcagcccgactcgcggacgacgccatggatgctgcccttgcgtcgctcgccgacgggccaatctcagaacgccttctcgcggcgacgtacgagttcgagctgcgtgcacgaggagccgatgaacccgccttcgcgaccatcgtggcggcgggatctcatgcctccgaaccgcatgcgaggccgagcgagcggctgatcaggccaggcgacatcctgctggtcgacttcggcgcaacggtggacggctatcgctcggacgccacccgcacgatgctgccgagcgaaggagcagaccctcgagtccaggcgtactgggacatcgttgcggcggcccagagggccggaatcgcagccgcgaccgtcggcgcgtccgcgcacgacatcgagacggcagcccgcgccgtccttcgcgaggccggcgtcgaagagctcctcctccatggagtcggccacgcgctcggcctcgagatccacgagcggcccttcaccgcgcacgatcgagatcccctcgccgaagggacggtcatcaccgtcgagccgggtctctatgtacccggagagcttgggatccggctcgaagacacgatcctcgtgggcgcagaaggcccagagtgcttgacccggcccgcgaccgagtctcgaacgagaccaggttccgcagctcgcgtgcgcagctaagctggtagctcgcatcgcgcggacgtgcgtccgttgcgcccattcactgttccgcctcggaaggagcccctatggcagtcgctacctcgacgaatgacctcaagaatgggatgaccctggacctcggaagcgacggcctctttacggtggtggagttccagcacgtcaagccgggcaagggcggagcgttcgtgcgcaccaagctgaagaacctccgaaccggcgcggtcatcgaccgtacctaccgagccgacgagcgcatcgaccaagccatcatcgacaagcgggagatgcaagcgctctatcgcgatcaggacggctgggtgctcatggacacgcagagctacgaccagatcacggtggatgcggcgaccctcggatccgcgatgcagtacctgcgcgaagggagcacggtgctcgtcctcagctacgaaggctcgatcgtcgccgtcgaactgcctgctgctgtcgagctgaccgtcaccgagaccgagcctggtctccaaggcgaccgagtctccggcgcccgcaagccagccacgctggagaccggactggtcgtccaggtccccctcttcgtgaacgtgggtgacaccgtcaaggtggatacgcgcaccggcgactatctcacgcgtgcctgaccgacgcgacgactcgcacgacgtgcgcgccgtttggcgcgagcgcgtgctggagctgctctacgaagccgatacgaagggcgaagcgcccgcggacctccttcggggggacgagccagcgttcatccgcgaacggatccgaggtctgacggagcgacgcagcgagatcgacgcacagttgacggcccacgtcatcggatggcagctcgagcggctcgcacccatcgaccgtgccattctccgactggcgaccgcagagctcctggaagcatcgacgccgccctctgtcgccattgcagaagcggtgaaactcgccgaccgctattcaaccgaacgttcggccgcgttcgtcaatggggtcctcgcctcgatcgccgtcgacatcgctggcgagggccaccgcggcgagcccgaccgcgaacccagctagctcgcgacgcgaccgagttcggcacgcaagaagctgggcatgccgctcgtcgagctcagctccacccgttgaggcgagatgccgagctggcgagaaacgctcgcaagctgtgcgttcgctgttgccaggacggtgtccatggtgtgcaggcgccctgcgatcaacgtgacggtgctcatgtcggtcggatgcaccagcagcgtcttcatgtacgcgagcaccgacgctgcgttcgggaacgcccacgcgtagacctccttgaccaccggcgtcaggttgaagtggttcaaggagttcggcggtgcataggtcgccaagttgtagaggtccgagttgaccgcgatggtgcagtactcctcgtcttgttcgatgatcgttcgcgcctcggcgagctggttggacgccttcgagacgatcgcaccgagcgcccgatagccgtcgttgagggcgaccgcacagccccctgcgtcctgctgcatcgtctgcacggcgccgcggaaatcgacgcgctcttgggcaacggtcacgcgctgcgggtacacgatcgcggcctcgatggcgacggacgcgacgaccactgcgccgacgatccagagcaccttgcgacggcgagcaggcgtccggggctcaagcgttggatcagctcggttgacgggtcggggcactgtgctcctccagatcgagtggttcagatcgcgtggcgacggggccgctgctacgccctctcggcgagggccggttcgctctccagtctacggacccacacgcactcgctctcgcaccatctccacgagggcgagcacggcgagttcataggagcggggcccgaacccagcgatggatcctgccacgacgcgcgcgatcgtcgaccgatgacggaatggttcgcgagctgccggattcgacaggtgcacctccaccacggggatcgtgatcgccgcgatcgcatcggcaatcgcgtacgacgtatgggtcagcgcgcccgcattgagcaccacaccatcgaccgatcgaggcgcacgctgcaggagttcgatcacccgagcctcgctgttggtctgctcgaaggtcacggctgctccgaccgaggccgcacgttctccgacgcggcggcgcacgtcctcgagcgtctcggtcccatacacggtcggctcccggaccccgagcaggttgaggttcggaccatcgatgacgagcaggcgcaccgccgtcatgcgcgtgcctcgtcgattgccgcgacgatcaccgcctctggcacgccgtggaccagctcgagaccgctcggtccatcgaggaccatcgcgagtgaccctcggtgcttcttgtccgctgcgagaaagaccatcacctctgcggccccgatccacggcggcacgcgatgtgcgaggccgagacgcgccaccacctcgacgtgctggatcacgcgatctcgcgtgatcctgccgagacgctcggcaacgatcgcctcgaccacgaggccgatcgccaccgcctcgccatggctcaagggccggcgacgcgccaaggcggctgcctcgatggcatggcccaccgtatgcccgtagttcagcagtgcgcgctcaccgtgctcgcgctcatcgcgctccacgacgcgcgcctttgcctgggccgcctcggcaaccgcctcgtcgagcgggagctcgaccagacgatcgaggccaaggaaggcgtacttcgccagctcgccaagaccacttcgccactggcgacgaggcagtgtcgccagcacatcgaggtcggcgacgactcgtcgcggctgccagaaggcgccgacgagatttttaccggcacgcaggttgaccgcggtcttgccgccgatggccgcgtcgaccataccaaggagtgaggtcggcaccgcgacgaagtcgatgccacggtggtaggtggcggcaacgaaacccgccaggtcggtgaccacccctccaccgatggcgatgaggccatctccccgagtggccccggcgctggcgagctcctcagccacccgctccaccaccgcgagccgcttggcgcgctcgccattgggaacctcaatgacaggccagggccatgacgcagggaggggaatcgcggcttgggtcaccacgaaggcctggcgccagtcctccgggacgatctcgcgagagtcctggaggatgccgctcccgaccgtgatggccacctcgtgctgtggcgttcgcatcgagaaccggcgggtcgcacggcctcgcgctgcccacgctgatcggagtgcgctcggaggaccttgcaccatcagcgctccagcgcaccgtcgcgccacggtagcgccgcctcgtgtgcgagatagctctcggcgttgcggcgaaactcggcgatggagtccccgccaaactttctcagggcttcgtccgcgagcaccaaggccaccatcgcctcggcaaccacgcccatcgcgggcaccgcggtcacgtcggtgcgctcgcgaaaggcgatcgaccgctcccccgtggcgagatcgaccgtctcgatcacaggccgattcagcgtcgcaaggggcttcatccacgcggttgccacgatcgggctcccattgctcacaccgccttcgatgcctccagcgcggtccgtcggacgctcgagctgcgaacccacgatggcatcgtgcgcgagcgaccctcgcacgcccgcgacctcgagcccggcaccaatgctgacggccttgacggccgggatcgacagcaacgcctgaccgaggaggccatcgagtcgacgatcccagtgcacgtaactccccaacccgaccggcacgccgtgcgcgacgacctgggcggccccgcccagcgagtcgccaaccttcgcggccgctcgcacctctgcaatcatcgccgcctcgacagccggatcgagacagcgcacctcggaggcgtcgatacgctcgcgatcaccaagcgtcggcacggtctcgacgctcacccgggcggcacccagctgcacgacgtggctcacgatcccgacaccgagaacgccgagcagggccttcgcaacggcacctgctgcgacccgagcagcggtctcgcgtgccgacgctcgctcgagcacgttgcgagcgtcatcgaagccatacttctgcagaccggcgagatcagcgtgaccaggacgtggcgccgtcaacttccgggcggtctggcccggatccggcgacatctcctcggtccacttgcgctcccactccgagttggcgatctcgagcacgatcggcgatcccaaggtgcgtccatgacgcacgccgccgatgatcgtgagcgcatcctgctcgaagcgcatcctcgggccccgcccgtagcccaagcgccgccgcgcaagctcagcgctgatggcgtcgccgacgagctcgagtcccgcggggacaccctcgatgatgaccgcgagcgcacgtccgtgcgattcgccaccagtcaaccagcgcagcatgcgctcaggctagcgagacgccgagcgcactcacgtgagtgccgtgagccacgatcaaagccacgagcgcacccaccgcgatcgctggcccgagaggcaggcggtcacgatggctcccgccgcgcaggagatgccagagcgcaccgagcgcgccgaggctcaaggccacgagcgccgcgaggaccgggacccaccagccgagcggcgcctccacggctccgagcatgccgaggagggcaatatcaccacgaccgagccccccgcgcgacaaccagcgtacgagcatccacgcgcccaccacggcgagcgcaccgccgatcgctgcagccacagcgcgcagcgcgtggggaccgagtccgaagatcacgacctccgtgaccagcgcaccatcgacgagcgagcgcggaatgcgtcgggtctgccagtccacggtcgcaccgaccaccgcgacactccaggcaagcgcctcggcgacgagcgcggcgcccgtcacgcccgaccagctgagccaccacacaccaagacccgccgccacgccagcgccaccatgcaggaacgtcgcccgtcggctcttcaccgcgccccgccgacgggcgagcggtcccacggcacaggcgaccagagcggcggcaaccacagcggctgtcgcccggacaacagcgacggacacgtacgatccgtcgaccgagtgcctccaaaggtttaccgttcggcaagatccgaccactacggtcgagccatggcaccgatgagccagagcgccgacgaccaggactggcgagcattcgacgggctctggaatttccgacccgtcgaggcaatccttgccaacggtcaccgactccgtcccggcaggcttctgcgctcggagcaaccgtaccgactcgacgccacccaacgacgccaactcctcgagcgctacgcgattggcaagatcctcgacctccgaaccgccgaggagtgcgccccgacggagtccatcgacgcgccacgaacgcacctaccgctcccggacgtctcgcgtgacccacgcatcgcagatggttcgcgcaacctggccggtgcctaccgcgcgatgctcgacgaccacgctccgacgttggttcgagccatcgacgccatcggggtgccaacgccggtgctcgtccactgcacggccggcaaggaccgaaccgggatcgtcgtggccctcaccctcgaactcgtgggcgctcggcgggacgacatcgtgcgcgactacgtcgagagcggacgacgtctcgcggcgttgaccgaacgtgccttggctcgcggctacgagccgacgtggcgcgagctcgcgcccgaagtgctcggtgcgcctccggctgcgatcatcacggttctcgagacggtcaaggaacggtggggctccgtggatcggttcctcatgacgttcgggatgacgccaatgcgcatcgaggcgatccgaagctcgctcatcgcatgacgccacgattgcacgcgcgccaaccccaacggctccgcccgaggccggcgtgtgcggcgccgcatcacgagcgctcgcgctcagtcgctcgcgtcgaccccttcaagggccttggcgagcaggttgccaagctggcgcaattcctccggagtcagtcgactgccaagcgcgccgtcaagcgtcgcgaccacaacgggctcggctcggcgcgccaccgtgcgtcccgcctccgtgatcaccgcatacgtcccgcgccgatcggtcgggcagccacgccgcacgacccactcggcttcgaccagccggtcgactcgccgcgacagcgcgctgcgcgacaccaaggcagcatcggcgagctcggacaggcgaacccgtccctcgggagcgctgtcgaggtggtggagcaccaagaactccccgagaccgatgccgcacgcgctctcgagctcacgatcgagcaggtcgacgagccggccctggagaacgagcagcgtgccgaacacctcccgggtcagggggtgctgggctgttcggacaggcgtcgacggcgatactgcttgcatgtgcaactacaactcctatacttcagcatagtcaggaacccatgacacaaggaggaaagcgatgacgctgagcgcacaggatctcggcatcgacacggggcggtggaacatcgacccgacccactcgacggtcgagttcgtcgtcaggcacatgatggtttcgaaggtccgcgggagcttcgagaagttcgagggctacgccgacatcgccgacgacgtcacgcagagcacggtcactgcgaccatcgacgcatccacgatctccacgcgcgacgagaaccgcgacaaccacctccgcagcccggacttcctcaacgtgaccgagttccccaccatcaccttcacgtccacccgcatcgagcccgcaggtgagaactggaagctcgtcggcgaactcaccatccgcggcgtcacccgtcccgtcacgctggacctcgagttcaacggcacctcacccgacccgtacggtgggaagcgtgccgggttctccgcgaccggcgagatctcccgcaaggacttcggtatcgagtggaacgctgccctcgagaccggtggggtcgtggtgagcgacaaggtcaccatcaacatcgagatcgagctcgtcaaggcgtaaggatcgagcgaccatactaccgagaaggggccgggtccgaagacccggccccttctcgcgtaccacgagcgcacggcgggcctcacccggatcccgatcgcggtcacgacgagccggtcacgacgagcgaggtgcgcaaaccagggccgtcgcctacttcttctcaggttggtagtacgggttgttgccggcggcgtgattcgtcacgtcgacgacgtcacgaatctcgggtacggcatctcgaatggcgaccgcgatgccctgcgtcagggtcgcagaagccagtccacacccctggcatccaccacccatcaacacgtaggccacctcgtcgacgacgccgacgagttccgcatacccaccgtgagctgcgatggccgggttgacctgctcctgcaggatgctgtcgacacgtcgggcgagatcgctcgtgagcgcctcgggaccgaactctggtagatcgctctggcgcgtcggggcgttcggattttcaatgacgaggtcgccatcgtcgccgacgtcgagcgtcgcgtcgcgcagcgcctcgatcgacgccgcaggaatgacgacaacgagatcgcccacctcgacgatggcgtctgcaccggacgccatcgccagctcctgcaggtacacgtcgtaggtccactggtcgcccgtcgaaccagtcacctcgatccagagcgcgatcggcgcctccgcttgctcttcggcgatcgccgcagcgacgacctccgctgcacgctgcgacacagccatcagtcccaccgcgcgcctccttccgctcaccactacgatcctatcgacgtggcacgccttgccctcgtggtccccgcgcatagttaccgagggaacgatttcctcgcagctgcaacgccacaccagctcacgatcgtcaccgatgccgaggagccactcggaggtgaccacatcgtgcgatcttcgctctccctggatgcgtccgagacagatcgcctcgcccaggtcctcgtcgagcgcagcgtcgaagcggtcatcggcgtcgacgagtactccgtccagctcgcagccgatgtctccgatcgcatgggactcagccacggccgtggggaggcaatccggcgggcgacacacaaggaccaactgcgcagcaccctcgatcgcgcggaactgccacagccatcgtggcacgtggccgacagcgtggccgccatcgacgtcgactggctcgagcgcgcgctcgggcctggcccgtgggtgctcaagcccctcgaccgaaccgcctccgagggagtcgtgcgcgtcgatgcgtccacactcgcctggggacgcgaccaactcgcagccgtcgtcggatcgcacgcgccggtcctcgccgagaccttcgtaccgggagccgagatcgccgtcgaggcgatcctgaccgacggcgcactcgagatcgtcacggtcttcgacaagccagacatcggcgatggaccgacgttctgggaagcgacgtacctcgctccgagctccatccctctctcagtgatcgaagaggttcgtgtgctcatcgaacgagctgcacgcgccctcgacctccacacgacgccgatccacgccgagttacggctccctgaaggtcggccggtgatcatcgagctcgcgccacgcaccatcggcggacgctgtgctcgagccattcgtctcgacgacggtcgtcatctcgaggatctcgtcatcgagcgggcactcaaccagccacgcacgatccctgcggcccgccgtggtggccccatcggtatctggatgctccccacgccccacgacggcaccttcgagggtctcgacggcgtggaagtggcggcagcgatcccaggcgtcgagcgcatcgagatgaccacgaccgccggcaccacggtgtacgctcccccacgaacccgcagctatctcggcttcgtcttcgtgagcggacgaagccgccgacgcgtgctctccacgctcgatcaggtccgttccgtgcttcgtccccgtgtcgctcccgcttcctagactctgagcggtgaccgctccgcgtaccgacgcagcacgagtactcctcatcaccacctacgacctcggacaccgtccccaactcgcggcgttgctccaggccgagctcgccgaccgactcacggtggtcgacggcaaggccgatgccgcagtgctcgcgagcgagattcgatccgccgactggatcatcctcaccacaccgatgctcaccggcgcgctgatcgccgagcaggtcctcgctgctcacactgacctgctcgccgctcggcacgtcctcctggtcggcgcctacgcaacgacgacgctccacgcgctcggcgagacacaccacgggatcatcgcactcgaccgtgacgatcctgagctggtccttggcgccatcgaacccgagcgaccgctccgccgaggcgggcgtcgtcactaccgcgtgacgacgagcgaaccgctggaccgctatcgacacgccgagcgcaacgggagctggcagctcgccgggtacgccgagaccacgctcggctgccgccatggctgcctgcactgcccggtcgccggcgcgtggcacggtcggatcgtgacgctggacgcgactgacgtgctcgccgacatcgatcgccaggtggaagcgggtgcctcccacctgtcactgggcgacgccgacttcctctcggcgccccgtcatgcgctcgccatcttgcgctcggtccacgaacgtcacccgcagctcagcgtcgacgtcaccatcaagattgccgagctcgcagcggatccaaccctccccgcgcgtctcgccgaactgggcgtcgccttcgtgatctccgcggtcgagtcgcttcgcgacgacatcctcgaccgcctgggcaagggtcaccacgcgcacgacgtcctggcagctcgtgacgcgctcttcgcagcaggcgtcggcctccacccgaccttcatcccgttcacgccatggagccgcctcgaagaccttcacgacattctccgcttcgtgtgggattcgcatctcgaagacgtcgtcgaaccggtgcagtacggcatcgagttgctcgtgccgacgtcgagcctcctcgagatcggccccgagttcggcgacttcgacccagcgacgctgagtcggcggtggaatccgagcgaccctcgtctcgatgggctcgctccgcgcatccgcgccatcgcagcgcgcagcgctcgctacgacgagggcttccgagccgtctgggaactggcagggctcggtgctctgccgtctcgcgggccgcgccgagcacccgcgcccaccttgatgagcgaggcatggttctgctgcgcagcgcctccacgatgaccgacctcgacgacctgctcgatggtctctccgacgcccagcgcgaggcggtcctcgccccggcgcccgttcgggtcatcgcacccgcaggctccggcaagaccctggtcctgacgcgacgtatcgctgctcagatacgactcggcgccgtacgaccccgcacgtccgcagcgctcacgtttacgagagccgccgccttgtctctgcgtcaacgcctggctcgcaccctggatacgaccttgccgatcaccacgacgatccatggtgctgcgctcgtctggctgagcgaactcgctcggctggaggggaaggccctcccaccagtcgtggagtccgaaaccctcgtgcgcgccgcgcttccgaacctctcgccggcggagcacgcggcggtgagagctgccctccgcggccagcgaccgacgtcacccgcgcacgaagcgcacgtccgcgcggtccatgagctccgacgacggcgacgcgtcatcgatctcgactccatcgtcggagagctcgcacgacaactcgaacgccagcccgaacggcgcggactcatcgggatcgaggcgctgttcgtcgacgagttccaagactcgacgcccgaccaacttcggctgttccgcgcgctcctcggtccggatctggccggactcaccgtggtcggcgacccgaaccagtccatctacggctggaacggcgccgacccgaacgtactcaccgacctcgaaccgcccggcttgcgcaccgtgacgctcacgacgaactaccggagccgcgacgagctcgtccgtcacgcgaccaggatcctcgatccgcagccacacgttcgaggagcacgtccaggcggtcgaccacccacgctgcgcggctacgccacgccagagcgagaggctcgagcgctcgtgcgcgaactcggcgggctccacgcgctcggtgtcgcctggcgtgcgatggcggtactctcccgcaccacgcgcgcactcgagcccgtgacggcagcgctcgaggccgccgagattccagccgtcgtgctcggacggacgcgcacggtctcggccatgctcgcacgactgcgctcgctgcgagatcgacgcgcgaccgtcgggcacctgatcgacgagctgagttcgatgcaggtcgacgacccttcgcaccagcacgagctcgaccaagttcgcgacatcgccatcgaactccaccgtgtcgatccactcgcagacctcgcgaccttccaggagatcctcgagcagcggctggcacggcgtctcgacgcggtcaccatcgcgaccttccacaaggccaaaggcctcgagtggtaccacgtccacgtcctcggcgtcggagagcgcgcactgccgcatccgcgagcacggacgagcgcgcagcgcgaggaggagcgaaggctgctctatgtcgcgatgacccgagcgaccgattcgctcagcgtgagctggcatggcggggggccgagtccgttcctcgcaccgatcgtcggtgatcgagcacccctccgccccacgccgagcgcagcggccagaggagccgtcgcgcgccaacgcgcgctgcgccatgccctcgtcgcccaacgagctcgcctggcgcgcagcttcgcgatcgcgccgtcgatgctgctgagcgacgagagcatcgagaccttcgtacgaaccccaccacgatgcgcggacgacgtggtcgcgcacctcacacgcgttccgccagccaggcgccgcgcggtcgctcgcgccatctgggcgtgcgtcagcgcgcctgccgacagctaagcgagatccacgacgagcggtgcgtgatcggaagggcgaggagcccgccgggcctcgatgtccacatcgaccgcaaccacgttgcgcgcgatgtcctcgctggcgaggaccaggtcgatgcgcatccccatcccacgacggaaggcgccctgccggtagtcccaccaggtaaagcccggatcgtcagggtgaagcgcgcgatagacgtcggtgaggccgagcccgaggagcgcatcgagcgcgcgtcgctcgggcaacgacacgtgggtcgcgccttcgagcgcggacggatcccagacgtcgtggtcgctcggtgcgacgttgaagtcaccgccgaccaccacaccgtcggcaaccaggtctgcgagatgtgcccgcagctcggccagccacgtcagcttgtagacgtagtgcggatcatcgagcgcacgaccgttcggcacgtagacactcatgaaccagcccgcctcgagcctgaccgcgagcgcacggggttcctcggtcgccagaggcgctcgcgcgaacccggtcccatagcgcacctcgcgaggagcctcgcgggtcaggaccgcgacgccgttccaggcccccgtgccccagtgggtcacgtgatagccgagcgagacgagggaatcggccgggaactgatcggtggccaccttggtctcctgcagcaggagcacgtcgggggcgacacgctcggcccacgccaccaccaactcgatcctggcgcggatcgagttgacgttccaggtcgcaagccgcatggtcacgcggtcggcgcgatcacgaacatcagctcgacctcggcgacgatcgcgtcaccgaccctggcatgtccccgaccgcgtccggccctcgtcgacagcgaggagagctcgacctccaatcgcagctcgtcgcccggcaacacctggcgccgaaaccgtgcccgatcgaccccaccaaacagcggtagccgaccagcgaagcgctcatcggcgagcacggccgccgcgcccagttgcgcgatggactccacctggtagacgcccggcaggaccggccgccctgggaaatgaccggccaggatcggcaggtcgaccgggacgcgccacctgcccgcggctcggagacccggctcgagatcgtcgatcgcgtcgaggagcaagaaggggggtcgatgtgggatcaacgtggtcggatcgatcgctgccacccgtcctcctcggtcctccccgatcgcgcccctcgccgcgccgtcaccggcgacctcgagcggacctaccctagcgggctaggcgacgtcacgaacctgcgacttcacggccgcgagcagggcaggcgtcactcgcttgagcccgtgcgcactcacgacgtgctcctggatgtgggcgagcagttcctcatccgtcgccgccgctgcatgccagtcgcacagggggatcacatccccgcaccggaactccttcatggttggccctccttcttgacgaacactggatctgtgacccggaccacgccgtcgagcccaacgcactgccgcagcgccatcgccgcgaggaacccaccgaggtctgcgcccggaaggcccacgttgcgctggccacgacttccctgtggcggcacgcttcctaccagcgtcatggtagctcaccgcgacgacgccggaccgaggttggcccaccttgcacccataccatcatcggcgaccgtccaagacgcaccgaacgacccgcgacggcttcacgacgccacacgccgcgccgtcggcgtcgacgaccacgatcggctcgagcgcaccgtcgtcgcgcacgagcgcccgttggagcagcacgtcgagggggtcttcttcgtggacgacgaggggtcgttcccaacgctggcgtcgctcgccgttcgaccaacagcagccgacggccaggggtttgcgccctgtcggctgcagcacccaccaacccgtcggcggtgcgtcggccagtgcgccgatacgttcggcaggctcaaggtactcgccagcgcagctgtcgttcgaacgtggcctgtggacgtgcatgagtcgttcacgcagcacctggtcgagatcgatcggctcgggtgatggacggccaaacaggtaaccctgcgcaagagggatgccgatccgcacgatctcttcgagttctccgtaggtctcgaccccctcggcaaggagccacgcatcgagttcaccgaggaatgcgccgaaggcggatgcgagacgactgcgcgccgcgtcacggtcgatcccgttcacgagccctcgatcgagcttgacgatctccggtcgcacgacgaggagcgccgcaaggcccgcgtacccggcgcccgcgtcgtccatggcgatgatggcgccgcgttcccgaaggaggtcgagtctcgcggggagatccggcaggtcatggagcggaacgtgttcggtgagttcgatgaccaacccctggagcgagggcagtcccacgacggcctcgaaggcgcgcgactcgagcgtcactggactcacgttgatcgcgagaaagtgctcgccgagcagatccgctcgtcgctcgagcgcagcgagcgcacacaaggtctcgagctccgcccccacgccaaggtcccaggcggcagcgatcacgcgatcaggtccgatcctgcccatggggtcgagccgcgcgagcgcctcgtagcccgcgatccgcggaccgtgcaggttgacgatcggctgcaggtgcgtgcgaggagcgatccgacccgtgacgagatcgtccacgaggtccgccaagcttcgcgggcggacaccgtcggagcgatcagcgcatcccactccctggagatccacgcccgcctcctgctcggctcctgtcgcttccagcagtggtgatctcggctgccggagcgcccacctgaagcgacggccgccgcggcgggctcacttggcgcgatgggggcgcgagcctagactgaagctgatggcgagcgcacccgacaacagcactgtgcagcattcggcctccgaacagttcggacccaacgactggttcgtcgaggagatggcggagcgctaccgagccaatcccctcctcgtgcctgagagctggcgtgcgtacttcgagggtgagcgcgtccccgatggcgtggcgacgaagaccatcgccaccgctacggcgaaagagctcgttggcttcgaggctccaggcgtcgcgacacctccgacgacggcgacaccggcgccgacttcgcctccgcacaacggagccacaccccagaccgcgccgttcacccctgcatcgtccccagaagccgtcgacccgctgacgccgccgaggagcagcgctcccgagacggcaccgcacgcgtccgaacccgcagtctccacgacgccgaccgtcccgtcagcacagcccctccgtggagcccagggcgccttggcacgcaacatggaggcctcgcttgcggtcccgaccgccaccagcgtgcgtgccgtgcccacccgcgcactcgaggtcaaccgggcaaccatcaacgatcagctccagcggctcggtcgatcgaaggtctcgttcggtcacttggtcgcgtgggccatcgtccgtgcgctcgtcgagcatcctcggatgcacgcctcctacgtcgccgacgccgacggacgcgggcaccccggcatcgtcatcccagagagcgtgaacctgggcatcgccgtcgacgttcagcgccccgacggcacccgctcgctcctcgtgccggtgattcgcaacgccgacaccctcggtcctcttgggttcttcgccgcctacgacgatgcggtccgcgcggtgcgctcacagcaggcatcgcccgacctcttcgtcggggccaccgcctcgatcacgaaccctgggacgatcggcaccgagcactcaatcccgcgtctcatgcccggtcaaggggtgatcgttggcgtcggggccatcgcctaccccgccgcattccaggctgcagacccacgactcctcggcgaactcggtgtctcgcggacgatcaccctcacctcgacgtacgaccatcgcatcattcaaggcgccgagtctgggcagttcctcgcgacgatcgccgctctcctcgaaggagaacaggacttctacgacgagatcttctcggcactccaggttccctacccgcccatgcggtggcaggccgaccacaccagcatgcagcccgacgcgaccgagcggctcgccaagcaggtccacgtccagagcctgatccaccactatcgggttcgtgggcatctgctcgcgacgctcgatccgctggacctgacccgtcccaccatgagccccgaactcgatccggcaacctacggactcacgctgtgggatctctcccgacccttcctcgctgaagggctcgtcccagggggtcaggcgtccctcgaaaccatcctccaggtgctgcgcgatacctactgccagaccatcggctacgagttcatgcacatccagagcccggacgagaagctctggatccaacaacggatcgagggctcgcaccaaaccctcacgaaggatgaccagctccgcatcctcgcaaccttgaacgacgccgaggcgttcgagaagttcctgtcgacgcgctacatcggccagaagcgcttcggtctggaaggtggcgagtctgccatcgtgttcctccgggaggtcctcgatcacgccgccgagacggggacacacgcagccgtcatcggcatggcgcatcgcgggcgcttgaacgtgctggcgaacatcgtcggcaagtcctatcgcacgatcttcgccgagttcgaaggcaacctcgacccctcgagcgtgcagggctcgggcgacgtcaagtatcacaagggtttcgagggacactatcgcactgcgagcggcagcgagctgcccgtcacgctcgcatccaacccctcgcacctcgaagcggtcgatcccgtcgtcgaaggcatggtgcgcgcgctccaggatcagcgtggcacgctctacgagttcggtgtcctcgggatcctcgtccacggcgacgcttcgttcgccggccagggcgtcgtcgccgagacgctcaacctctcgcagctgcctggctaccggactggcggcaccgtccacctcgtcatcaacaaccaggtcggcttcaccacgaacccatcggaggcgcgctcttccttctacgcctccgacatcgccaagaccatccaagcacccatcttccacgtcaacggcgacgatccggaggcggtggcgcgctgtgcgcggctcgccgtcgagtatcgagcgaccttccacaaggacgtcgtcgtcgacctgatctgctatcgccgtcacggacacaacgaaggcgacgaaccgagctacacgcagcccgtcatgtaccacgtgatcgagcagcacccgtccgtgcgccgactctacgcagatcagttggtacgttcgggtgcgatctcggaggacgaagccgaccaagcgctcgaagcgtacctccagcggctcgcgacggcgcttgccgagactcgcgaggcagcaccccccaagccgaccgagctgccgccagagccagcacgcgacgtcccactcccgatcgtcacgaccgcggtcgacaaggctgcgctcgactacgtgatcgagacgatccatcgggtgccagaggattttcacctgcatccaaagctcgctcgccagttcgagacgcgccgggccctctacgagcagggacagctcgactgggcgctcggggagctcgctgcctacggcacgctgctgctcgaggggcacgacgtccgcctcagcggccaagacacgcgccgcggcaccttctcgcatcgtcacgccgccctctacgactacgagacgggcgcgatggtccaacccctcgctcgcttgcgcgacgacgaggtgccggtgccgcacgcgtccccgatcgggcgcttcatggtgtacgactcctcgttgtccgagtatgcggcgatggggttcgagtacggctactcgctcgtccagcgatccgctctcgtcatctgggaggcacagttcggcgacttcgcgaacggcgctcagatcgtgatcgaccagttcatcgccggagcgctcgacaaatgggaccagcactcgggtctcgtgctctacttgccgcacggctacgaaggacaggggccagaacactcgtccgctcggctcgagcgcttcctcgcgctcgctgccggacccaaccttgcggtcgtccaaccgtcgacggccgcgcagctgttccacctcgtgcgcgcccaggttgcgcgcaccccacagcggccgctcgtcgtcctcacccccaagtctctgctccgtgcgcgtgagacgcgctctgcgatcgccgcgttcactgacggaggtttccagccggttctggccgacccgttggtcgacgacggcgagctcgagccgacctcagtgcgacgactgatcctcgcaagcggcaaggttgcctacgaggcaatggccaagcgagccaagggtgagctcgccgcgccgaccgccatcgtgcgcgtcgaccagctctacccctggccccgtgaagcactcgccgcagcactggcgaccttccccaacctcgccgaactggtgtggctccaagaggagcccgagaacatgggcgcctggccgtccgtccacgagctgctccatcgcatggacctcaatggggcgcggctgcgccacgtctctcgcgtgcgcgctggctctccggcaacgggctccgctgcgatgcacgcgctcgaacaagccgacctacttcgtcgcgcgctcgaggcacccctgccctaggccctcgcatgccgtgctcggctcgcgtgctcagtcgaggcgacgaatgaagtcgcggaccgcctcggcccaggccgctggcgccgacaggtgcaccccgtggggagcgcccctcacacagtaggcctcggcatcgatgctcgccatgagtgttgcaagtcctcggcgatggcgagtccctgccagctcgccgatgcccgcttgcaccgggaccgagatccggtcgaggtcgatggcaacctcaccagcagcgagctcggcgagttctcgcgtgaaggctggggcctctgctcggcgctccgcaaggaagttcggcccgagctgtgcgagcgcagggcccatcgctcgacgcaggaagtcgctcaccagctcctcgaggtctggttcgggaacctcacccgccagcaccgaccgagggtccactgcccacggtccccaccacgccgacgtcggcaggggcgcctcgaagacactcacgccacgcagcgtgggcggaggatcgctcgccaaggcgagtgcgagcgtccctccgagcgaatgaccaacgaccaccgtcgcatgctcgcgccccaccacagcccgcaggtctgcgaggtgcgccgtgaaggtggcgggccccatgtcccgagagcgcgcgtaaccacggcggtcgtagagcacgacctcgagcggtgcgagcgctcgcgcgaagcgtcgaaaggtcgcagcacgatcgagcacgccgtgcaccacgacgacgcgcggctccgagcccgcgaagcgatcgaccgccaagtctcgacccacgctggcagcctacgaggccgacacgcagacccgctccctcgtagactcgctgcgtgcgcgccgtagccccccgaaccctcggcctcgccgaggccgcgctcggcggcggcttggcgctcggccaatggctccgcaggcatccacacgccgcgcgagccctcgtcgtcggcaccgcctacgacctttgcgcgcgggggccagcgggtctcggtctcggtcttgcgattggtgcggcacgtccagccctgcggggcccgatcgtcgcggggttggcgctctcggctcgcagacgactgggttggttcgcaggccacgccctggccgccaccgctgcgctcagcgccgtgcgcgcggtgcttccaggtccgcgaaccgatcggcgagccgtcgtcgtcgtcaatgcgcacgccggctccacgcgcctcacccgacgcgccctgacccatctccatcggctggactcgaacgtcggcgtcatcgtcgctccgcgagatgccttcggcgcaagcctctctgccgctgcccgccagagccccgaggtcctcatcgtcgccggcggcgatggctccatcagcggtggggccgaggtcgcggccgatcacgaggtcgtgctcggcatccttccgaccggcaccggcaacgacaccgctcgaggcctgcgcatcccactcggcccggaggacgccgcgagcgtcgcgatcggcggcgtcgagaccgccatcgatctcgggctcgccggcactcgtttgttcgtccacgctgtgtcggtgggtgtgatcgcgcgcttcgcggaggcggtccagcaccttcgcggccgagcccggccgctgctctacccgctcgccgcatggcgggtctggcgccactacgacggagtccgcctcgaggtgagcgtggatggacaacctgtccactttccagggacgctcgtcgaactcgcggtcgtcaacaccccacggctcggagggcgtcttggcatctcgctcccgccgtcgcttgcggccgacggccgactcaccgccatcgccgtcacccgctcgccgctctcgctgctggtacgatccttggcctccatgatgcagcagaggcctcaccacccgcacgggaccctgctgacgcgcgacgctcgagtcatcacgctcacgagtgccacgccgaccctggtggcgatcgacggggagccaatcgccgagaccccgatcgatcttcgaaccctccccgcccgcctccgcgttcacgtaccggcgcaacctcggcgatggcgtggcgcggcgtcggaccaccgcacgccaggagacgacgaggcagctagacgccagcagcggtgagcgaaccatcccgcaccgcccacgagagggcggcgtgcacggttgggtgctcgaaggcgaagccgcttgcaccgaggacgctcggttcgacacgctgcgacacaaggaggagctcgcgagccatctcggaaccgaggaccacctcgagcaccggagccgggaccgggagcacggccgggcggctgacgacacggccgaggactgcgacgaagtctcggttccgcaccgggtccgggccaacgaggttgactggtccgtcgagctcggtgtcgatggcgtggacgatggctcgcacctcatcgaccaagctgatcggactcatgaactgccgaccatgcccgaagggccccgcgagaccgagccgcgccatgggcaggagacgagtgagcacgccgccatctggagcgagcacgacacccgtacgcgcaaggaccacgcgaccgacgacctcgcgggcccggagcgcctccgcctcccaatcgaccacgacccgagcgaggaatccctccccggcggtggactgctcggtgagcacctcgtcgccacgatcgccgtagaacccgatcgccgatgcgcagaccagcacgcgaggtggactcgtcagctgtcgcaagccacgtaccacagaccgggtgccgacgacgcgagaggcgtagatcgaggaccgaaccgccgcattccagcggcgctcgccgatcggcgcacccgcaaggtgcaccactgcatcgacgccgtcgatcgcgtcgaaccacgcccgctcgtcgttggtcgagaagatcggcgttcccgccgggtccggggcatcgccccgtcgaagcgcgagcacctcgtcgccacgagcccgcagcaccgatacgagcgcccgcccgatcaacccgctcgcaccactcaccgctacgcgcatgtcaccctccatcgtgtcgacactcgcaccaacgcctcggtctaccgagatcatcctggacgctcaggcatatcgttccgcgcgggcgtcgacacgaacgcgaaagcacgtccaggctggccgcggatacccgcggccagcctggaccaacgcacgatggtcgcaacgatcgaaccgtcgcgacctgacgctcacgcttcgtgcgacgtgagcgcatgcgccgaggcgccacgctcgatctggatacggcgcggacgagcggtctcagcgagcggaaccgtcacccgcagcaccccgtcctggtaggtcgcgctcactcgggacggatcgagctccgaaccgaggtagatcgaccgctggaacgtgccggcgaagcgctcggcgacgacgacgtccttggcgtccgcccgcctcaccgcgcgcgcagccttcaccgtgaggacgttgcgctcaacggtcagatcgatcgactccggatcgacgccgggcaggtcgaactcgacgacgtagtgatcatcctcgcgataggcatcgaccggcgtgaacaccgagtaaccctcagtggtcacaccctgcaccatgctcatgagctcacggaacggatccgtacggaacagcaccatggcacacacctccttgccagtcctcgactgtcacgatcgtcgtgacacttacgacaacaccactctagcaaatctattcccaaactgaccattttcttgagtcacttgccatcatgtttcttgaccctcactccccagtaccgaactcccgatggccactagactgtcgatcacgagcagacaacgcctgtggcaggtgggtcgagcggccacgaccatcgcggcccgcgacacccttcgtcgtatcggtatcgcgctcacgccaggtcccagcaaggacgcggcccagcgagcacggacactgcgcacgacgaccgacgtagcggccgccgtcgcgggcatgcgcggcctcaccgtcaagcttgcgcagatggcgtcctacgtcgatcccgccgcccccgacgacgtccgcaacggtctcgcgcgcttccaagacgccgcaccgccgatgagcgccgacctcgcgctcggcgtcctgcgcgacgaactcggcgaacggctctcgcggttcgccgagatcgaagaggagccccgggccgcggcctcgatcggtcaggtccatcgcgccacgctccgcgatggcaccaccgtggcgctgaagatccagtacccggacgcgcgcgaactcatcaccgccgacctcgagcaagcgccagccatcgtcggccttctgcgcttcgcctttccctcgatgcgcgtcgacgacatcgtcgccgaactcgccacgcgggtccgcgacgaactcgattaccggcgcgaggctgccgtccaggctcgcttcgcacgggcctacgccggccacccgcgcatcgtcatcccccgcccgatcggagcgctcacgacgagcagggtcctcgtcaccgaatggatcgatggcgcaccctttgcgagtgctgccaccctcgagcccgaggagcggtccgagatcggcgagatcctgttccgcttcgtcttcgcgagtctctatcgcctccgtctctacaacggcgacccgcatcccggcaactacctcatcctcgacggaccacgcccgcgcgttgccttcctcgacttcggattctcgcgctcgttcaccgccgacgagatggcaaccttcgaggcgctgatcagggcgcgtgtcgtgacgcccgaccgccacgccttcgccgagacgcttcgagcagccggcctcgtcatcggcgacgaccacgacgacgacgtgctgtgggagttcttcgctccctactacgaactcgtcgagacacctggaccgcgcacggtgacgccggcgtgggcctcgggcatccttcgtcacaccttcgaccgatcgcacccgctggccagcgccgtcaacgtgccaccggcgttcgtcgtggtccaacggatcaacctcggcctctatgcactcctcgccgagctcggtgcgacggccgactggcgtgccatcgccgaggacatctggccattcgtcgctcgcgccccgatcacaccgatcggccaggaggaggccgcctggcgtctggagagggctcgatgagacgcaggctctggtggttggtgcccatcggcatcgccgccgcgatggtcggcgcgcgccaactcctcgaccaacccgcgatcgtggtcccggaggctgccgccgtgagcgccggcatgctggtgtgggagttgcccttgttcacccaccggccattggcgaccgtggcgctgatcgatctcgcggcgttcggcggcgtccaggccgctcgctacgtctcgctgcctgagcccgccctcatcgctctggtgacggtcgccatcctgggggccttcgtcctcttcgacctccccgccctgccagcgctctcggcggggctgctaccgatctacctgcacatcgtggtagccgcgtacgtggtggcggtagcgctcaccatggtgcccgtcgcactcgtcgccgaacggcgccaccgagcaagtcgccgccacttcggcacccacgagcttgcccagatcgcgccagcgagcgccgttgcggtgctgctcgccagcctgaacccgttcctcatgcttccgccgctctacgtcgccacgaccgaagcagccctcggcgctcgcccaccagcgggtcaggaggccatccgtcgttccgtggcgctcgcgacgggcttcgccggcgcgctcgtcctccatctcgtggccccgcccctcgtcgtcgcccccgtcgcggtcgcgctcgccgcgttcgtgagcagccagctcggcgtgtcccttccacctgcgatcgcgttcagcctggttcccctcctgtttccagtgaccgccagcacccttctcgccctcggcggactcgtcggcatcgtcgcaaccgccctcgctccgtggctgcccaacgccttcggccgtgcgcggatcctcctcgcctcgttctcgtcgggtaggctcacggcatcggtggatgacgaggcgctgcctgtgggcgatggcgagtaggcgatggacgaacgccacgaggagcatggcgagggagcacggtgaaggcaaccacagcgatcgagcgatcgcacgcgagcggcgagcgctccacgggacggatcgtacgtggcctgatcgtcgcgatgcgacccaagcagtgggccaagaacgctctcgtcgtagcggcaccgctcgcagcgggcagcatccttcggacccacgtcctcgtgccgacagccctcgccttcgtcgccttcgtcgcgatctcggccgcgacgtatctgctcaatgacactgcggatcgagagcgcgacgccgcccacccgaccaaacgccgacgcccgatcgcggccggcatcgtcccggtatggctcgcccttctcacggcaaccatcctcggcctcggggccctcctcctcgccgccctcgccatcaacctggcgacgctcgccgtcctcgcgacctacgccgcctcgacgcttgcctactcgctcaagctcaagcacgaaccgatcctcgacatcgcgatcgtggccggcggcttcgtgctgcgcgccgtcgcgggaggcatcgcagcgcacgtcttcatctcgcactactttttgctcgtcgccggcttcggcgcgctcttcgtcgtggcctcgaagcgctatgccgagctcaccgcgaccgacggcgagagccgcacccgcagcgtgctcgcttcgtactcaccaggcttcttgaacctgactcgggcactcgctgccaccacgacagtcgtgacctactgcttctgggcgttcgagcgcagcgccgggctatcggatggtcgcctcgtgcttggcttgtcgatcgtgccgttcacgatcggagtccttcgctacgccctgctcgtcgagcacggccacggggaggcccccgaggacctcctcaccgccgatcgcacgctgctcgggatcggcatgctctgggtcgcgctcgtcggaggagcgatcttccttgtctaggcatatgagccaacccatcgacgcggcgaccgatcaggccccacccttcgaggagcgttggacgctcctcgaagggtggggccgaacgccccgctcggcggcgtggcttcgcgaagcgacagacgacgccgtcgtcgatgccctctgtagccagggcccccgcccggtgctcgcccgcggcctcggacgcagctacggcgacgcggcgctcgcggcaggcgggatcgtgctggacatgaccagccgccagccggtcgtcaccctcgaccagcatcgcggcgtcgccgtcgtcgacgcgggtacctcgcttgcccacctcgctgcgagtgtgctcccccacggttggttcctccccgtcacccccggcaccaagcacgtcaccgtcggcggtgcgatcgccgccgacgtccatggcaagaaccatcaccgagacggatcgttcggcggctacgtcgagcgactctggctggccacgccggagggcatcgtcgagctcgcgccacccgatgagcgtttctgggcgaccgtgggcggcatgggactgaccggggtcatcctccgagccgccgttcggctcatcccggtcgagagccgcttcgtcctcgaccgagaagtcgcgacgtcgtccctcgacgagaccatcgaggtcctcgccgacgacagttcggttcgctactccgtcgcatggctggacgcgacggctaccggagctcgcctcggccgcggcctcgtctcgttcgccgaccacgcacccgccgacgcactcccggcctcgctcgctcacgacccactccgactgccgcgcgagcgaacgctgcccgcacctccagatcgcatcccctcagggctgctgtcggtgcccacgattcgggcgttcaacgagctgtggtaccagcgtggacggcgtcggccggagacggccctcgtcgacctgcgctcgtacttctatccgctcgacgccgtgaacggttggaaccgtctctacggcccacgaggtttcgtgcagtaccaagtggtcgtcccgaacgacgccgtatcggtgatcaggcgcatcctcaccgacctcgtcgagcatgggcatccgtcgttcctcagcgtgctgaagcgcttcgggccagcggggaacggttggctctcgttccccaccgcaggctggactctcgcgctcgatctcccggcgcgccggagcgacctcgagaccctcctcgtgcgcctcgacgccctcgtgctcgaggccggaggtcgcgtctacctcgccaaggacggacggcttcgacctgagtccgctcgggcgatgtacaccaggatcgacgacttccaagcgctgcgtgcacgcctcggtgtacgaggcgtcatcagctccgacctcgcccgccgcctgcacctcgactagcctcgtggcgtgctcaacgccaacggtcttccccaacagctcctcgtcgtggggggtgggtccgatctcgcggtcgcgatcatcgagcgcctcgcaaccgacggccccctcgaacgcgtcgcgctcgccggaccgcggccggccacactcgaacgcgctcgcgaccggatccgtgagcacctcgacgaggtcgccacgttccacctggacctcgccgatccacgagcggtaccgagcgacctcgaaccagccctcgagtggctcggcagtgtggatgccgtcctcgtcgcggcaggtgtcctccccgaccaacacgctgccgaggccgaccccgccatcgtcgcgaatgcctttgcggtcaacgccaccggacctgcggtggcactcagcgtgctcgccgatcgcctcgagcgggccggcaccggtcagctgatcgtcctctcgtcggtcgccgccacggtggtgcgccggcgaagctacgtctacgacgcgtcgaaggcggcgctcgatcgctttgccctcgggctcgccgatcgcctcgaaccggcggtcggtgtccacatcgtgcgcccgatgttcgtcacgacccgcatgaccgagggtctcgagcgaccaccgctcgcgctctcgcccgaacaggtcgctcgcgcaaccatcgcagggatccaggctcgccaacgagtgatctgggtgccccgggccgccgcgctcggggtcatggtgctcagcgtcctgccgcgcaccgtcctccgacgtctcccgatctgacaggcaacgtccctcttaccccgcgaccgcggtgcccccgaccagatcgacgccgccaggcgcaggggcgctcggggcgccgccaagccccacgatggcgccggaggacaacaccagttcgagaccggcacctgcgcgcgcagcactcaccacggtggcagagccgacatcggcgctcgcgaggtccgatgcatcgccgaaggcaaagacatcgccgttcgcaagcacgagccagtagccctggccgtcggccgtcggcacgagcgtgaccactggggcagggagcgggtgcgagccgccgaggcctgagtagccggcactgtaggtattgccgtagaagtgggcgtcaccgaagccaaagacgccgccgtcggcggccaccaaccagtagccctggccgtcgggggtggggctgagcccgacgaccggtgcggcgagcgggtgggagccgccgaggccggtgagacccaaggtataggtgttcccgaagaagggtgcgtcaccgaagccaaagacgccaccgtcggcggccaccaaccagtagccctggccatcgggggtggggctgagcccgacgaccggtgcggcgagcgggtgcgagccgccgaggccggtgagacccaaggtataggtgttcccgaagaagggtgcgtcaccgaagccaaagacgccgccgtcggcggccaccaaccagtagccctggccatcgggggtggggctgagcccgacgaccggtgcggcgagcggatgggagccaccgaggccggtgatgccaagggtggcggtgtcaccgagactggtggcaccgtcggcggccaccacggtcccatccgccgtgacgccgcgaagcccgacgttccccgtcggcgacgacgatggtggagcaggcgtcgttggcgaggtcgtcgtcggggtggtcgccgactgcgcgttcgtcgccggggtgccgaccgccgcgatcgcgcccaccgcaccgccagcgggtgcggtggcgccgatgctcacccctccatcgaagccgacgagggcgcccgacgacaggacgatggagtagccctggccaccgggaccgggcacgagtccgatcgcgctcgccgttcccggcgtgagcgatccgtagctcggcgcatcgccgaagccgtagaccgtaccgtcggcggcgagcagccagtagccctggccatcgggggtcgcgagcatggcgacgatcgggctggcgggtgccgccggaagcccgccgaggttcgtggcgtcgccgaaggcgagcacggtgccgttcgcaagggcgagccagtagcccttgccgtcaggggtaggcacaagcgccacgacacgcgctggcagcggatgagcaccgccgaggccggtgaagccgcgcgtgtaggtattgccgtagaaacccgcgtcaccgaagctgaagacgccgccgtcggcggccactaaccagtagccctggccatcgggggtggggctgagcccgacgaccggtgcggcgagcgggtgggagccgccgaggccggtgatgccgagggtataggtgttcccgaagaagggtgcgtcaccgaagccaaagacgccgccgtcggccgccaccaaccagtagccctggccgctcgggtcgcgggtgatcccgaccacgggtgcagccagggggtgggagccgccgaggccggtgatgccgagggtagcggtgtcgccgagactggtggcaccgtcggcggccaccacggttccggctggggtggtctcgagcaccccgttgccgaggctcggcgactcgggcggcgtcgggggcggtgcgggggctgaggcgctcgcgtcgttcgagatcgcgatcggtccgctcgcgacgaaccaggccgaggggagtccgagagcaccagcgaacgttgcgcccgagacggtcaccgacccgttcgtgccgctcacggtgatcgaggtcactcgtccgccgtcgttaccgagcccgttgcgcgcatcgaccgcgagtccggtgggtgtgccgatcgaggggaatgcggcctcgaccgacgcgagcgagacgctctgcgtccaggggttccaggggttacagatgttgccgtagcagcccgcatcgtagggatcgggaacggcgggaaacgtaccgggtgccgtgtaaccgccatcggaggccgagtactgcgtgaacgcaggcgctccggaggcggtcacgagcacctcgtgcgccgtgtccgccaccgcctgctcgaccagcggccgatacggcgcgctcaacccgttgttcacaccgccgtagacctggcacgccgaggtgtcgcagatggtcgcgaacccgtagccgttgccgaccgcgagcgcataggttcgggcctcgacggcctgagcctcgagcgcctggaaaccccatggttccccttgcggaccggaagcgccgaggaggccccatgaggccggcatctcgttcgccaccacaccgagcacgtaggactcgagcccgagctcattgacgagcaccatctggcccgagccatcctggagcacctcgagttggccgcgatagctccgctcgctgccgccgggcccacaccacacgagtgccgacgaggccggctcgtcgacctgctgaccgaccggcggcagcgacggcggcgacacccacagcgaaccaggtgcgctcgtgaggttactccaccctcctggggagccgcagcccgtggcggcttgccccaccgccgcaaccatggtgccaccctgatccgtgagctccaccgggacgttcgcaccgacgctgacgccaccgacgctcaaaccggatggatcgaagacgacaacggggcccccgttggcctcggtgatccagacgcgcactgcctggtcggcagccgtcgtgagcgtggtcccaccgtagaagtgcgcgaggatggcctgataggagtcctggcccacactggcgtagccgatctcgccgaactgcgaagcgccggagcctccaccgacaccgaacccggtgaaggtgagctcgccgctggtcgacgttggcgtcatcgccggtgcatgcgccggcgccgcgacaagggctccgagcgcgatcgctgcgcccgcgagcggaatacggcgccctccgacgcgcacgctggtcctcggcaacctctgccccctcctgcgtgagccctccttggccgagccgagcgcgccttctcgacgctcggcccacactacaccatcggcacgcgccggagcggtcttgacggacgtagactccaaggcgccatggcctctcgcgacctcaccgccaaggacctcactgcaagggaactgcgcacccatctcgacgagacccgagcagcacttcgggctcgccttgcgccgtcgctggagcggacgttgcgtgaagcgctggtcgatctcgagccgctcctcgggccccgcgcgcttgccgaacggttgcggcgactcgcggcggcgtcctatgtcgaggccgacgtaccgacccaatcgcgaatcccggggctcgccgtcgtcaagcgcggcgtgcacgctctcgtggcgtggtacgtccgtgcgatcgtgcagcaggtcaacacctttgccttcgagacggccggtgtcctcgaagcggtcagcatcaagctcgacgagttcgagcggcgcctcggtgccgtcgaggctccgagcgtcgcaccggccacggccatcacagtgccgtggcctcccggcgcgaacgctgcgatcgtggcggcgctgaccgaactcgagccgggggctcgcgtgctcgtctcggacgcgacgaacgacgacctcgcgaccgccctggccgccgcaggcctcgacgtcctcggcacctcgctcgatcaggaggcggccgatgcactcgccgccgacggtatcgacgtgcgcatcctcacgatgaacgaactgctcgacgcaacggcgcccggatccatcgatgcggtcgtgctccgaggcaccgaggtcgagttcagcgacgtcaccgccaagcgtcgcctcatcgcatcggcccggcgcgccgccaagggtcccgtcgtcctcgtctggaacgagcccgagcgcctcgccgccgaaccgagccttgcgggcgtgctcgcgctgcaccctgggccgttgcccaaggcggcgtgggaactcctcctcgcagagcgcggcgagcggcccgtcctcgcgccggtcgccgacgggctcaccatggcggtgctccccggctgatgagggttctccacctcgtcccgtcgctcgcgccccacgacgccatcggcacgcacactcggctcctgcacgaagcgctgctcgctgccggcatcgactctgagatcgtcgcagacgaggcactcgacggcgcccaggccacgccgttcgccgcgcttcgtcgacggcggctcgatgccgccaccgtggtgtggtaccaggcatccacgacctcgccgatggccgcatgggttaggactcaggtccgtgcacggcgcctcctgacctaccacaacgtcaccccgtggcagtaccaggagcagaccaacgtcgaggttgcccgtgccctctggagggcacggggcgaactcacgcacctcgcgccagccgtccaccttgcgagcaccgtctcgcgcttcaatgcccgcgatctgaggcgactcggggtcgacgaggtgcggatcctgcccccactcatcgagctcggtgagcccgcagagcctgcgccggcccggccatctggctcgcgatggatcttcgtcggtcgactcgtaccgcacaagcgccaggatcgcctcatcgcagcgctcgcgatctaccgtcgcacgatcgacccctcggcgacgctcgcgctcgtgggcaaggcgaccgaaccgagctggcgcgcgcgactcgtcgacctcgccgcggcgatcggcgtcgaggcggccgtcgagttcatcggcgacgtcgacgagtcggggctgcgtgccgagtggcgcgaggcgtccgtgtacgtctcggcctccgatcacgagggttttggcttccccctcatcgaggcgatgagcgctggcgtgccggtggttgcgctcgcgcgtggcgcggtcgctgagaccatcggacgagcgggcctcctcgtcaccgacgaggcgccccgagcgctcgccgaggcggtcgccctcgtcgagcacgacaccgaggtgcgttcggcgctcagcgccgaggctgctcgacgacgcgctgcactcgatcccgcgcgggtcggccccctgtatcgagcgctggcctgggaggcggccgggtgagggtgctccagttcgtgcctgccctcctcccgcacgacgccgtcggcaacatcgtgcgcggtctcgacgagcgactccgcggcatcggcgtctcgaccggcatcgtggtggcgggcgaccgaccgcctccgggcgcaaccagcgttcgccacacccagctccggcctgacgacatcgtgctctaccaccttgcgagccgctcgcccgagggtgcgcgtctggtcgctcgccacccgaacgtggtcgtgcactaccacaacatcacccctccggagctactgctgccgtggctcccgacggacgcactcgagctccagctggccaggcgtgaggccgcgcgcatcctgcgagctgctcggctcaccatggcggtgagcgcctacaacgcagacgacgcccgttccctgggggcacgtgacgtcgccgtcaccggcaccctgtcgcgccacgatcagctcgtcgcagcaccatcaaccgaggtcctcggatggctgcgcgcagaccgcgatcgccgagggtccccgcacgactggctgttcgtcggacgcctcacaccgcacaagcgcgccgaggatctcgtcgccgcgctgttcgcctaccgacacgccaccggcaccgacgctgcgctcaccatcgtgggacggccggcctcgcgacgctaccttgcccatctccgtcggcgcgtcagcgtgctcggactcaccgcccgcgtccgcatcctgacccatcccctcgcaccacgcgccctggcggatcactttcgagcggcgagcgtctacgtcacggcctcgcgccacgaggggttcgggctgccactcctcgaggcgatgtccttcgggctgcccatcgctggcctcgcggctgcagcggtcaccgagacggtccagacggcgggagtgctcgtcgaccgcgccgacccagtggagctcgccgccgcggccgcgacggccgccgagctcgggccacgtcttcgtcccgccatggacgaacggctccgcgcgtatgacagcgacgccgccttcgcccgcatcgtcgagggactccggagcgtcggcctcgaggtccgagcgtgagggtcctgttcgtcacgcctcgttggggtcccgacatcgcgggcggtgccgaacgagccgcgcgcgcctggggggtggccctcgcccggcgcggccacacggtccgggcgctcacgaccacggcgaccacgctcgactggtccccggtcctcgatgccggtgagaccaccgacgatggcgtcatcgtcgagcggcaccacgcgaccgctcgcgacggcgacatcgatcgcgcgcttcgagccgtcggaccgctcgccgcccacctcgagcgcaccgctgcgcgccgactcatcgagcgtcaagggcccgtcatcgacgggatcgaggatgcagcgcaaaacgccgacgtcgtcatcgcctatccgtacctctactggaccagcctccgcgcgaccgaggtcgccggtcgccggacggtggtccacccggctgcgcacccggagccgctcgtcgcgctcagcgcactcgaacccgtcttcaccgcgcccggcgggctcgtctaccagacggcgagcgagcgccgcacggtggaagcccactggccaacggcgcaggtgcgctcgctcgaactcgcacctccgctggtcgcgtccgcgcgcgagcgcgtgccgtgggacgcacgaacgatcgtgctcgcggtcggacgcttcgagcacgacaagggttccgaggccctcatcgcactcgccgaggcacttcccgacccgttgcgagtcgtcgtggccgggcccgttgtcgaaccgccgcgacgaccgagcccgctccagaccctcggcgttgtcagcgacacgagactcggccagctccgcgccgaggccatcgccacggtgatcctctcacgctacgagtcctactccctcgctgcggcggagtcactcgccgccggggtcccgatcgtcgtcaacggctcgaacgacgtgctcgtcgagctcgctaccacctccggtgccgggatcgtcgccgcggacggcatcgacgtggccgcagcgatcgtagccctcgcgaccgatcgcgagctggcgtcgcgcctcgagacagccgcactcgcctgggcacagcaacgcccgggtgccgacgaggccgtcgaacgctacgaggccttcctcaccgaggtcgctgcgcacgcgcctactcggcgaagaagctgacctcggtcgccacgaggccgcccacaccgaggtgttggtcgacgatcttcagggcggtatcccattggcgccgctcgaggagctcgccgctacgcgcctcgacgacgctgagcgagagctggtagatgccgggagcgagcgggacgtcggcgacctgaaccaagaacttgcccgcgccgtggacgacgaagggatcgagtcccatctcgcgcgtgtgtgcggtgagcacgggggcgccctgaggactcaccaccgcgagctcgaggtgcaccggggtcggacgcccgtcgcgctcctcaagggcgaaacggagctcgagcgggctacgcgcctcgagcgtcaccggctggtccacgacaacaccgttcgcccggaggtcctcgaccacgacgtggcggggcgcctcgtcgagctctgcgacgaccggtgcctgggttccgagcccggagcctgccaactggagctgcgtcagcagcgagatcgcctcctgtgtcggtccaccgcccaccaggcggccgtggtcgagcacgaacgccgagtcacacaccgcgcgaacgagctcgggcgagtgcgacacgaagatgatcgtgcgaccctcggcctggaactcgcggatcttcgcgatgcacttggcctggaaacgggcgtcgccgaccgcgagcacctcgtcgacgaggagcacgtcgggatccatgttcacggccaccgcgaagcccagcctcgcgtacatgcccgaggagtagaacttcacctggttctcgatgaaggggccgagctcggagaactcgatgatgtcatcgatgcgctgatcgacctcacgccgcgacatgccgaacaaggtcgcgttcaggtagatgttgtcgcgccccgacaggtcggggtggaagccggctccgacctcgagcatggccgcgacacgtcctcgcacggcgacctcgccgcgactgggcgtcaggatgccggcgatgcacttgagcagtgtcgacttcccggatccgttgtggccgagcagtcccaacgtgtgaccctgctcgacgtcgaaggtgatgtcgtcgagggcggcgaacgactcgtgaggcacacggccccagtggacgaatcgctccttgagcgacgtgtacttctcctggtagagacggaagaccttggtgaccccgcgtacctcgaccgcggtctgacccaccgctagagctcctccgcgaagttgccttcgagtcgtccgaacgcccacagggcaaccacgaagagcacgacaccagcgacgaggacgccgagcacgccccagaagtaccacatcgggcccgccgtcggcaagatctggacgacggtgtgcgacgcgaccgagtagggatccgtcttggcgtagaacgtcctctggaacgcgagcacgaccggcgtcaccggattgaggagatacacccagaccgggatgtgatggtctgcgaacttgttcgcgacgagttcgaacgcgtacacgacgggggttgcccagaaccaggcctggagcaggatctccatcagatggcgcacgtcacgcaggtagaccgtgatcccagagacgaggatgccaaggccggaagcgaacacgagcagcgcaacgagcccgatgagcgccacccacaggtagctgaccgacggcacgacttggaatacgacgaggaacaccgcgagcaccacggcctggaacacgaagaagaccgacgcggagccgaccgaggccaaggccaggatctcgcgaggaaacgcgaccttcttgacgagtcccgcgttgtccacgactgcgccggtcgcgcccatgatcccggtctggaagaggttccagcagaggagcccggtggcgaggaagatcgcgaacaacgggatgccagaacccagcaccttctggaagacgatgtagtagatcaagatgaacatcgccgggttcaccagcgaccacaagaacccgaggaaggagtccttgtacttgacgcggatctccttgacgatgagtccgcgcagcagatcgcggtagcgccagatgttcgcgagccgctccgtcaccgacacgcgcggccgcaccagccgtatggcgagcgcgcggttcgggtcgtagcgcttcgtgtcgccaggctgggacgctgggagatgggtgtccacccgcgccctcacgcctcggtcgacgaagcgctgcgctgtccgtaggacttcgtgcgaatcacttgatcgatgaagccatactcgagcgcctcgtcggcggtgaaccagcgatcgcgctcggaatcggcctggatccgctcgaggggttggccggtgtggaacgcaatgcgctcggcgagctggcgcttgaggtacgtgatctgctcggcctggatcgcgatatcggccgcctgtccctgcatctgtgcgagcggctggtgcatgaggatgcgcgcgtgcggcaaggcgtagcgcttgccatgcgtgccggcacacaggaggaactgggccatcgaagccgccatgccgatggcgatggtcgagacatcgcagctgacatattgcatggtgtcgtagaccgcgagcccgtcgtagatcgagccacccggcgagttgatgatgaacgagatatcgcgttcgggatcctcagcagcgagcagcagcagctgcgcgcagatctggttcgccgaggcctgggacacctcggtcccgaggaagacgatccgctcacggaggaggcgctgaaagacgtcgccaccagcttcgataccagcggcgtcggcaagatctcggacagaaccctcgacaagggcaggtagggccatgcccgctaggctagcgtgcgttccccgacgggaggctgacggggtcgcgactcgacgtcgaacgcgggcgtggcgaaattggcagccgcgcgaggtttaggtcctcgtgtcgtaagacgtgggagttcgagtctccccgcccgcaccggtcatcggcggccggcgcacagccgatcttcagcgtcaccggtcgcgatcagcgaaagctctcgcccagtcggcgaagccgacgagcgcccgccttcgatgcgacagcgcgtccttccactcaccgagttcggcaaacgttcggccgtcgccaccgagcgggatgaagatggggtcgtacccgaatccctgctcgccacggggctcgagtgcgatggccccctcgacgacaccctcgaagcatcgcggcgggtcctcgtcgaccacggcgcacaccaccgccacgaagcgggcacggcgactacgcgtcgatccgagctcctggagcacacgcgcgatacgctccgcatccgtcggcccatagcgagcggagtagatgcctggggcaccgtcgaggccgtccacgacgagtcccgagtcctccccgatcacgatcggcgctcgcccgcgtcccgcctcggccttgatgatcgcgttctcctcgaaggtcgacccggtctcggcgacctcaccgacgtcgatccccacgacctcgaagtcggtgaggatgcgtcgcgcttccgccaacttgtgcgaattcgaggtgacgagcccgaccctcacgcgagctggggtcctcgctcgaggagctcgccgatgccgcgctccgccagcttgaggagctcgacgagggtcgccttcgcaaagggcgccccctccgctgcaccttggacctcgacgtagcgaccgccgtcggtcatcaccacgttcatgtcgacgtcggcgcgcgagtcctcgtcgtagtcgagatcgaggagcggctccccgtcgacgacgccgacggacacggccgcaagacgaccggtgagcgcagctggctgcacgagaccgccctcggcgaggcgctcgagcgcgcgctcgagcgccaagaagcccccggtgatcgcggccgtcctcgtgcctccgtcggcctggaggacgtcgcagtcgacgacgagctgatgctccccgaggcgctcgaggtcgaccacgctgcgcaacgctcggccgatgagccgctggatctccacggtgcgcccctgctggcgcccgcgcacggcctcacgggccgtccgtgtcggcgtcgaccccggtaggagcgcatactcggcactcacccatccccggccctgcccccgaagccaggccggcacgcgctcctcgagcgagacggtacagagcaccgcggtacgacccatacgcatgaggaccgatccaggcgccatctcggtgaagtcaggtgtgatcgccaccggccgcagctcggctgccccgcgccccactggccgtcgttccacgtcgcctcctcgctgcgtccggcgacccacgctaggcgctacgcgtgcgccggcactccagcgcctcgacgggcacctgctcgatcgcgccgagctccccagggaacaggcgaccgccgatctcgcgaaagacgacagggtccccgctgcaggcgacgcgcaaagagccgacggctcccgagcgtgccagtccatccgcaccgagtcgctgtgcgacctcgaacgccgcctcctctgccggcgacacgagcgtcacctgctcgccgaccaccgcttgaatctcgcgtgcaagatagggatagtgcgtgcaccccagcagcaacacctcgacccccgcgtcgacgacgggcgccagacgatccgcgatgaccgctcgtacggccggaccggtcgtctggcctgcctccacgaactcgacgagtccaggacaggcgacggcgacgcccgcatcgtcggcgagcgcccgctggtaggcgcccgaggcgatcgtgcgctccgtcccgatcacgccgacacgaccggacccgacgcaccggcgcgccgcgcgcgcccccgccccgaccacgccgatcaccggaaccgcaagctcggcccgaagcgcatcgagtgccacggcggacgcggtattgcaacccacgacgacgagtttcgaaccggcctcgtccacgagccagcgaccgatctcgagcgagaaccggaccacctcgtcggcaggccgcgatccgtacggcgaacgagccgagtcgccgaagtagacgagatcctcactcggcaatagatcgcgcagcgccgcgaggatgttgagcccgccaaaaccagagtcgaagacaccgatggggccgtgcgcgcgctcagccgccaccgctcgacgctccctggaccacctgttcttctcgaacgagcccgcggctgatgcgataggcgcggatgtcgactcgaggacgcgcaagcgacgcgatcacgtagacccaccgatcgtcgaccgcttggcgtacgtccgtcggcgacgggaacgcctcggagtgggtgtgcgagtggaacaccccaacgatctcgagcccggcacgctcggctcgctgctccgcgcgcagcacatcctccggggccatggtgaacacccgtgccgagtgcgcctcgttgcgtccggggaacgcctcgacgatggcacggtcgtcgccgagcagcaggccacacgcctcgagcggataggtacgaaggcagtgcgcagcgatcgcatcgagcaccccatcagccacgcggaccacgacaccacgctaccgcgcaggcaccggccccccgggcaccaggagccggagctatgctgagcagcgctcggcatcggcgaacgaggaggcagacgcacgtggcacggcaaggcgcgcgtcctgcgaaggcgcagcagctcggcggcgtccgcgtgctcgcccagaatcgtcgcgcgcgtcacgactacgacgtcctcgagaccttcgaggccggcatcgtgctggtgggcagcgaagtcaaggccgtgcgcgagggtcacgtccagctccgcgacgcctacgcccgcatccgagatggcgagctcttcttgttccaggcagtgatcagcccctatcgacacgccaccggctttgggactcacgtcaccgaccgccctcgcaagctgctcctccaccgcgacgaaatcgatcgactccgcggccgcttggagcaggagcgtctcacactcatcccactctcgctctacctgcgcgacgggttggtcaaggtcgagctggcgctcgcgaagggccgcacgctctacgacaagcgccacgtcctcgccacccgcgacgcccagcgcgaggtcgagcggctgcgctcacgctatcgacccaatcgcagcgcacgctagactgatcacgccacagcgagtcatgagggggctgcgcatcgcagctatcggtcgcgttgttggcatcgacaagggggtgtaccggattcgactctggtcgacgagatggtggaagcgagccgtgctcaccggatgcacgtcaaacagccggtgcaacaataaacgccgagcctgagctcgcactcgccgcgtaacaccggcgacggcggacggcttgcccgtgcccgcgggctgatcccgtcgtcatcacagggcacttaccgtttcgcagctgttggcgctgcctagcgggacacctcgccaacacaacctcaggggacgtgccaggtcgtccccgaggatctcaacctggctgcgctcggagaagcaccatcaaggagccagaggacgcgggttcgactcccgccacctccactgatgttacgaaaggccaaccggtgtccccccaggaggaggacaccggttgcgcgttcgggccccgttcgcccctcgtcggtacgcgatcgcggctcgcgggcctcaggcggagggaaaggcgccggtcgggagtgattgccacccggtcgatcaggtcgcgcaggagctgctcgacggtgtcagggttggcgacctcgacgatccaggagatctgggcgaagagggcctcgagccgcttgcggtctgggaaccgaggagccgctccgctcagctggctgggcaaccgttctcggtggacgatcagttcatcacgctgttcgatcagctcggtgacccggggcaagcagaccgccgccggcatgtcgccggtctcgaaggctcgcaggtcgtggtggctggccccctgcaacgaggccgcggccgcgagttcggcgagcaccgcgcggcgaagcagatcctcgggaggctggtcgagggggacagatgctgaacaagggtgccaccgtcgccgaggtcgcccgcaccttcgcacatcgccgagaccacctggtaccgctggaaacagacctacggcggcatgcagggcgcggacctgaagaggtcgaaggagctctgcgccgaaggccggcgcctgagacgctggtcattgatctcgccctcgcgaacgacaggctctgacgagctggccgaggggatcgtctgaccccggaccgcaggcgaggcgccgtgcgccggctccaccagcggctctcaggcgtccgagccaggggcgtgccgagtgacggtccagccacgagccacccggcgccgaaggtcgacgaggcgctccagcggcctcgacgaggccatcggcgagatcctgcctgccttcgcgctgccgacgaacgcaagggacaccccctcaccgagcgcacgatcggtcacgcagatgccagatctgcctccacgacgctgcacgtcggcgcaccacgcctgctgccggacatggtggcaccatcggctccgtcgggaacgtcaacgacgacgcactcgccgagaccgcgagcggcctcgcggcgaccgaatgggtgggcccgggctcacccgccacgtgtggccctctggccggcctcacgaaccttgaggaggtgacctcggcctggatgcgccgctccgccacgacgaggtctatgcaccggctggggcaccgtccgccggtcggggtcgagtatgagtacgatgatcgccgagcgcgagaccgttcacacgtcacggcgtgtgcacggaacctgggggcttcaccgtgcatcgcgtgggccctgtgccgatcccgcgctgtgcgtgagtccccgacgatgctgcgacaccaaggaggaagcgtgcgtccgaacgccgtcatcatcggccttggccagctcggccgttcccttgccgaaggactggtcctcgcaggctggaccgtgacgggggtccggcgcgatcagacggcgagcgagcttgctcggcccgacctcgtggtcgtcgccaccggtgaggacgatctcggcccagcgctcgagacactgccgcccgactggcgctcgcaccgggtcgtcctcctccagaacgaactcctccccgaccagtggcgtcgccatggcatcatcgatcccacgatcctcgtcgtgtggttctcccgcaagcccggcgagctggtacgggagctgcggccctcggtcgtcgcggggccgcacgccagcgcgatccgcagcgcgctcagcgccctcgatctccacgccgtcgaggtcaccccatccgaggtgatcagtgccctcgtcgagaagaacgtctacatctggtcgatgaacctcgcggcactcctcgtccccgacccgaccacgagccgcgtgctcggcgagtttcgagacgtctacgacgcgctctgtcgagagacggttcacatccacgaggccgcccttggtcatccgatcggcgacgtcgcggcgctgtgcgacggcgtggccgccatcctcgccaacgagggagagcggcgcctcggaggccgcagcgcgaagcgccgagcggagcggctcgccgcgctcgctcgtacactcggcgtcgacgcccccaccgtggctcgcgctgccgagagcgcctgagtcacgcgacagcttcggacccgtcagggcgacccaggctcggcgaggaagaccgcgacgaagtcgcgccagaacggcaccagatagtgcgtcggcgcctgcgccatggacggcaacaggttcgtcgccacgagtccgttcggcccctcggcgaaggtcgcaaagctcacccagtaggggttgatgtcgagctgcatcccacgaacggcaccagcccacaccagcatcgagcccagcgtcgctggcgacagtcctgggccaccgacccacacgagattgccgtgcgaggtgatgccgaggccgctccgccaggtcgcgagcagattgccgagcgagtagccccacgtcacgaggggattctccgacgccgtcgggagcactgctccgtgatcgaccagcaaggtcaagttctggcgaaccgcgctcacggccggactcggaccgacctcggagccccacgcaccaatctcgactcgcccgttcgtcagctcgacgagtgacgcggcaccctcgacgagcggggctcccacgacgccatcctgctcgaagccaccgttcgaaaccgcgaactggaagccgccctcgaacgccgcgacgagattggtgaccaacgaggggggcaccatgccctggtaccgaaagctcccaccgggttgggtcgtgcccgcgaagagctgcacgacagcgtgtgcctgatcgatccaggccaccccgaccggagcggcccccggcgacggcgccacctccgaggtgaataccaccgcgccgcccgagccgaccgcccccgctggcgtccacgtcaccggcgcacccgtcgggccgacctcgatccggggcatcggccacagttgctcgggggcgccgccccccgcgatgggcccggggtgtgcaaggcgggtcacgccgctcgccgcgtcggaggccgccgggaccgggggcggcacgcgcgctggcgacgagcccttagcacgtgcgctccgtgcgctagtgccacaggcagcgagcaccccgcacgcaacgaccaggcaagcgccgccgtagcgccgacgtcgcgccatggcctcagccgtccgtcgccatcgggcgagtgcgaggtcaggcgttcatgaatcggcgcacagcgatggccgatcccgccgtaccgaccacgatccccaccacgaggacgatgccgagcgtcccgatcacgtcgccagtggtgaggacgaagccggacaggaggtggatctggaagtggctcacggcaaagctgatcaggtcacggagtccgaccacgaccccacccgcgatggcagcgcccaggaggccctggacgagcccttcgagcatgaacgggatctggatgaacgagttcgtcgcgccgacgagccgcatgacggcgacctctcggcgccgagagaagatcgcgacccggatgacgttcaaaatgagcaccgcggccgacacgaggagcacgacggcgatcacgaggatcaccgactgagcaatcgtcgagatctcgaggatcgtgtggatcgccgagaagttgtcgttcaccgcgtagaccccgggctcaccacgcacgaccgcggcgatcgccggtgcctctgccgggttgaccagcgagacacgatagaacgtcgggacctgcgattcaggcaccgcgttcacgagatcgggctggttggcgaggaggcgacggaagtcttggtaggcctgagcccgtggcacgtaggagtacgagcgcaccgtcggcagctgatggagctccgcctcgagcgcacggaactccgatcgcgtcgcgttcggctgcatgaagacgaggagctgcacgttgccctgccactcgctggtcgcggtctggacaccctgcttgatgaggagcgcggcccctaccagcgacagcgacaccgtcaccgtcaagatggccgccagtgacatcaagcgattacgccacaggttggtcgcggtctcgcgaaggaagtagcgcagtgcggtcatcgaccctccactccgatgccgtagacgcctcgaacctgatcccgctggacggtgccggtaccgatctcgatcacgcggcgccgcatggcgtcgacgatgctcgagtcgtgggtcgccatcacgaccgccgtcccggtgcggttgatccgctccagcaagttcatcactccccagctcgtctccgggtcgaggttgccggtcggctcgtccgcgagcaggatcagtgggcggttcacgaacgcccgagcgatcgcgactcgctgctgctcgccaccggagatctgcccggggagtcgatccgccttgtcctcgaggccgacgagccgaagaacctggggcacctgctggttgatcacggaacgcggcttgccgatcacctcgagggcgaacgccacgttctggaagaccgtcttgttcggcaggagtcggaagtcctggaagacgaccccgatgttgcgccggaagtaggggaccctccagttcggcatggtcacgaggttcttgccagccatccagatcgtgcccgagtcggggcgctcctcacgcgtcatgagcttgatcagcgtcgtcttgcccgatcccgacgacccgatgaggaagacgaactctccacggccgatctcgaagctgacgtcacgaatcgcagacgacgatcccgcgtactgcttcgtgacatgctcgaagcgaatcatgcagctccttcccccgggcgcctgcccggtgaggtcacgcagccgctcatcctaccattcgagatcacccatcagggtgcttctcgcgcctccaggcgaggaacgcctcgatgaaggggtcgaggcgcccatcgaggactgcttgaacattgcgatcttcgtacccggaacgatggtccttgaccaactggtagggcgcgaggacataggagcgcacctgattcgcccaaccgacgtccacccgcggcccgctcaaggcatcgagctgtgctcgctgctcttcgcgccgtcgctgctccagcttcgacaccaggatctgcatcgccttcgccctattctgcaactgcgaacgctcgttctggcacgacaccacgattccggtcggtaggtgggtgatgcgtaccgccgagtcggtgacgttgacgtgctgcccgcccgctccggacgaccgatacgtgtcgatccgcagatccttctcgtcgatgacgacctcgccagcgtcctcggcgagtggggtcacgtccagtgacgcaaagctcgtctgacgccggtgctgggcgtcgaacggcgagatgcgcaccaaccggtgcaccccacgctccgcgacgagcaagccataggcgtagcgtccgcgcacgatcgccgtcgccgacaagatcccggcctcttgtccctcggtgacctcgtccacctcgaactcgaacccgcgaccttgggcccaacgctcgtacatgcgcagcatcatctgggcccaatcctgggcatcggtgccaccggcacccgagtggatctcgagcacggcatcgctctcgtcgaactccccggcgaggagcgagcgaatctcgatcgcatcgaggtgcgcagccagcgacgtgaggacgtcctcggcctcggcggcgagatctgggtcgtcgtcggccatctcgatggcgacgttgctgtcggcgagcatggcgtcgagtcgggcgatgagctcgacgtcgtccttgagcgtgccgtagcggcgcgagagctcgcgacccttcgcggggtccgaccagaccccaggatcggcgagtgcggcctcgagctcggcaagctctgttcggcgatcgtcgatgtgcaagaacgctcgggcccgctcgagacgctcggccagtgcccgagctcgctcggcgagttccgctctcgtcacgccgaaccgccctcggactcaggaccctcggtgacgtcgcgagcctcgcggatgaggtccaagatgctcatcgcctgcggatcggtggcgccgaagtagcgcgcgcccgacaggtcgagcttcggcacgttctgcgaggattcggttcggaacaggtaccgcacgaagtcgtcctcgatgcggcgcattagctcctggaacatctcgaagccctcttgctgccacgcgacgagcgggtcctgctgacccatggcacgcaagttgatgccctcgcgcagatagtccatgtcgatgagatggtcgcgccagtgctgatcgatgacgcccaagagcacgtcgcgctcgagcgctcggagcctgggggtgccatcggcatcggcaccgagcgcgcgttcgcgctcgtcgtagagctccaaggcctcgacgaccagcgagctcacaagttgatcgcggctctgcgcgtcggcgagctcctcggcggtgaaggcgctcccccaggttcgccgcgcctcgtcgaccaggcccgcaaggtcccagtcctcgccgtaggccccaggagcgtagacgtccgcgacacgccgaaccgtgcgctcgatgctctggcgagcgaactccgacagatcctccccttcgaggatctctcggcgcctggcgtagatgaccttgcgctgctcgtcgagcacctggtcgtacttgagcacgtccttgcggatgtcggcgttgcgcgcttcgaccgtcgcctgggcacgctcgatcgctcgcgacacggccttggcctcgatcggttgatcctccgggaacgcacgattcatcacccacgacacgacgctgccacccgcaaagatacgcatgagttcgtcctcgagcgagaggaagaaccgcgtctcgccggggtcaccttggcgacccgatcgacctcgcagctggttgtcgatccgacgagactcatggcgctccgagccgatgacgtagagacctccgagcgagcgcacctgctcaccttcgtcggcgcacacctgttggaacttgccgagagcttcctcgtaggcagcacgtccctcatcggtcgtggggtcgagtccggcttcgcgcaccgcgatcgccgcgagcccctcggggttgccgccgagcaagatgtcgacaccgcgcccagccatgttcgtggcgacggtgacggcgccgaggcgtccggcctgggcgatgatctccgcctcggcagcgtggtacttcgcgttcagcaccgcatgcgagatcccgcgttctgcgagcagactcgagagcaactcggacttggcaaccgagaccgtgccgacgagcaccggctggcccttcgccgatcgctcggcgatctcctcgacaacggcgccgaacttcccgagctccgacttgaacacgaggtctgcgcgatcgacacgttgcacgggtcgattcgtcgggatcggcacgacctggaggccgtacgtcgaggcgaactccgcggcttccgtctgggccgtaccggtcatccccgcaagcttgtcgtagaggcggaagtagttctggagggtcacggtggcccaggtgtggttctcctcctggatccgcacccgctccttggcctccacggcctggtgcaacccgtccgaccaacgccggccctccaggatgcgccccgtgaactcgtcgacgatcttgacctcgccccggtcgacgatgtagtcgcgatcgcgcaggtacaggtgctttgcccgcagcgcctgggtgagctggtgcaagtagcccatgtgcgcgatgtcgtagaggttctcgaccccgagcgcgcgctccacccgttcgatgccggcctccgtcgggaggacgaccttcttctcctcgtcgatctcatagtcgacgtccggacggagggtgcgcacgatcgaggcgaagcggtagtagagatcggggctcatctccgacggccccgagatgatgagcggcgtgcgtgcctcgtcgatcaagatggagtcgacctcgtcgacgatggcgtagtggtgcggacgctgcaccacctcctccaacgacgtcgccatgttgtcgcgcaggtagtcgaacccgaactcggtgttggtgccgtaggtgatgtcggcgaggtacgccgcgcgcttggcggcgggatcgctctcgtcggccccgacccgaccgaccgtcatcccgagggcggcgtagatgcgtcccatccaggcggcgtcgcgtgcggccaggtagtcgttgaccgtcacgatgtgcacgcccttgccctcgagcgcgttcaggtaggccgggagggtcgacaccaaggtcttgccttctccggtctgcatctcggcgatccacccgaagtggagcgccatcccgccgagcagctgcacgtcgtagtgccgctgaccgatcgctcgccgagcggcctcgcgcaccaccgcgaaggcctcgaccaacaggtcctcgagagtctcgccctcctcgagccgctgacggaactcggcggtcttcgcacgcagtgccgcgtcgtcgagttgggcgatctcgggttctagctggttgatgagcgggacgactgcctgcagacgcttgaggcgcttgccctcgcccgctcgtaggatgcgatcgaagatccccatgggctcgctcgcggacgacgctcagtcggcgacgcccgcaccctcctcctcggcttgatcgatgagcccgacggtgccatcctcccgccgatacacgacagcgggccgcccggtctcctcattgatgaacaggtagaaactatggtcgagcaggtccattcggaacgcggccgactgcgggtcgagcggctggagcgcgaaacgcttgcgccgcctgatgtcgagtcgagcctcgggtgcttcggcgccaccgcggtgatggggatggctgcgggccaccagtcgacccttcagacgctcgaggcgccgcttgagccgctcctcggcacggtcgaaggactcgagctccgtctcgcccacaccgcgtgcgcgcacgaccgccttcgagaccacgtaggtcacctcggtcacgacgcggtccggattggctgggttgccggctcgctcgacatgcacctcgacccgctcaggggcaccgaggtacttctcgagtcgcgcgatacggtcctcgacgtgcgcgcgctgctgctcggtcagcgtgcagcctcgacaccgaaggtcaactgccatgggccacctcctatcgggtaccgacggtccatgaggccaagtatgcctcttgctcaggagtgagcacgtcgatccggatccccatcgctgcaagcttgagggcggcaacctcggcgtcgatcgactcgggcacgccgagcaccgacggctcgaggcgctgcccctcgcgcacgagccactccacgctcaacgcctggttcgcaaagctcatgtccatcacgctggccgggtgaccctctgcggccgagagattgacgagacggccctcggcgaccaccatgacgcgagccgtggtgcccgactcgctgtcgaccaggtactcctccaccatgggtcgcacgggtcggcgacgctcccctggggccaaccgcgccaatccctccaggtcgatctcgacatcgaagtgcccagcgttggccaacaaggcaccgtccttcatacgccgaacgtgctccggccggatcacgtcacggttcccggtgacggtgatgaagatgtcgccctcggccgcagcctcctccatgggctcgacacggaacccatccatcaccgcctcgagggcggccaccggatcgatctcggtcacgacgacctgcgcgcccatcccgcgagcgcgtgaggcgacacccttgccacagaaaccgtaacccgccaccaccaccgtggtccccgcgagcagcacgttggtcgcccgaatgatgccatcgagcgccgattgacccgtaccgtagcggttgtcgaacatgtgcttggtcttggcgtcgttcaccgcaacgacgggatagccaaggctgcccgaggcctccatggcccgaagtctgatgacgccggtcgtggtctcctcggtgcctccgaggatgcgcttcacctggtcgggacgctccgcgtgcagtcgggagacgaggtcacacccgtcgtccatcgtgatggtcgggtccgtgtcgaggacctggtcgatgtggcgatagtaggtctcggtgtcctcggcccgaaccgcgaacaccgggatgccttcgtgcttgaccagcgacgccgcgacgtcgtcttgggtcgagagcggattggacgcgcacgccacgacctcggcgccgccagccttcaacgtacggaggaggttcgccgtctccgtcgtgatgtgcaggcacgccgcgatgcgcacgcccgcgagcggtcgctccgcctggaagcgctcccggatgccacggagcaccggcatggttcgatccgcccacgcgatgcgctggcggccctcgtcagcaagcccgaggtcacgtacgtcgtagtccacgttgatcctttcgaagaggtctgatcgggtcggccgcggactaggccgcagggccgctgaggtactgcttgagtgcgttcagcatcggaatgggtccaggatccgttccgagtgcctcggcgaggcggagcgacatgacgtcgccgacgaaggcgaggtcgaagaacgtcgcgagttcgcccaccccctggccgtggaccgagaccgctcgatgcactcggggtgcgatctcgcgctccatgaaggcgacccgccgtgagatctgcgggtgctctccatcgtggcgcaagaacaccagcgacacggtggacgcgagcagctcggggtaggcctcgaaagcggtcagctcgttgtggcccgcctcgggcaacaccgacgcaaccgcgagtgccttggcgttctcgttgatctggttcttccatcgcagcgccgccacctgaccgacggcacccgatccgagcacgatcgggatcgtaccgacgagcgccgaagcgagatcggaggcgagcgtccccttctcgagttcgtcgcgtcgctggcgaagacgctcgatggcatggccgatccaggccgaggcaccggggaagaagccgacccgctccaacacgccgagcagcgacaccgtgagcgcaccgagcgccgctcgcggctgcgggatcgagccatcgatggcgacgtgacacacaccgcgctcggcggcaacacgagcgagctccccgccggccgagatggcgacggcgcgagcaccatgatcgagcgctcccgccaggacttcgagcgtctcctcggtgttccccgagaacgacaacgccacggccagcgagcgtggaccgacgaacgaagggagctcgtagcccttcacgaccaccacggggatgggcatgtacggagccgccgtcgccaccgcgacgtcacccgcgatgccgctcccgcccatcccgagcaccacaacatgctcgacctggtcgggagcgggaagatcgcacagtcggccaacggtaccgagggcggcttccatctgctcggggagtccgagcgtcgcatcccacatgcctagttcgtccacggcggtcctccctcgggatcggtgttggatacctccccctccggcgagaggccagcggcgactaggagcgcccgatggcgctcgtcatcgaccacctctgcatcctcgaccagcagatccgcgataccgtctgtgaccgcataggcacggtggaggcggggattgtagagcactgactccgactcgatccagagcaggggcccgtggtcgagcggacaggcgacgatggcgagcaggtccggcgagagcgcactcatgcgtcgcgagactccgccttcgcgacgacggcgagcacctgctgcgtccgccgagcgacctcgtcggaggtgcgtgcttccaggttgaggcgcaagagcggctcggtgttcgaggcccgaaggttgaaccaccaatcggggaagtcgatggtgagcccgtcgaggtgatcgacgcgcccttcaccggcaaaggccgtctcgacgaaggcgagcacctcgttggcgtcgcgaaccttggagttgatctcgcccgacgccgcgtagcgctcgtactccttacgcagcgtcgagagctccacccctgcgcgagcgagctcttcgagcacgttcaccgcgccgatcacacccgagtcggcccggtagttctcgcggaagtagtagtgccccgagtgttctccagcgaagatggcaccggtgcgagccatctcggccttgatgaacgagtgaccgacgcgcgtacgaatcggcaccccgccctgttcacgaatgatctccgggacagcccgggagcagatcaggttgtagaggatggttgcacccggctcgcgctcgagcatgcggcgcgcgatgatcgcggtggtggtcgatcccgacaccggcgcggcccggtcgtcgaccaggaagacccgatccgcgtcgccgtcgaacgcgagcccgatgtcggcaccctggctgagaacccgtgccttgagatcgatcaggttctcgggctggatggggtcggcaggatggttgggaaagctgccatcgagctccggatagagcacatcgagctcgacgtcgagtgccccgaagacggctgggaccacgaggccgcccatgccgttggccgtatcggccacgatgcgaagacccgcgagcgacgacgcatcgacgaagctgagcacgtggtgcacgtaggcatcgagcaggttgtcggtggtgcgagccccgcgagcgccgctcgcgctcaccggagctagtccctgctccacgagcgcttcgatctcggcgagaccggtctcgacgccgatgggagcagccccgggaccgcagaacttgatgccgttgtaggaccctggattgtgcgacgcggtcaccatggcgccgtgcgcatcgagtcggccgctcgcgaagtagagcatgtcggtcgagcagagcccgagatcgacgacgtcgaccccctcgaccacgagaccgtccgcaaaggcactggccagctcttcggacgagaggcgcatgtcgcggcccaccaccacgcggcgcggaccgagcgcgcgcgcaaaggcacgaccgatcgcgaaggcgatctcgccattcagttcgtccgggacgacgcctcgaacgtcataggccttgaagattccactcatcgtcgcagggcactccttcgaccgccgcccaaggtccgtccgagcgacgcggccttcgggcaccacggcagcttaccgcaccggcccgggacgtaggatcgacggcttcaggcgcgctggcgacgacgggatcgtcccgaccgagcatcctcttcgacgagcgacacgacgtcgtcgacggtgaccgcatcaccatctcggcgccaccacttggccccgcaggcagcacaggagatcagcgtcagcgcgtggcgagccacgtcgaggtcgatgatcaccaggtcccgctcgcggcacgccggacacactgtgtccatgagacctccctctctcgtgggcctttggacccgatccaggcttcggcacctggggccaggatctttaccaaatgttgagctcgcgagctggtgcttcggcgaccgccccgctcacggaccccgagagggctacactcacaccatgcacgtggcccctgagcagctcgacgacgtcgagcgcatcgcccgagccgccctcgcccgactcggcaccgagggcatcgacgacgaccaagagctcgcgtggcgcctcgcgcacgtcgtgagcgctctcggcgccgtgcgagcactcgtggacgatccggcggtaccccaagcgctcgcgagctacggtgcagccctgttcctgcgggaagcggcgagcgagctcgtcgcgctcggcgtcatcgacgacctcggtgcgcttccgctcccaccgcgaccgtccgaggcggccgctgccgaggtcgccgaggcgcccacgacgtggtcgctgggggccgacctcgatctcgcacgcgacaccttcgggcgcttcgcgcgcgacgagatcgcaccggtcgccgacgaggtccatcggcgcaacctcgacgtacccgagcgcatcatcgagggcctggctgggctcggcgctttcggcctcagcatccccgaacgctacggaggctccgccaccggaagcgtcgacgacacgctggccatgctggttgcgaccgaagcactctcgcaggcctcgctcgggatcggcggctcgctgatcacgcgccccgagatcatcgcccgggcgatccttgccggtggcaccgaggagcaacgggtccgctacctgccagcgctcgcgtcgggcgagctcatgggcgctgtcgccgtaacggagcccgactacggctccgatgtcgcctcgatcacgacgcaggcgatcctcgggcccgacacggccaccgtgcgcggcacgaagacctggtgcacgttcgctggacgcgccaacctgctcgcggtcctcgcccgcaccgagcccgacccgagcctgcgtcatcgagggctgtcactcctcctcgtccccaaggatcccgtcccgggccacagcttcgacctcgagatcggcgggggccggctcacgggccgcgcgatcgacacgctcggctatcgcgggatgcactcctacgaggtcgccttcgacgacgtcagcgttgcgcgcgagcagatcgtcggcggcgaggagggacgtggccgagggttctacctccagatggctggcttcgagaacgggcgactccagacggtggcgcgagcagtcggactgatggacgccgcacttgcgcaggcgcgcgcctacgtcgccaaccggcgcgtgttcggacgcagtctcgccgactacaccctgacccggcgcaagctcgctcgcatggtcgcgacggtggcggcggcacgggccgccgcctaccgcaccgcacgtcacctcgagacccccgaagggtcgctcgcagcctcgatggccaaggcatggtcgtgtcgccaggcagagttggtcacgcgcgaagcacagcagcttcatggtggcatgggctatgccgaggagtacccggtgagccgttacttcgtcgatgcccgggtgctctcgatcttcgaaggcgccgacgagacgctgtcgctgcgcgtcatcgcgcgagcagtcgcatcgtccagcgagacgacacgatgagcgccctccgccgcctcctcggcgatctgctgtactgggccggcctcatcgccggcacgggggccatcgtgatccacctgttcacacttaccgtgctgacgcccgggcgcctcacccaacaagcacatcagctgctctcagccagcgtcgtccagcgcgcgatcgccgactcgctcgccaacgcgctccaacccatcgcttcggctcagggcgtccagctcacgtcgagcgaaaccctcgctgcggtccacagtgcgctcagctcgccgctcgtccagagtgacttcctcggcgccatgacgaccgcgcaagatcgcctcctcgggaagaccagcgcacccgtcgtgatcggcggacccgccttcacgcaggccatcgccgccagccttgcatccgtcgacccgtccgtcgcccatgtggtcgcaggcgaggacctcgccgtcaccgttcccggagccgacgtgcccaaccttggcttcatcgccaccaacgccccgcgcaccgagcacacgctgacggacatcgcgctgctcgccctcgtcctcgccctcgtgctccacaacgaccggcgcaagctcctcgcccgcatcggcacctggctcgtcggctgctcgatcgccgaggtcgccttgttctggttcctcccgaaggtcatcctgccgcacgtcggcttctcgtgggcccagttcgccgcggtggtcctcacgatgaccggggcggccacggtcacgttcttcctcgagctcttcgctgcaggcgccgcagccatcgcgctcgcgcgcggcgcgaaggcgctggtgtgatggctcagccgacgagcgaagcctcgacgatcacattgtcggcataggacccgccgacgccagggacctcagtgaacggtcccccacaggtcaccagcgcgagtgtgggtggcccttgggtcgtgaagagctgtggatgcacgacggtgttcggcgagagcaccggcttcgtgtcgactcgccactcggtctcgcgcccaccccagttgagatagacaagatcaccggggacgagctggccgatctcgccgagggcgccctcgccctgcccgacccagttcacgtgcccagcgagcagcgtcactccgggcgctccgggcgatggcgtctgctcgtcccaccccaccgtgtgcacgtcggacgggatggtcagctcaccgttcaccggcccctcggcgaccaccggcgcgctcacggcaagcgcagggatggagatctcggcgacctcgcccgacacggtcggcgtaaacggcacgagacgactcccgccttggcggggagcgatcgctctctggctcgcgagtgaccgggctcgcacgtgatcgaggtgggtcagacgcgcgatgcgagcagccggcgacgtcgcgataccgtcgtagacgagccagccccccgcaacgatcgcgagggcggacccgcccaccgcgagccggcgccaacgagcgctccgggcgcgctcagcgacgctcatcgtgcctcgcgcggagggaacgacgacgtacggcgaccgccagcgtcccacatcccacgccaccgagcacgatgccgatgggcaccgcagcggtcgtggtcgacggagcgacccttggcccggtcgcgagcagcacgggcgtgaccgacgtcgagctcgtgcgaggtgtcgggagcgaggtcgacgaaccggaggtcgtgggggtgggtcccgagcctgtcggaagcgaggtcgacgatccggaggtcgtgggggtgggtgatgggcccgtcgagccagacgaaccggagccagaggacccctggccttcccccctccaggttgacacctgctataggaggaagggatgagccagacaccgaacccaccaccgggcgacggccccgctggacgacgacgcggccgctacccgagccagttccgcaaggacgcggcagcgttggttctcgaccagcgccgcaccatcgctgacgtcgcccgtgagcttggcatcaacgagcagacccttggtaactgggtccgtcaggaacgcatcgaccgaggtgagcgagagggcctgacgagcgccgagcgcgaggagctgacacggctgcgccgccaggtcaagcagctcaccgtggaacgcgagctgctcaagcgagcgatggccttctgggtgaaggaggggggacagtgagccgctaccactggatctcccgccaggaggccaagggcttctctgtagcggcagcagcacgagtcatcggggtctctcgccaggcctactacgcctggcgacaccgtcgggaccgaggcgaggatcccgagcacctggtgctcgcgagcgagcttcgcgccatctggcacgagagcgacggcacctacggcagcccccgcatcacccacgagctgcgacggcgcgggttctgcgtgaaccacaagcgggtggaacgcctgatgcgcgagctcgagatggcagcgggcccacgccggcgcttcgtagtcacgacgaggcggggagaggacgcagcgctcccggacctcgtccgtcaggacttcgctcctggtgagccgaagcgcaggtatgtgagcgacatcacctacgtccgcaccgatgaggggttctgctatctcgccacggtggcagatcttggctcgaggcgcatcgtgggctggtcacttgggcgtcacatgcccgatgacctggtggtcgaggcgatccgcgaagcactcgggactcggggcagcctggctggggcgatctttcacagcgatcgcggcagccagtacctctcccggaaggtacggagcctgctcgcgacccttggcattcgccagtcggtggggagggtcgcgacctgctacgacaacgccgtggccgagtccttcttcgggagcttgaagcgcgagctggtggctcgctaccgcttcgcgaacctctcaggggctcgctctgccatcgctagctggattcaccgttacaacacggtccgcctgcactcaagcctcgggtacctaccgcccgtcgagtacgagctctcctgggcctgccgggaggtggccgtggcctaaattcagactgtcaagcaaatggggggaagcccacccgaacccgacgaaccgccagagctggtcggcgacgcggggacggtcaccgtcacctggttggacggagtcgtcgaaccgtcgtagctcacggtggcgacgttggtcgcgctctgggtcgccggcgccgatgccgacaccgtgaccgggatcgttacggaaccgaggacggtgccgctcgccacgtcgatgggctgaccgttcaccggcacgagcgtgcaggtcatggtcccagctgagatggcacacggtttcccgcccggagcgctgtcgctcaaccccgccgacggcgtgaagctcggcgagccgtagctgagccaggtcacgctcggcaagttgtcactgaccgtgagcgggtcggcgatgatgcccgagcccatgatggtgatcgtgtactcgccggtcgtccctgggctcgcgaccgaggtcgggctcccgccgctctcgtaccccttcacgaccgtgaacgtcggtggggcaggctgtgggagcgtgcccacgaacccgtggggcgcggtgtggacctcggggaccacgacacaggggacccccgccgtctggacgcagctcgcagtgttcgacaaggttccctcgatgacgtccccgtcgatctgggtgccgccggtgatggtgccgaagggcgcgaggagcgacccctcccactgcacgccacccgagcctcgctggccatcgagcgtgatggactgcgtcgcactcgacgacggcggcgcggcgacgaagatcgccctgctggcgcccgtcgcgctcaccgacgtgatgaaggagagatccgcctgggtcgggagctggacgatcaaggtggccgacgagggcaccgaataggcgagcgtccactccggggacgccgggtacgcggcctggccggcctcgatggcagccaacgcatgaccaaggttcacgacgacgtcccccgtctgcgtcgacgggacgctgatcgtgatcgtcggacccgaggaacccgtcgtggggtaggtgacgctcgccccgctcgtcaccggcaggcccgagagctcctcgtcgagggcctcgagataggtgttctctgcggcaaagtcgagcggactcgttggggacgccgtcgtcaccggcccgctgccgttgttgtagagcgtccatgatccctgcgtccccgtgggcgtcggggagactgccgccccgtagttcccgaggacgaacgtgcttccgctctggacatcgggtgcaacgagcgcgtcacacgtcacgcccggggggcaggagaacccggggaccttctttccgtcgacggtgaagctcgtcccatgcgcggtaccgatgctgccaccgaaggccgcccatccggtcgtgtcgaccgaaccctcgagcgtcgcgtcaccgccaccgacgtagaagccgtacggaaacggattcgccccgccgagcgtccaagtcgtcgagtcagaactcgcccgggcgccggtgccgacgagtccgaacgcgcccgccatccctgccgacgcgactgcgagcgcaaccgcgccaacgaggcgtcctcgccacgcgaggtgtcgacgctgcctcgtgtgacgacccctcctggtgcgccgccgcagtcccctggtctccgcctcgtccatgtgcgctcccaaccctggctaccggagccggccacccaaccatggccacgctgtgtggttcgatggtactacgtcatgtggcgtcttcgccacattgccctcaaggtttgcaccatcgttgccgataaggccacctggccgctgttcaggaccgcgccttggcgacgtcgggaccacgacggtcctcttgaggcgctcgacgctcagcgtgagggcaggctccctacgaggccaacgaccgatgcgtcagcccacgcactcctgtggcgctgcaccagcgcaccaggccactcgcactcggtcgccgcagcgacggcgctacgacgccgacggcgtcatgccggcgcgacggccacggagggcgaacttctccgccatcttgcgactcgcctcgtcgatcatctcgtccccgaacatgaccgctccacgacggtccgacgtcgtggcctgctcgtaggcgtccaagatggcgacggcgcgatcgaagagttcctgtgacggacgatacgtgtcgttgaggacgtccacctgcgtcggatgcaacgcccacttgccgtcgtagcccagcatggccgatcgaagcgcggaggccttgaggccctcgaggtcgtggatgcgcaagaacgggccgtcgatcacctgcagacccgccgtgcgcgccgccatcaggatcttcgagaggacgtagtgaaagtggtcacccggatactccggaatcgcagccccaccggtgagcaccggcagctgcatcgacgccgagaagtccgccggtccgaagacgagcgtctcgagccgtgacgacgcggttgcgatggcctcgacgttgatcagtccccgggtcgtctcgatctgggcctcgatgccgatgtggccgcgctcgagtccgagttcggcctcgagctgcgtgagaacgagatcgagcgccaccacctcgtcggggcgctgcaccttcggcaacatgatctcgtcgagacgcgggccagcccctgtcaccacctcgatcacgtcgcgcaacgtgagcggcgtatcccaggcattcacccggacgcacaccacccgctcgccccagtcgaacgagcggatcgcacgggccacccgcccgcgggcctcgagcttctcgctgggtgcgaccgagtcctcgagatcgaggaacaccatgtcagccgggatggtcagcgctcgctcgatgaagcgatcggacgatccaggtaccgcgaggcacgaacgacggaggagatcacgagatcgggcacccatgggccccagcgtaccaatgcgggtgggtccgcgtcagctcacgcttccgagagctcgaaccacaagaacccgtacggcgcgagcgtcagtgggtagcctccgtcggctgggacctcaggaaatggggtcatgccgagcagctccaccggcacaaagccctcgaacccacgaagatcgaggcggcagggctgagccttcgaggacagattgctcacgcaggccacgacccgctcgtgctcctcgtcgaagcggaggtaggccaagatcgccggattgtcgacgtcgcgcagctcgaaggtaccgtcaccaaagactccctcctggcgacgcgcgagcaggagctcgcgcagccatctgaggaacgacgacgggttgcgcatctgcgattcgacattgacgacctggtagccatagaccgggtcggtgatcggggcgaggtagaggcgctggggatcggcgcgcgagaacccgccgttacgatcgggcgaccactgcatgggggtacgcaccgagtcgcgatcgccgaggtagacgttgtcccccatcaggatctcgtcgccgtagtagagcaccggtgagcccggcagcgacagcaggagcgcgtggaggagttcggccacgcgacgatcgttctcgatgaggggcgcgaggcgccgaccgatgccaacgttgcgtcgcgcgatgggatcggacgcgaaggccgcccagagaaagacgcggtcctcttcggagatcatctcgagggtgagttcgtcgtggttacgcaggaagatgccccactggcaccgcggcgggatcggtggggtctcggcgatggcgtcgcgaatcggctgcgcactctcctgcttcaccgccatgaacagcctcggcatgagcgggaagtggaagcacatgtggcactcgtcgccctggccgaagtactcaacgacctgggccggaggctggttcgcctcggcgagcagcaccgcgtcgggaaactcggcatcgacgagcgccctgatccggcgaaggaacgcgtgggtaccgggaaggttctcacagcgcgtcccctcggcctcgaagagatacgggaccgcatcgaggcgaaaaccgtcgacgccaaacgccagccagtagcgcacgatctccagcatcgcctcttgcaccgccgggttctcgtagttcagatcgggctgatgagagaagaaccgatgccagtagtactgttcgcgttctggcgcccacgaccagttcgacgactcggtatcgacgaagatgatcggggcgtcgcgatacccgtcgtccgtgtccgaccacacgtaccagtccgccttcggattgtcgcgcgacgagcgcgactccacgaaccatgggtgctggtcgctcgtgtggttcagcacgagatcggcgatcacgcgcatcccgcgcaggtgcgcctcccgaagcagctcggcaaggtcgtcgagggtgccaaggtcgggatggaccttggtgaagtcagcgacgtcgtagccaccgtcgcgcagcggcgactcgtagaacgggagcagccacaagcagtccaccccgagccactcgaggtagtcgagcttctcgatgaggcctcggaggtcaccgacgccgtcgtcgttcgagtcgtagaacccgcggatcagcacctcgtagaagaccgcttgctggtaccacgcgggctcgccctcggcgccccgcagcgaggcgaaccggtgttgggccatcaccgtcccacgaagttcgctcgtcccggcccatcggtcaggaacgaccgcacaccgatgcgcgcgtcctcggtggtgaacacctgcgcgaagagtgcctgttcgagcgcgagcccctcctcgagcgagccctgcgtcccctcggcgagcgcgaccttcgcgaacgcgagtgctgcgagcggacccgacgcgaagcgctgcgcccacgctcgcgccgcctcggtcgcctgccctggctcgacgacgcggtcgacgagccccacgccgagtgcctcggcagccgtgagcggctccccggtcaggacgagacgcttcgcgaccgccaacccgacgagccgaggcaaccgttgtgtgccgccgccacccgggatcaagcccagcgagatctccgggaggccgagcttggccgacgaactcgccacccgtaggtcgcacgcgagggcgagctcgaggccgcccccgagggcgtacccctcgatcgctgcgatcaccacgcgtgggagcgccgcgatggcccccaacgcgcggtggaacgcccgggcggtctcccaccccacggggcgctcgtcgaactccgcgatgtccgcgccggccgcgaagatgcgatcgccacccgtcacgaccacggcgcggggcaagtctcgctccaggtccgaggccgcggctgcgagttcggcgagcaccgcgcccgagagcgcgtttgccttcggccgatcgagccgtacggtggcgacgcctgcatcgtccctctcgacgtggacaaactcactcatcggatgaccctcctcgtgctccgtgccctggagcgatctcgagcgcgtcgaggagtgcgtcggccgcggccccagggtccacggtgcccgcctccacctgcgcccacactgcctggtctgcgtcggccgccgcccggaggacgcgatcgacgatgacacgctccaccgcgcgcctccgccgcgcggccacgcgcgacttcaagatgcctcgatcgtcgagttcggccgcgagcgccacgacggcctcggccaccgcatcggtgccctcaccgctcgtcgcgaccgtctcgagaatcggggggcgcggctctcgatggccgagatcgagcatcgcgacgagatcacgacgcgtctcggcgagccccgcacgatcggccttgttgatgacgaagaggtcggcgatctccatgatgcccgccttgttggcctggatggcatcgccccagcccggcgtgatgacgaccaccgtcacgtccgcctcgccgacgacctcgacctccacctgtccgacaccgacggtctcgatcacgacgaggtcgtagccgaccaacccgaggagtcgaacgatctcggggacgctgcgcgcgaggccacccagcgcaccgcgggtcgccaccgagcgaatgaacacgtcggggtcgtgcgtgtgcccctgcatacgcacgcggtcgcccaggatcgcgccgccggagaacggcgaactcgggtcgaccgcgacgacacccacgcggtgaccccgggtccgccacgccccgaccaagcgatcgaccagcgtcgacttcccagcgccgggcgaaccggtcaccccgaccacgacacgagggcgcgctgaccacagatcggcgatgccgatcggctcgccggcccctgcccggcgctcgacgaccgagatcagccgtgcggtcgcacccctgtcaccagcacgagcccgtccaacgagctcttcgaggtcgctcactcgcctccctcgatccagacctgacccccgagtcgctgcaaggttcccgcaagatcgtcgtagccccgctcgatgtgctcgacgccgagcaaccgactctggccctccgcagcgagcgccgccaccaccaacgccgcacccgcacggatgtcgtgcgcgaccgccgtcgcaccgtggagatgatccacgccgcgcacgacgacgtgatggccctcggagatgatgtccgcgccgaagctccgcagctcgtcgaggtagcgaaaccgaccgctgtagagattctcgctgaccaccgagactccctgggcacgcgtcagcatcgccacgagcatgggcttgtagtcggtcgcgacccccggatagggcagcgtctggatgtccccggccctgaggcgctcagtgacctcggcgacgagccgttgacccgcgtcgtcggcctcgatgtggaagccgaggccgctgagcttgcgcagcaggatctcgaggaccctcgggttgacgccgacgagctcgagacgcccggtcgtcgcaccgagcgcggccaggtaggtggccgcgacgacgcggtcgccgatgacgcggtgacgcaacgggcgcaggcgctggacgccctggacgcggatccgagacgtccccgcaccgtcgatccgcgcgcccatcgacacgagcgcggtcgccaagtcgacgacctctggctcacgagcggcgttgtcgatgatcgtctcgccgctcgcggtgacggcggcaaggagcgcggtgtcggtccccgtgtgggacgggaactcgagcgtcaccggcgcacccgcaaggggggagcccttcacgaggaccgatcccgcgtccatcgtcgccacggcaccgagactggccaacgcatcgagatggatgtcgatcgggcgcgccccgaaatcatccccacccggcggcgcgagccgcaccgcgccggtgcgcgccagcaacggtgcgaggagcacgacggacgcgcgaatctgcccgacgagttcggcaggaggttcgctcgacagcgacgccgcctcgggcacctcgacctcgacgacgtgcggctcgggccaggacacccgagcccccacggcctcgagcaggtgggccatgacggtgacgtcactgatggccgggacgttctcgatacggtgacgaccctcggcgagcagcgtcgcggccatgatcttcaggaccgagttcttcgcgccctgcaggcgcacctcaccctcgagccgcgacgtgtgttggaccatccacgaacgcatcgcgcctccctcacgctctccacgccaaccggccacaacctactcggcgccggcgcccggggccaatggcggcgcgtcctcagggttgaggtcctcgagcgtacgagcacgcgtctctggaaaggcgatcagcaccagggcagcgagcgcgatcggcccgatggcgagcgcggcgatcggggtgccgtagcccaatccagccgacgcggccgccccgaccgcgacgagtcccaccacggtgcccaccctgctcgcgatcgcgatcacaccattggccccagagcgaagcctcgtcgggaacagctccggtccgaacaccgccagcgccggcaccgccatggtcccgaccgcttcgccgacggcgtagagcaccaccagcgccacgccgtgggcgaggaatgcgagcgcgaggagcaccccgccgaccgcgagcccaacggcggcgagcacgcgccgaccgaccgtctcggcgaggcgcgcaccgaaggccaggccgatcccagatggcaggttggcgccgatcgtgaacgccgagatctgccaggccgcaaagtggcgatcgacgcgcaagaactggttccgaaactgggaagccggcaggtagaacaggttgaacagcgcggcagcgatggccacgaggatgagacgaccgcgatgctcccgagaggtgagttcgcgaaagcgcacgggggtcgagtgccgaaagcgggccggatcgcggcggtgacggaggcgtgggacgagcacgaggccgacgatcgcgatcgcgaacaaggcgcgccacgcctcgggtgcgatcccaagcccagccaccgccaccgcgcacagtccggcaccgagtgcggtcgcgagcaccagaaagcccatcgtccacgctcgcccctccgcatgcaccgtctcggcgacgatgacgttcgcgagcagtacggcaaccgtcgcgcccgccttggcgagcacctgggtcacgacgaggccggcgaggtccggtgccagcgctcctgccgccgtcgcgagcgtcgcgagcacgagcgcagcccgcaggacgcgccaccgacccacacggtcaccgagcctcgcgatcggcaacgcgacgagcacgtcgacgcgcaccagccccgaaccgaccccttgcgcgaggggtgaggcgtggagcgtgggggcggcgaaggcaagcgtctgtcccaggagcgttccgcagtacgcaacgacggtggcgacccagaacacggtcgcaacgacgtccagtgacccctgagggaagacccctggcggcagaacacgccgcaccaaccggcccttgccgcgcaccagacgcccgagtgcccagcgcacgagccagccgagtcccggcgcgccgacgtcgcagcgcacctcccaacggccgtctggcaagcggcggcgctcccacgccacgagcgagcccgatccctgcacgaagcccgccgcgacccgctcctcgacgagcagggcgcacgcgacgggtgcatctggtccagcgagcgacctcacccgcacgctgatcggctcgagatcaggaacccaggtgctcgtgcaggaacggaatcatgcgatcccacgcctggcgagcggccagtgcgtcgtacacctcgggtctcgagtcgttgaagaaggcgtggtgcgtgccggggtagatgaagaactccacgtcggcaccgagttcccgcagccgcgcctcgagagcacgcacgcgatcgggagacgcgaagtcgtcgtgctcggcgtagtggccctggatggcagcggtgatacggctgtagtcgggctcggccccctgccacgggatcaccccgtagaagggcaccagcgctcggacctgcgttggcacctcggcagcgagcacgtaggcaagcccaccacccatgcagaacccgatgacgccgacgccctggcgccccgtgcgtcgctccagttcgcgaaccgcaccgaccatgcgcttggaggcatcggagagctgcatcgccatcatcgccttggcggcctcgtccggctcgtcgacgacacggccgtcgtagaggtccggagcgagggcactgaagcccgctgccgccagccgatcaacgacatctttgatgtgatcgttgacgccccaccactcctggatcacgacgacgccagggcccgtctcgccaaccggctgcgcgaggtagccagtcgcgtcgtggccattcatcggaaagtgcacggtctcgcccatgcgcccatgctagccagcagggagtggcggcgtcagtaacgtccgccgagcttgcggtggtcccagctcacgatccgctcgggctcgaggcggatggcgacgcgcttggaggccgaacggcgcatcgcctccgcggcctccgcagaacccagctcgtagcgagcgagcagaccctccccgacccggcgcaccagtacggggtcgtcgctgagcacggcccgaccctcgatcagcacgccgcggagctcgtcgtagcgatcgccgagttcgacgagcccgctcgcggtcgcctcccgcgcaaggttgcgcgccttctgcgagcgcgcatacgtccacgaccacaccacaccgtcgaggacaacgtaccacaagggcaccatgtggatggtcccacgaggcccgtgactgccgaggacgagtgtcctcccctcgctgagcagggctgcgatctcgtcctgggtcatcgccacgtgactacgcctcgacggcatcggcccctccctccagctgcgccagtccgggggcaagtcgcggccacccgtagcgcgacggcaggattcgccgcccgtcgacgagcaccgccaggtccgcggtcgcgaacaggcgggctcgatgcctgttggcgaccactcgaaccagctcgtcgggcaggagccgccaggtgcacgtctcgaccgtcgacggcccgacgccgcgtcgggcgacgagcgtcgggccaaccgcgagttctccgccacggccatggagtccgcaggactcgaggtgatcagcgagctcgatcccagcccggtaggcctcctccagtggatcgatgaccccgagcacgcggttcgcgagcgcgagcacctcgacgccgacgcggggatgggcgacaaggagccgaagcgcgctcgtgagttctgggggcgtcgtcggctctgcagcgatgacgagcgcaaccgtgccgacggtgtcagcatcggtgaggtcccacgcgctgagctgacgcagcgcttcgagcaagctcatcacccggcttggataccccctcgtgtcatggctgccacgtcgagcacgcggtcgacctcctcctcccccaagacgccctcctcgagcaccaggctcctcaggtcccgcccctccttgaccgcacgcttgacgatggccgcagcgcgctcgtagccgatggcggggttgagggccgtggcgatcgccggtgtcgagagcgcgtacgtccggcaccgctcgacgtcggcctcgatgccgtcgacgcaccgcgtcgcgagcaggcgggacgccgccgcgagcaacgtgacgctctcgagtgccgcctgcgcgatgacgggctgcatcacgttgagctcgaagatcgacccggcggcgcccgcgaagccgatcgtggcgtcgttgcccaccacgcgcgcgaccacctgggtcaccgactccgggatgaccggattgaccttgcctggcatgatcgatgagccaggctggagatcgggcaggcgaatctccgcgagaccacacctgggaccagaacccatccaacgcaggtcgttcgcgatgcgatacagcgccacacccagcgcacgcagactgcccgacaccgccaccacgccgtcacgagctccgtggacctcaaagtggttcgccgcctcgcgcacgtcgagccccacccgagcgccgatgcgtgcgagcaccgctgcggcgaagccctgcggtgcgttcaacccggtgccgacggccgtgccgccgagtggcacctcgcgaagctcgtccaccgcggccgcgatacgggtgcgtgcccgtgcgatctgggctgcgtatcccgagaactcctggccgagcatgatcggtgtcgcatccatgaggtgcgtccggccggccttgaccacggtggcaaagtcctcgctccgacggacgagcgacgcttccaaggtcgcgagcgcagggtcgagcgcgtcgcgaacctcgagcgcgaccgcgaggtgcatggccgtcgggaaggtgtcgttcgacgattgcgaggcgttgacgtggtcgttcgggccgacggtccgaccgaggcggagcgtggccagatgcgcgatgacctcgttcatgttcatgttggtcgaggtccccgatccggtctggtagacgtcgacggggaagtgctcgtcgtggaggccccgggcgacctcgtcggcgacggcggcgatcgcctcggccatctcgggatcgaggacgccccggtcgcgattctcgagcgcggccgcccacttgatcaacgccagcgcgtggatcacctgtggcgccatgcgctggcccgacaccgggaagttcccgatggcgcgctgcgtctgggccccccaggccgcatctgctggaacctccacctcgcccatggtgtcgtgctcgatccgcacccgttcgctcatcgcctgctccttggtcatcgccgcgtggactaccctggcaccgatgcgagctgtcgtgatcgccgacggtgccgtcaccgtcgcaaccgtagccgacccgaccgttggacgccacgaggcccttgtcgaggtcacctccgcagggatcaacgccgccgacctcctgcaggcgagaggcctgtacccgccaccacccggggtcgatccgacccggctcggcctcgagttcgctggggtcgtcgctgcggtcggggacggaaccaccgaggtacgccccggcgatcgcgtcatgggcatcaccggcggcggcgcacaggcggagtacgtcgtcgtcgacgcagccacgctcgtgcccgtccctgacgagctcgatctcgagcgcgcaggaggctttcccgaggccgccttcaccgccctcgacgcgctgctcatccaagggcagctcggcctcggggaccgcgtgctcgtgaccggcgcactcggtggcgtcgggaccatcgggctccagatcgcccgtctcgccggtgcccgcgtcacggcgctcgtacgcgatgagcgacgtgcatccgaggcctatgccctgggcgcacaccgagcactcaccctcgacgagctgccaggttcggggccctacgacgtggtgctcgagctcctcggagcagccagcctcacgcacgccatctccgagctcgcggtcggtggccgcgtcgtggtcatcggcgtcggtcagggctcacgcgtcgagatcgacctgcgcacggtaatggggtcacgagcagccctccgtggatcgacgctgcgcgcgcgcccgacccacgagaaggcagcgctggcccgagaggtcgcccaccgactcctgccggcgcttgccgaaggttcgctccagatcccggtcgccgcgacgtggccgctccacgacgccgccgccgcctacgaggcgttcgcgcgcccgggcaagctcggcaagctcgtgcttgccatcggcgacgtctgacgggttgcgctccaagcgcccgatcctcgcatctcgatccgcaggagctcaccagcgacgatggacgcagagcccaacgacgccgagagctcccaggcatgcagctccacgttccccgtcgggtcgagttcctcggcgaggccgtcgagtgtctgcccgggcgcgatgcgaacgacgcgcacgatcgttccgatgtgggggcgggcgacggcgcgtagcgcgccacagcacaccgcgaccacgacgagggcgagcgtggccgcgacccgcacccgttccccgcgcccgagacgacctcggccgggcggcctcctccgagcgaggcgctggttccgggcggagccccggctcgtcggctccgccgaacgcgccggcggtggcgtagcgggcgtagcgacgatcgcgagcgcagtcgaggcgggaggcgtacgaacgggcgcggtcacacccgtggcctaacccgagggtcggacacggcacgcaaatgtgacggctatttgcctatgcggatacatcttggcgatatactggcgacatgccgaggatcgaagcaccaaccgtccgcgaacatcacgatcagcgtcgtgagcgtctcctcgacgcggcacgggcgtgcctcgtcgacccggcgattcgctcggtcggcttcgaacacgtcggaccgcgcgcagggatccgacgcaacagcgtctacctctacttcccctccgagacccacctgtatcttgcccttgccgagagcgacgtccccgccctcgccaagcagttggccgaggcagcggcggcagccacgcacgacaagctcgccgccatcgtcgacgtcgtcctggcgaacgcgccccgggaggagttcgagatcttgcgccgcctggcgagtcgcaccgcgtcccagcgtcccgatctcgtcgcaactcgccttggcgagctgcgacgtgagctcgccgaaccactcgtctcggtgctcgccgacgagggtgtggactccgccgacctcgtcggattgctcgcccttggcaccctcgaggcggcactcgacgcgatcgctcagggcgaagatcgcgacgcggtgcgcgaggcagtcctcgccaccgtgcggagcccgcgcactcccagccgctgagcagcaggccacccggcacggcccgccggccgccgagtcacggttctgcctgccgaaggtcggcgtgcgcccgccgccatgcgctctgtgctgctcatcgcgaccggagttcgctccatgaggcaagtaggccgagcaccagcgcatcgaacctggccaactcctcgagtgaggcgcgctcgccgaggctatgaccctcgccctctgccacctggagttcgcacgcaaggctctcgccgacgcgctcgacgaacgcacgagattgctccaccggcaccacacggtccgcgctgccgtgcgtgatgaggaccgggatgcgccgccgcggtcggcggtgcgcgaggtgcggcgcgtcctggccgaccagccagtcgacgtcgccgagcgcggacgggtcgagcagtgggttggtcaacaccaacgcatcgagcagtgtcgggtcctcgaggatgagctgcaggagcgtccagcctgccgacgacgcgccgatgccgacgcgaggacccgcgaccacgccctcgaatccccgcacgacctcggcaagggcctctgactcgaccgtcccgaaccgaccgacgatacgctcgcgtgccgatcgcccgtagccgtacgaacccgggtagtcgaccgcgacgaccaccaagccgtgtcggagtgcgcgacgccacttgtcggggaccgggaacgcgacctgttcgacgggaccgccatggacgaccagcgcgacaccacgaggtaccgggggccagatcgccacgccgcgtgcggccagccccaaggccccaagtggctcgatgcgagaaccgtccaccccgtccgagcccgcctgccggagcgtctcggacccacggcggacccgctccgaccacggcccccgctcgatgcccacgacgtcaccgtcgatggccgagatcgaggtccacgagcccgacgccacgcgacggaggcgctcgtccaggacgacgagcgcgggcgcctccacggaggcgatcactccgagcaccgcctccgagtcggggatgtagccccgacgaccaggcccaagagggtactcacccacgtcgtagtcgagacccgcgatctggggcacccgccccgcgagtaccgggacgtgcgcaccggcgcgatcgtcacgaacccacagaccgcccggtccgaaccgcggctccaccacactcgcaccgtcaccgccgaaattccccgcgatggcgccggtcgggtcgagaagcatcaccgaccccgtgagccacggctcgcgctcccccgcccgggccaacgcgatcgaaccgtcgtcgtcgacggccacatcccagaggtccgagaccccaaggcggccgaggtccaccacgttcaccagccgagcctggtcgtcgaagacgacgacgcgagcgtcgctcaccaccgcaaccatggctccggcgggagaaccggcgatccaacgcacgccgggcacggtggcgacgtgctcgatgcctcgtcccggcacgactcgcacgacggaaccgtcgacgcacaacacccacaagcacgagctgcccatcgcgaggaccccgccgttgccgggacgcgcccacgctggcgtgacgtcggcgcagccgagtgcagtcacggtgctcgccaccacgaccccgcgagcactgcgctcgatccacgcgacgcccagcggacctgccaccacgtcggcgacgcgctggacgacgtcgctcaccgaggcggctcttcgtagaggccgaacacctcgccgagcgccatcatcacctcgccgacgctcgctctcgcgcgagcggcatcgatgagagcgggcatgaggttgcgctctggatcgcgcgcctcgtcgacgaggcgtcggatcgcagtccgctgggcctcctcgtcacgctgacgccgcaccctcctgagtcgttcgatctgacgcgcttcgacctcgggcccgatcacgagcgtcgggatctcgtcctcctcgttgccggcggtgaaggcgttcacaccgacgatcacccgctctccggcgctgatgcgcttctcgagctcgtaggcagagtctgcgatgcggccctggtagtaaccgtcgtcgatcccgacgaaggccccctcgagcatggaccccccaccgaggcgctcgatctcggcgaagatcgccgaggctcgtgcttcgagctcgtcggtgagcgcctcgacgaggtaggagccgcccaaaggatcgacgacgttcgccacacccgtctcgtaggcgatcacctgttgcgtgcgcagcgcgatgcgagccgcacggtcggtgggcagcgagagcacctcgtccatggagttggtgtgcaggctctgcgtgccgcccagcacgcctgcgagcgcctcgagcgcagtccggaccacgttgatctctggctgctgggcggtcagcgacacgccggcggtctgcgtgtggaagcgcaactgccacgaacgtggatcgcgcgccccgtagcgctccctcaaccaacgggcccagaggcgccgtgcggcgcggtacttcgcgatctcttcaaagaaatcgatgtgggcattgaagaagaatgacagctgcggcgcgaacgcatcgacgtcgaggccggctgcctggccgagctcgacgtaggcgaagccgttggccagcgtgaaggcgagttcctcggccgcggtcgagccggcctcgcggatgtgataacccgagacggagatgggatgccacttcggcatctcggccgcggtgaacgcgatggtgtcacgcaccagtcgagccgatggacgaggcgggaagtagtactccttctgcgcctgatactccttcagaatgtcgttctggagcgtgcccgcaaggcgctctcgtgcgacgccacgctcctccgccaccgcgatgaaactggcgaggatgaacgccgctggcgcgttgatggtcatcgacgtggtgaccgcaccgaggtcgatcccgctaaacaggtcccgcatgtcctcgagcgtgtcgatggcgaccccgcacttgcccacctcgcccaccgaccgagggtcatcggagtcgcgtcccatgagcgtcggcaagtcgaacgcgaccgagagcccggtgcccccgttggcgagcagctcgtggaagcgctggttggtctcgatggccgtcgagaagcccgcgaacatgcgcatcgtccagcgcttcgttcggtagcccgaggcgtagacgcctcgagtgtacggatactgaccaggcagctcctcgtcgggatcgaccatggctcccgcgtcgtccgggtcgagcgcgccgtggcgcccgtagaggggagcgaggggcacccccgagagcgtctcgaaggcctcctcgcgcgttccggctcgacgatacgcctccgaccaagccgacagatcacccatgggccgattctaccgaacgtcgctgacgcctccaaggcccgtcacccatgcgatcccccgacgcgggtggtacaggctgctaacgttggcgcgtgaccatcgacgaccgaaccccggaccgcaacctcgctctcgacctcgtccgcgtcacggaggcagctgcgctggctgcgagcgcctggatcgggcgcggacagaaggagtccgctgacggcgccgcggtcaacgcgatgcgctcgatcctcgcgaccgtgcccatgaccgggacggtcatcatcggcgagggcgagaaggaccacgcccccatgctctacaacggcgaggtgatcggcgacggtaccggcccagtggccgacgttgcggtcgacccgatcgaggggaccacgccaaccgcgatggggcgctggggtgcgatgagcgtgatcgcggtcgcgacgcgtggctcgatgttcttccccgggccgatcgtctacatggacaagctggcctccggacccgagggcatcggcgtcgtcgcactcgacgcaacgccacgcgacaacatccgcgagctggcgcgtgccaagggcgtcgctcccaaagacatcacggttgccatcctcgatcgaccccgccatgcggacctcatcgaggaggtccgtagcgccggagcccgcgtgcggctgatcggcgacggcgacgtctcggccgcggtcctcaccgcgatcgacgagagcgatgtcgatctcctcatgggcgtcggcggctccccggaggcggtgctggccgcggctgcgatgcgctgtctcggcggacagctgcaggccaggctgtggccccgcgacacggacgagcgcgaccgggccctcgcccagggctacgacctcgagcacgtcttcgcgaccgaggagctcgtcgacagcgacaacgtcttctttgccgggaccggcatcaccgacgccgagctcctgcgcggagttcgcatcgtgggcggacgcgtccatacgcactcgatcgtcatgcgctcgcgttcgggcaccatccgcaccgtacgcgcccagcatcaactcacgaagctgagggcgatccagctgctgtcctgagcgagcccgagggcccgtgcgagcggagccccaacggcgacggcgccacgttgctcgagcaacgccgttcctgcggggccaacgagtgcggccggggcgagcgaggcgccaagggcgtcgcgtagcgcggagccgacaccgaaccctcgcagatcggggtcgaagacacgcgcatcgacgagcacccaggccgcatcgctcgctcgtcgcgctgagacgacgccgatgacctcatcgtcgacgaaggcgagggcactgcgctggtgcagcgtcggcgccgcggtctgagtcagccaggctccatcgctgacgacgacacgtaaccgcaggtgcgaccgtacgacgatccagctctcgcccacgcgcgcctcgagcacggagcgccaccatcgcctcggatcgcgcatccgcacgagcaggaccgcgaccgccctcggctcgagcggtgctcggaagtcggtcccgaggtcagcgaggtgttcgagcgactcgagcgcacccccctctcgaatggtcacgtggggcacgaacgggcgatcgtccggccacccgagctctgcggcgagcccggcgatccagccgtcagggtcggccacggccagatgcgcggtcgggcgccggttggcgaagacgccgatccccgagaactccgtcactggtggatccagccgcgcgacgacctcggcgacctgccggaggagtgcagcaacgccggcagcgtcacgctcatgcggcggcagcaacgtgatgtgcggcacgatgcgatcgagcgcgcgcgagccgacgacacgcctcacggcatcgatgccctcctcctgggcatgcgacagcaccagcgcgacggcgacccgaacgcggctcacaccgacagccgagactcccgcagctcgaggcccgcccgatagggggccacgaagcgctcgtccacgtcgctcgcgagctctgcgacgacacgccgccgcgactccagcgacgcctgatcgatgtcgcccacgaactccgcggcacgcgcgagcacgacggcacggttgccaccgacgcgcaccagaccgccgtcgatgaccagttcctcctgggtgccgtcggcgagccagagcttggccacacagacctcgacctcaccgacgaaacgcccgtggttggcgaggaaggcgatgtcgccggtcgggacacgcatgacgagttcttcgacggctccctcgaacacgacctcctcgggagttgcgatcacggcatcgaaggtcgcgcgcatctctacccgagctccttggccttggcccagacgtcctcgatgctgccggcgttcaagaacgcctgctccggaacctgatcgaggtccccgcgaacgatcgcctcgaaggactcgatcgtctccgcgatcggcacgtacttccccttgaggccggtgaacacctcggccacgaagaacggctgcgacaggaaccgctggatgcgccgcgcccgggcaacgatgaccttgtcctcctcggagagctcgtcgagcccgaggatggcgatgatgtcctgcagatccttgtagcgctgcaggatctgctggacgctccgagccacctggtagtgccgctcgccgacgatggtcggatcgaggatgttcgacgtcgacgccagcggatccacggcgggatagataccgagtgaggcgatctgacgcgacagctcggtcgtcgcatcgaggaacgtgaacgtcgtgaacggcgccggatcggtgtagtcgtcggccgggacgtagacggcctgcagcgaggtgatggagcggcgcctcgtcgaggtgatccgctcttggagctcacccatctcgtcggcgagcgtgggctggtaaccaaccgccgacggcaagcgcccgagcagggccgacacctcggacccagcctggacgaagcggaagatgttgtcgatgaacagcaggacgtcttgatccttgacgtcgcggaagtactccgccatggtcagcgcagcgagccccacgcgcagacgtacgcccggcggctcgtccatctgcccgtagacgagtgcagccttcgagatgacgcccgactcttgcatctcgaggagcaggtcggtgccctcacgtgtgcgctcccccacgccagcgaacaccgacacgccgccgtgctgctgcgccacacggttgatcatctccatgatgagcaccgtcttgcccacgccggcaccgccgaagagtccgaccttgccaccttggacgtagggctcgagcaggtcgatgaccttgatgcccgtctcgaacatctgggccttcggctccaggtcctcgagcggcggtgccgaccggtgaatctcccacaggtcgtcagcaccctccaacgacggggcgtccaggggttgaccgagcacgttgaacacgtggccgagcaccgcatccccgacgggcacgctcagcccgcgccccagcgcacgcaccggcacgccacggcgcaggccatcggtgggtcgcagacagatgcagcgcacccgtccctcccccagctggcgcgccacctcggcggtgatggtgacggtctcgccgtcgacctcggcgtccatctcgagagcggcgttgatctccggcaaggcgtcgggagggaactccacgtcgaccactggtcccgcgatcgagaccactcggccaaggacatgctcggcgttggtcatagcagctcactttccttcttcagcgcccccgccgtcgcgagagcctcggctccacccacgatctcggcgatctccgtggtgatcgcatcctgccgtgctcggttcatcgctcgtgtcagcgtccgtaccaactcgttggcgttgtcggtggcggtcttcatcgcccgctgccgggcagcgtgctcggcggcggacgcttccagcaagagtccgaagccctccgccacgatgaggtcacgcaggctcacctcggtgagcaccgccagatcggggtcggtctcgacctcagagcgcgactccgtcccgtccaacagatcgtctcgacgcatcggagcgaggtgcgtgacctcggtgcgctgggacccgagcgagtagaagcggttcgaaatgacgtcgatcccaccgatgacaccctcttcgagctgcgcgatcagcggagtgaagagtcggagcgcctgctggtaggtcggctggtgggtgacgtgatcgatctggtgatcgacaccgacaccgcgaaaatgcgcccaggaaccgaacttgcgcccgactcccaccacgacacccacgtcgccaccgcgacgccgccgctcgaaggctcggatcacgttggcgttgtaggctccgcacaggccgcgatcggcggtgaccacgacgacggccacgggaccggaggcctccagcagaggactgcgcaacgctggctgcgccgcgaccagcgttcgtgtggcgtcgctgagttcccgatagtacgtacgcgcctgggcgatgcgccccaccgccttgacgatgcgagaggcggcgatgagctccatcgccttcatgatcttcttggtcgagttcacactgcggatctgtgcccgcagtgctcgctccttgccgcccgccacgcgctaggccccctgatggagtgccttgaaggccttgatcgccatgtcaagccgctcgcggtcgccaaggcgcttcgactcgctgatctcctggagcacctcggggtgctgagcccgcaggtaggcgaggaacgccgcgacgaaggggccgacctcgctggtcggaacgtcatcgacggcaccgctggtgccgacgtaaatggagacgacctggtcctcgagcgacactggctgaccttgaggctgcttgaggatctcggtcaagcgatacccgcgatcgagctgggcctgggcgaccttgtcgagctcggagccgaaggtcgcgaacgcctccaactcgcggaactgcgcgagttccaggcgaagcgagccagcgacctccttcatggccttggtctgcgccgacccgccgacgcgcgagaccgaggcgcccacatcgatcgccgggcgcacgccagagtagaacaggtcggcgtcgaggaagatctggccatcggtgatcgagatcacgttcgtcggaatgtaggccgagatgtcgcccgccttcgtctcgatgatcgggagcgccgtgagcgagccaccaccgagttcgggcgacagccgagccgcgcgctcgagcaaccgggagtggagatagaagatgtcacccgggtaggcctcacgccctggcgggcggcgcagcagcagtgagagctgccgataggcatcggcctgcttggagaggtcgtcgtagacgatgagggcatcgtctcccgactccatccagtgctgaccgatggcacaacccgcatacggggcgaggtacttgaacggcgctggctccgacgctggcgcggagaccacgaccgtgtaggccaacgcaccggctgctcgcagcgtctcgacgacgctcgcaacgctggtgcccttctggccgacggccacgtagatgcacttcacgccctggccacgctgattgatgatggcgtcgagcgcaatggaggtcttgcccgtcttgcgatcgccgatgatcagctcgcgctggccgcgcccgatcggcacgagcgtgtcgatggccttgatgccggtctgcaggggctggttcaccggctgacgcttggtgatgcccggggcctgtacctcgagacgacggctaagactcgcggcgatcggcccgagaccgtcgagcgggcgccccagcggatcgatgaccctgccgagcagctcgtcacccaccggcacggacaggatctctcctgtcgagcgcacgatctgaccctctcggatcccctcctggtcgccgaggatcacggcaccgatggcctcttcgtccaggttcagggcaaggccgaccgtgccgtcctcgaagcggagcatctcgttcaccgcgaccgacggcaagcccgagaccagcgcgatgccgtcgaagagctgcagcacgcgcccgatctcctcgccgccctggtgcggcgcgaactcctccatgcgtcgccggatgaccccagcgacctcttcctcggagatttcgaagtgctccatcaccatttcactcccctacgcgctgacgagacgacgagcgtcgtcgagctgacgtcgaacgctttgatcccagagacgatcgccaacgatcgccacgatgccgccgatgaccgactcgtccaccacccactcgacctccacgcgctggccgacgagccgctcgaggtgcgtacggacggcgtccgcctcatcgtcacgcagcgaacgagccgtgcgaaccgttgcgacccgcaacgagagctgtcgggcggcgagttcgagcagccgatcgacgacccggccgatcggtcgcacggaactcgtcgcgacggccgcacgaaggatccaggtcgtccggacgctcacgcgcggcccaaacagatccccgatgatggcgaggcgtgcttcgcgcgttccctcgaaacccgacagcacgcgctggagtgcccgatcccgttcgagcacctgtgccacaccgcgaagttcgtggagcaccggctcgagctcgtcgcgcgctccgaggtcctcgaagatggcccgcgcatagccgatgacgcgcccgatggtggcaaagtcgccggggccctcgaggaccatgtcggaggcgaccagctcagggagttcctcgagcgaatgcaccacctcgccgacgacctcccacgcgacgacagcgtcgaagagccgcagagcgagcgagctgacgcgctccccgacgaggtcgtggagcactccttgacgacgatcgacgtcggcggctcgatcgtcgagggcgacagcgagctggacgaagcgctcgcacagctcggcgacgccgcgagcgtcgcgttcgagctccgaggccgttccggcctcgcgagcgagatcacgcagggcgagggcgtagcccttcacgagctcacgcatcagtcagcgggctccgcctctcgcaagaaggcctcgatgagcggatcgaacgatgactgctcgagctctcgtgcgacgatcttgccagcgagctcgaccgcgaggtcagcgacctcggaacgcagcgagcgcagcaactggacacgctctgccgccagttgcgcctccacctgcgcacggatcgcctccgcctcggcacgggcccgctcgctcgcctcctgcctgagcgcctccgcggtccggcgagcgtcgtcgaggatgcgacgcgcgtcctcgcgcgccccctggagctctcgttcgcgctcggcccgcagggcctcggcctcgcgtcgcgcagcatcggctgcctccagatcggcacgaatgcgatccgaacgctgcgccatcatccgcgcgaccggcgggtaggccaccttggccaacaccaccaacaagatgacgaacgagatcaccgaccagacgatctcccccgtgctcgggaggatcgggttcggcgactgagtgacaaccgcctcgagcatgcgatcagccggtgtacttgaggagcacgaagacgacgaagccgatgagggcaagcgcctcagcgagcgcgaaaccgatgaacgcgagcgagcggacggctccagcggtctcgggctgacgcgcgatcgcagagaccgcctgcccgaagatgatgccgataccgatgcccggtcccaacgctgccaaaccataggccaagcccgaaccgagttcggcaagacccttgcgcaggttgacgctcgacgctgccgcgatcaccgtggcaacaacgttgtgcattgatcctctctctctccgctgtggtacccccgggttctccacccgagatctcgatcccccgaccgtgacgcacaggcctcggaacccgacgcgccgggggcatgctagtgcccagccacccccatggcctcgccgatgtagaccgccgtcaagatcgtgaagatgaaggcctgcaagaacccgacgaagatctcgtagcccgtcaccacgaccagcatcgcagctggcagcggcagcgcaacgagggcgatcgacttcacgaagagcgcctcggagatcaccgcgaacgtgatgagcagcaggtgacccgcgagcatgttgccgaagagccgcaccgcgagggcgaacggacgcacgagaaaggtcgacaagaactcgatcgggacgagcaggatgagcaggacccccggaacgcctctcggcacgagcgcgctgcggaagtagccagcgaacccctgtcgcttgatcccgaccgcgaggaaggtgacatacgagatcacggcgagcgggatggtgacgctggtgcgagccgtggccggcatctggatgaaggggacgacctcgaacaggttgttgaagaggatgaagaagaacatcccgacgagccagggcagccagctcaagccctcagggcccatcacgtccaacacgatggtcgagcgcacgaaatcgacgcccgcctcgacgacgttctggacgccccgtggcacgagttgggcgcggcggccggcaagcccgaagagcacgagcgtgatcgccgccgatgccagcgtcagcaccgcgatcttgttgaacatgaacgcagtgccggaaaaggcgatcggacgccagttcagcacctcagcgatcgggggaaagctaatggcggcgagcatcaccgaagcaccctccacggacgcagtccgtcgtcaccgatccgcccggacacacgccgcgcttcgaggacgaccgcaacgagatagccggcgatcaccaccgtcgcaaagacaccgaggcgcatccagtgagcatgcaccagggggacggtgatcgcggtcagcagaccgagcccaaggatgagcgaggcaaacgccgccaccatcaagcccccgatgccaaacctcgcgccctcgcgaaacgccacgaccatgatcgcgaaggtcagcgcgacgccggcgagcgcgaacgcggcggtctcgaggccagcgataccatcggcgatgccgccacctgcgagggcaaccggcgcaaccaaggcgagacgggtgagaaacccgagggcgagacgcgtctcgggactggtggtactcatgccctcggacgccccccgaactcgggagcatcgagcgtacgggcggcctcacgcacctcgtcgggtacctcgagcgatgcctcgagcacgcgcccacgaccaggccgctcgggcgcacgagacggtgcggactcgacgacagcggccaccgaccgctcgagtccctcacgcgctcggtagatcaacgagagcaacgagccgacgaccccgaggccgccgatcacgaagccaaggatcacggagtgagacgcgcgcccggcccagaagccgagcaggatcacgatgacgagcgtgccgaaggcctccacgaagtgggccacagcctcactcgcccccgagatcatcgggtgcgcacccgcgcctcgtttcaccgcgtcctctccccacgactggcccactcggccgcgctcatgctagcaggcaacctcggagcggccgccgtcaggaaccctcccgggtacccgagtgacgccgtagatccgggtgcaacaaggtgaacagcagcaccgccgccgccacgaccacgatcgggagctcggccgtcaaggacggaacgaacgacggcaccaacgcaaaggctgacagcacggcggtccaggtccacaagatcgccaccgcccgtcggggcccatgccccatctcgcgcagccgatggtgcaggtgcaagttgtcgggcgtggcgacgctctggtggtgccgtgctcgacggagcaccgcgagcaccatgtcgaccatcggcacgccgaggatcacgaacgggatgacgaggggcgcgaagaagaagaacgtttggtccgagacgttggcggtacgacccccgacgacggacgtcgcggctgcgagcagcaacccgagcagcatggcgcctgcgtcgcccatgaagatccgcgctgggttgaagttccagggcagaaatccgatggccacgccagcggttacgaaggcgacgaccggaccgatcgacgactccggcagctggcccaacgcctggaggtgcaagctgtagatcccaaaggcgatcgacgcgatcgcgacgatgcccgcagcgaggccgtcgagaccgtcgatcaggttgatcgcgttcgtcatggcgaccacccagatggcggtgagcaacggcagcatggacggcgcgagcacgacgatacccgcaaaggggaccttgaaccagaacatcgtgacgccgaagtaccacaggatgctcgcagcgagcacctgggtcgcgaccttggccggcgccgacaggtcgaccacgtcatcgatcgctccgagcacacagatgacggtcgcggcgagcgcgacccccagcggctctgacgagtcgaagaacaccgcgcggaaaccaccgatcatgctcgcggcgccgaaggcgacgagcacgccgaccagcatggcgagaccgccgagggttggcgtcgcacgttcgtggacgtggcggccaccgggttggtcgatcgcgccgactcggagcgcgagcacccgcacgagcggcacggccaaggcggtcacgaccgcgccgatcgcgccgaccagcagatagcgcatcaggacgcgaggccaggcggcacgaaggccgcacagagctcgcgaacctgctggcgaacctcccgaaccacttcgtcggtgcgggcgcgcagcacggtcgcgatcagcgaccccacgcgcttcatctcctcctcacccataccggtcgtggtgagggccgccgtcccgagacgcagccccgaggtgacgaacggggaacgcggatcgaacggaatctgattgcgattgagcgtgatgcccgcggcatccagcaggtcctgggcggtcttgccgtcgagttctggatcgaagtcgcgaagatcgacgaggatcaagtgcacgtcggtgccgccagagacgagacggaaaccctcggcctcgagcgaggccgcgagcgtctgggcgttcgccacgacccgacggccgtagtcgcggaacgacggtgaggcggcctcgcgaaaggcaacggccttggctgcgatggcgtgctcgagcggtccaccctgcagtcctgggaagaccgccttgtcgatggccttggcgacgtcctcatgaccgacgatcgcagcacccctcggtcctcgcagggtcttgtgtgtcgtgaaggtcacgacgtcggcaccgcgctcccccgacgcgagccacaacggattggggtacaccccagccgcgatgagaccggcgacgtgggctgcgtcgaagagcacgcgcgctcccacctcgtccgcgatggctcggatcggggtgacgtcgatgacgcgtgggtacgcggtcgcccccacgacgatgaggcgcggatggtgcgcccgtgcgaggtcggcgagctggtcgagatcgagccactcgcgattcggatcctcctggcggacgccatagccgacgaaacggtagagctggcccgagaagttcacgggcgagccgtgggtcaggtgtccaccttggtcgagccgcatcgccaacaccggatcacccggcgccaagagggcgaggtaggcggccgcattcgcgttcgctccagcgtgcggctgcacgttggcccacggcgcgcgaaagagcgctcgcgcgcgctcgatcgcaagggactccacctcgtcgacgacggcgttacccccgtagtagcggcgaccggggtagccctcggcgtacttgttggtcaacaccgaaccggtcgcctcgagcaccgcagcggaggtgaagttctccgacgcgatcagctggagcgtcgaacgctgccgctcctgctcgcgcacgaggagcgcggcgagttcagggtcctctttgctcagcacgcccatggctcctcccttctcgcctcattgtaggcgtctcgcccgtggagcctcagcgaacctcgaccggctcgccgagcacggcttcgacgtccgatggcgcgaccgcaccctggcggagcacccggacctgcggacccgtcaggtccacgatcgtggacgcgacccggcccgagggacctggagcccacaggacgccagcgagccgaccagcgaccggactgccgtgggcgacgaggtcggcgagcgccgtgtcgacgtccgatggcgtcgccacaccgtgccagttcgccgaggaggcagcgagcggccgaccggtggcgagttcggccagccactcgacgtcggggacccgcagtgcaacgctccggcccgagggattgaccacgtccgcgagcgttggggcgtccaccacggccgagatcggtcccggccagagcgcgccgagggcccggagcctcgaccggcgacgtggctcggcgtaggcgagcgcctcgtcgatcgatccgacgagcaccggcggcggcgtcgtggtcgagcgacccttcaacaccgcgatgcgctcgagcgcgcgtcgactcgtcgcggatccgaccaaccccgggaccgtgtcggtcggcatgaggaggaccgaacctccatcgagaatcgtggccgcgcgtcgaaacgcctcgactccttcgagcgagggctcagccggctgatcgccgaggagttcacgaagccgcacgagtcgctccaggccaccgcgcgacgagcacccggggccggccggcaagatcgcgttccacggtcacatcaccgtagccctgcgcgctcgcctcggccaccaaccgctccccttgtgtctcaccgatctccatgaagagccaccctcccggccgcaaggcgacccgcgcaccaccgatgactgccatcggaccctcgagacccgacgggcccggtacgagtgccacccgaggttcgaacactcgcaccgcagggtcgagacgctcccactcggacgctgcgacgtaggggggattggcgaccacgacgtcgagcgactcaggttctgccccctcgaaccaggagcgacgcacgagcgtgacgagcgcacctgtcgctcgaacgttctcccgcgcgagcgcaagcgcacggggatcgacgtcgctccccgtcacctcgaggcgcggaccttcgagggcaagggagatcgcgatggcacccgagcccgtaccgacgtcgagcacgcgcatcccggtgcgcacggccgcgaggacgtgctcgaccagctgctcggtctcgtagcgcggaatcagcgcacgatggtcgacccggagctcatgacctcggaacgaccacgtgccgagcacgtactgcaggggctcgccggccgcgaggcgggcctcgagacggcgcgcgatgactgcggcgctcgcaccggacgaggcggcgcgtcgcgccaccgcctcgtcgaaccagcgtcgctcagcaggtcgcatctccgcgctcacgcatcgcgcaacgcggcgagctgctcctcgcgctcgtggacgaggagcgcatccgacagctcgtcgaggtcgccctggaggatctggtcgagccgatagagcgtcaggccgatgcgatggtcggtgacgcggttctccttgaagttgtacgtgcggatcttctccgaccgaccccccgagcggatctgcgccttgcgcgtggcggtgagctcggcttgacgcttgtcttgctcgagcttgagcagacgcgcgcgcagcacctggagcgccttggcgcggttctggatctggctcttctcgtcctgcatggcgacgacgatccccgtcggcaggtgcgtgatacgaaccgcagagtccgtggtgttcacggactggccacccggcccggtcgatcgatagacgtcgatgcgcaggtccgacgggtcgatcgacacctcgatctcgtccgcctcgggcagagcggtgacggtggccgaggaggtgtggacacggccctgggtctcggtcaccggcacccgttggacacgatgcggacccgcctcatgcttgagccgcttccaggcgtcatcccctctgaccagcagggtgacgtcgtcgtagcccccgagatccgacacgcttcgcgacaggacctcgaccttccacgaccgtcgatcggcccaacgctcgtacatatcggcgaggtccttggcgaagaggttcgcctcctcgcctccttcggctcccctgatctcgaggatcaccgcgcgaccgtcgttggggtccgacggcaggagcaacagctcgagtgcctcgcgagctcgcgcgagcgcggcatcgatctcatcgagctcggccttgagctcctcacgttcggcggggctcgcgccccgatagagctccctcgccgcgtcgcgatcgccttcgagcgcctgcacccgtcggagggctccgacgatggcctcgagctctttgtgacggcgagcgacctcccgggcgcgtcgctggtcctggaagatcgcaggatccgccagttcctcgagcacccgagcgtactcgtgctcgaaacgctcgtaccgatcctcgctcatggcgtctcctcgataagttcacacggtccaaaggcctcggcgatacgagccccgaggggcgcgctccccgcgacgacgagccgaacgacgctcgaccagtcaccggccagggcacgcgcctcgatggggagccacggatcgaccgctcggccgaacccgacgacggtgccgtccggcgcccacgcccacgctcggcccgccgcctcacgaacgcgatcgggctcgaagggccgcagcggctcctgctcgagccacgtggctcgagagcggcgcgcaatcgcgcgcggcacgctctcgaccccggggcttcgaccatggtggccatcacggagtcgccgggcgagcaggcgcgcctccgccagcagaccctcctcgtccaatccgagctcccgacgcatcgcccagtcgcgcggatcgacaccgacaacacgctcgccgtcggctcgcccaccgatcgtgacaccagccgattcgacgaggaccgcatccggccacgacgtcacgccgaccggcacgacgtcggccacggctcgatacaaggcacggagccacgcatcgcgctcccagtcggcgtcggtcgtgacaggcggtgcccagggctcgacagggacggggcgtcccccaacgagctgctcgagcaccgcgtgcgtccccttgagggccgcagcgacgcgatcgagacgctccgttggcccgagcgtcacgatacggacacgctcaaggtggcgatactcgacccaggccgcaaccgcgccggccgcgcccgtcgtcgtcaccacgacgatctcaccgtctcgacgacgcgcagcgccgtctgcgaacgcgccacgatcggggagctcgacgacgacgccgtcgggagccagcgcgttcgcgacgacaaacgcgagctcagcgtgcctgctggccgcgccgtgctcggtcaccgtagcggcgctggaagcgctcgacgcgaccaccggtgtcgacgagcttctgtcgaccggtgtagaacgggtgacactggttgcacagctcgatgtgcagttccgacttggtcgatcgggtctggaacgtgttgccgcatgagcagtgcacggtcgcgaccacgtactggggatggatcccttccttcacgatgcctccttcacactgatggtggactccgagagcgctgccgaggatgcctgggctgcgctagatgccagggctacgcgcgatctcggcgagaaactccgcattcgagcgcgtcgagcggatcttgtcgatcaagagctcgagacccgcagccggtgtgccctcctggctgatcgcaccgaggactcggcgcagcttccagacctgcgccaactcgtcgcgagtgaagaggagctcctcgtgtcgcgtcgacgaggcgttcacgtcgatcgctgggaacaagcggcgctccgcgaggcgccggtccaggcgcagctccatgttgccggttcccttgaactcctcgaagatgacctcgtccatcttcgagccggtctccacgagcgcggtcgccaggatcgtgagcgagccgccttcttcgacgttacgggcggcaccaaagaacttcttcggaggatagagcgcacccgagtcgacgccaccggacatgatgcgcccgctcgcgggctgggcgaggttgtaggcacgagcgagacgcgtgatgccatcgaggatgatcacgacatcgtgcccgagttcaacgagccgcttcgctcgctcgatcacgagttcggcgacctgggtgtgctcctccgcgggccggtcgaaggtagacgcgatcacctctcccttgaccgagcgtcggatgtcggtcacttcctccggtcgctcgtccacgagcaacacgaagaggacgacctcagggttgttgcgctcgatcgcgtgcgcgatctgcttcatcacggtcgtcttcccggccttcggcggcgagacgatgagtccgcgctgacccttgccgatcggcgcaacgagatccatgatgcgtgtggtgagctcgagcggatcctcggcgttctcgagcaccagccgctcgtccgggaagagcggcgtgagatcctcgaagcgagggcgacggcgagcatcctcgaccgtcatgtcgaagacgcgctcgacgcgcacgagcgccgggaacttctcgttctgggagctcgcccgcgcctgaccgacgatctggtcgcccttgcgcagcccgaacttgcgaacgagcgaggccgggacgtaggtgtcccgcgatgacgtcagacggccattcgctcgcaagaagccataaccctcgtcgcgaagatcgagcacaccgacggcctcgatgagctcttggacctgcggtccttccgcctcggccggccggtcaccgcgatccttgttgcgccgacgacgcgagcgacgactactgccctcgtcgccacgacgagcaacctcaccgcgcacctgctccgatgcttcaggagccccgtcgctctctgcgtgtgcctccgtccgcgctgcggccggactggcctcgccgcgtcctggcgagccatcgctccgttgcacactcgcatccacggcgatcggaggcagcagccgcgcgaggtcgaccgcaaggcgatcggcctccgcgagggtcggctctcgggtcccctcggtcgcgctctcggcttggggccgacgctcgcgtcgccgagtcgacgactgaccccgctctcgcggtccgctcccgacgacgctcagcgcgtcacgagcctgggcatcgtccgcgggcagcggcggaagcaccgcggcggctgcgtcctcgttcgcgaagaggctgcgatccccctcgtcgctcgcggatcggcgtgccatcgacgacgcctcgatcgcctggatgatctccgctttgcgcgatcgggacgaaaccttgacaccgagctcacgcgcgatcgccagcagcgactctcgatcgcggcgtgccagatcaccgagcacgtcggtggaactcaccatggggtagatcccttcttggtcaggaggaacaggcgcagcactggcgcggtcacgccagtccagcagctcgagcaatcgcgtcaagacctgcagacgacggcacgggtccctccacagtgcgcagcgcggtgtccgggtccttcaagccatgccctgtcaggatgcacactaccgtgtctgaccgcgctaggtccagtcggaggaggccagcaaccgaagccgctgaggcgggctcgcagaacaccgactcctctcttgcgagcagtatataggcctcgagaatggcgtcgtccgagaccgcgagcaccgtcccacccgagtccgacgtggcgttcagggcaccttgccacgaagccggacgcccgatccggatcgcgctcgcgatcgtctcgggatgctcgacgacctctccgcgcacgatcggagcagcgccctcggcctggacccccaccatcctgggcagacgcgtcgtcgcacccgcggcatgcgcttcgcggtagccacgccacgacgccgtgatgttgccggcgttgccaacgggcatcacctggaccgtcggtgcatccccgagctggtcgacgatctcgaacgcaaccgtcttttgaccctcgagtcgatccgggttcacggagttgacgagcgcgaccccatcggcctcggccagctgccgcacggccaccagggcatcgtcgaacgacccctcgatcgcgacgacgcgcgcaccatagagcaacgcctgtgccagcttgccccgtgcgatgcctgccgacggcacgacgaccacgctcgccaggcccgccgctcgcgcatacgccgcagctgcggccgaggtattgcccgtggacgcgcagatgaccgccctcgctccgcgagccttcgcgttggtcaccgcgagcgccatcccgcgatccttgaacgaaccggtcggattcaagccctcgagcttcaagaacacgcgtgcgccgacccgctcggacagatgcggtgcgtagcgcaacagcgtccccccttcgccgagcgagaccagctcagccccgtcctcgatcggcaacgcgctccgatacgcctcgaggatgcctggccaccgcagccgtctcacaacgccatcgtcgtgtgccatcgctcgcttcctcacagcacccggtatcgttgccgacgtccgaccacgtcgccgagcgtcaccaactggcgatcgatcgcctccatctgctccagcgtcgcctcgtgcgtcacgagcatgaggtgggcgtggccctccccggctccgagctgctccacctgcgcgatcgacaccccttcctcgccaaacacctcagccacccgcgcaaggacgccagcagcgtcgcgcacgagcagcgagatcgcgaatctgccggtgatcgacccagccgacagcattgtcggctcctctcgagccggtgccgtactgcggcgccccgcccggcggttctgcgcagcctcgaggatgtccgcgagcacggcggccgcagtcggcagcccacccgctcccgggccgatgaagaccagctcaccgaccgcctgaccttcgacgaagatggcgttggcggcgtctcgaacgcccgcaaggggatgctccctcggcacgagcgcaggaaagacctcgacgctcagcgcctcgccatcggcctcgtcgagtcgccgcgccgtggcgaggagcttgatctcagacccgctcgcgtgcgcgaagcgtacgtcggcggcggtgacgccgacgatgccctcggtccgcacgtgatccgcgcgcacgctgcgctcgaacgcgagggatgcgagaatggcggccttcgcggcggcgtcgcgaccgtcgagatctcgactcgggtcggcctcggcatagccgagtcgctccgcctcggccaccgcctccgcgagttctgcgcccgtctcgctcatgcgcgtgagcacgaagttggaggtcccgttgacgatgccttgcaaggaccagagacgctccccgaacagcgacgtgcgcaggactcggatcagtggcaccccacctgcgacggcggcctcgaacagcagatcgacaccgctcgcctcggcgagtcgctcgagcctcccgaggtggtcggcgagaacgtccttgttcgccgtcaccaccgccttacccgccagcaacgcgcgctccagcgccaacagcgccaccttcggctggcccatcagctcgacgacgatgtcgacgctcggatcggtgatggcagcatcgaggtcatcggtgacgagtcccatgggcacccaggcgtcacgtggtcgctggatgtcacgcacgacgatggaggtgagctcgatcggttcaccgaggcgccgctcgagcagcgcagcgtcgcgatcgagcaaccggacgaggctcgagccaacgacgccacacccgagcagcgcgactctcacgagcccacctccagacggaacagatcatcgagctgctcgcgacggacgatctcgcgggcgacgccgtcacgaaccatgaccacgctcggacgcggcaaccggttgtagttcgaccccatcgagtagccgtacgcccccgtgaccggagtcacgatgagctcgccagcagcgaggtcttccggcaacagggcgttggccaccagcacgtctccggactcacagtgcttaccgaccacgcgcatcgccgtcgtgtgcggcgcctcgagtcggccggcggcgacggcctcgtagccagacccgtagagcaccggtcgagggttgtccgacatgcccccgtcgacggccacgtaggtcctcacccccgggatccgcttgaccacgccgacacggtacagcgtgatcgcggcgggagccaccagcgcgcggcccggctcgacgaaggtgcgctccggatccatgccggccagcgttgtcgcctcggcgatggagcgcccccactcctcgagcgtcggtgcccgttcgtcacggacgtagggcacgccaatgccgccaccgaggctgacctcgtcgaccccccaggcttcgcgcaccgcccccatacgcccggcgagctcgccgaagggatcgaggtcgaagatctgtgacccgatatgggcgtggatccccacgaccgtgaggccgtgcgcacgcgcccacgtgagtgctcgctccgcagagccatcgtcgagctgaagcccgaacttggagtcgacctgccccgtgcggacgaaggcgtgggtgtgggcctcgatccccggcacgacgcggagccagagtcgccgacggccgagaccaagacgcgcgatgcgctcgagctcctcgtgggcgtcgacaacgattctgccgaccccaacctcgtcggcgagcaggagctcatcgacgcccttgttattgccatggagtacgatacgctccgcaggcacgccgcctcgacgagccgcctcgagctccccggccgaggcagcgtcccaccagagcccggtgtcggcgacgatgcgggccatcgccaccgcagagaacgccttcgacgcataggtcacctgcagcgcacccagccccgaccgcagctcgtcgatgcgtgctcgtacctcgtcctcgtcgtagacgaacagcggcgtgccgaagcgatcggccagctcgtgcacgctgatgccctggatcgtcagctcgccgctcgcgccgatgcccgccccacgaggccacaggcgcactgggagcgcaccgaggcgctcacccacgcctacatctcctcgaccgcgcggaccccgatcaaggcgagcgtccgcgccagcacctgaccggtgaggtccgcaagtgcaaacctggccccgcgtaccagtgggtcgggctcgaccaggatcgggcagtcgtggtagaagccgtggaacgccgaggccgcctccagcagccaggcgacgacgcgatgcggcgcacgttcgacgatcgcggtctcgagcacacggttgaggcgcaagagcacacgagccagctcgagctcgcgagggtggccgagggcagtgagcgatgcggcggggtcgagagcgagacccatggctgccgcctgtcgacggagcgccgcgaccctcgcatgggcgtactggatgtagtacaccgggttctcgctcgactcggcccgagccttgacgagatcgacctgcgaggcacggtcgatcgacgacgacagcgcgagcaagcgggtcgcatccgccccgagttccttcacgagccatgagagcgcgatcgccgttcccgcacgcttcgagaacttcacggcagcaccgttgtcgaggagcgacaccatctgcccgagccgaatctcgagacgccggtcgtcgatcccgagggcgcgcatcgctgcatgcaggctcgccacctgcccgtggtggtcggcgccgaacacatcgatcgcgaggtcgaatccccgcacgaccagtttgtcgtagtggtaggcgatgtcgcccgcgaggtaggtgtagtcaccgttcgccttgcgcagcacgcgatcacgcgtatcgccgaagcgttcggccgcaaaccagagtgcaccgtcggcctcgtaggtcgcgtcgagagcactcaggcgtgcgacgacctcctcgacgagtccgccaccttcgatcgctgcctgggagtaccacgaatcgaagtggatgttgagctcttcgagggtggctcggatcatggcgaggatctcgggcacagcccagctgcccgccgcgaccacgtcgtcggggccgtcgtagcggcccgagagctcgtggacgtagtcgccgcggtagccctcttcggggatgggctcccctcggcgtgccgcgaggatcgaggcaccgagcgagcggatctggccgccagtgtcgttcacgtagtactcacgcgaaacctcgaaccctccgtgggccaacaagcgtgcaagggcgtcgccgtagatgctgagccaaccgttgccgatgtggagaggaccggtcggattcgccgagacgaactcgacgagcgcccgtgcaccgtgaccgacgtcgacagcgagcgcggccgcaagatcggccgccatcgcctgcacgtcgccgagcagggccgctgggctgagatggatgttcacgaaaccagggccagcgacctcgagacgctcgacacggccagcgacacgcggttcgagacgcgcaacgagtgcctcggcgagcacacgaggtgcgaccccgaccgtgcgcgccagctcgagcgcgataggcgtcgccaagtcgccgtgcgcgcgctcgcgcggctcgacgagtgggccgacctcgaccgcatcagcgatgccgcgagcgcgaagctcctcgtgcaccgccgtcaccagaacctcgtggagccaacccgcggtggtcacctacgtcctttacgctgccaggggcgcttgcccggggatactgccgagccagcctaccggcccgcggcatcggaaccacgaggtcgcccgacgagtacactcgaagcgtcgcagcgtgtggcccccgtagctcaggggatagagcaccggcctccggagccgggtgcgcaggttcgaatcctgccgggggcaccagagcgtcgcgcgtcgacgagcctggtgcctgagcctggcgacttgagcacccgtcgacgacgcgtggttccgacgagggcacgtcccagtgggctcgcatccggtgggctcggtccccgatcgagcgaggccggtactccgttgctaccgagccagcttcgcgaggatcgcctcacgtgcggcctcgcgatcgtccaaccggtagaccgtctggcccacccggaaggtctgctcgtggccgcgccccacgatgagcacgacgtcggactcctcggcgatctcgatcgcgtggccgatcgctccacgccgatcgagttccacgatgatctgcttgtggtccacgtcgagcgtgcctgcgagcagctgcgccacgatctcacctgggtcttcgtcgccaggattgtcggccgtcaagatggcgacgtcggcggtcgctgcggcccgtcccagctcgggacgcttcaggcggtcacgtcggccccgagcccccgcaaccagaatcactcgtcccttcggggagagcgctcgtgcggtcgcaatgagcgctcgcagcgaatccggcgtgtgcgcgtagtcgaccacgaccgtgaacggttgtcccgcgtcgatccgctggaagcgccccgcgacctgatgacactcggccagcccccgctcgatcgtgtcgccctcgatcccgagcgcttctgcgaccgccaccgccgctgccgcgttgtaggcgttgtgaatgccgtagatgggcacacgcagacgccagcgacgccggccgccgacgaccacggtgaagatcgtcccgtactcgtcgtagcgcacgtcctcgacgcgatagtccgaaaacggggctggcccgtaggtcaccgcagggatgcgaacctgggtcgcgagccgcacgccccactcggtgtcggtgccgatcaccgcctgcttggttcgctcgggtaggaagagctgggccttggccgcgtagtactgctcgatggtgccgtgatagtcaaggtgctcgggcgagaggttggtgaagaccccgattcgaaagctcgtgccgtcgatacggtgctggtcgattccgtgcgacgacacctccatcacgacggagtcgactccgtcgtcgaccatctgccggagcaagcgatgcagctcgggcgcctcgggcgtggtgaacatcgacggacggttggagtccccgaagcgcgcctcgatggtgccgatgagtccagttcggcggccggcaaggctcaagatggagtcgatgaagtacgaggtcgtcgtcttgccattggtgccggtgatgccgacgagatcgagccgctccgatggacggccgaagaaccccgcgacgagcccgccgatcgcgtgccgcaccgacggaaccacgagttgcgggatgtcgagtgccacctcgtgctgcacgagcagcgcgacggcgccacgcgcgatcgcatcgctgacgaagtcatgaccatcgaaacgcgatccccgcgtcgcacagaacatcgctccaggcgagaccgaccgtgaatccagcgtgatgtcggcgatcgccaccgaggggtcgcccaccagacgagcgcttggcacgagtccatgcagatcacgcagcgtcagcacaacggcccttgcctcttcctctctgggttcttcagctaggctagcgctccccatggagcgatcaacggccccctctcccacctcgcacccagcgatcaccgtgagcgtcgtcatcgccgcctacaacgccgcggccacgatcaccgacgcgctcgagagcgtgcaccgccagcagtatcccccgatcgagatcatcgtcgtcgacgatggctcgaccgacgacaccatcgcggtcgtcgagcgcagcggccttacgagcgccatcatccgtcaagccaatcaaggcccgtcgcgtgctcgcaacgccggggtccgcgcagcccacggagactggatcgcgttcctcgacgccgacgacgtgtggcatccagccaagctcgccgagcaggtcgcggtcgtcgagcgccacggcgacgcagcgatcgtcgccaccgattgggcgcgggccctcgaccagctcggggtgcctgccgcgagccacctggagtggttcggctaccgcgacctcgtcgtcttgaatcgctttcagacctccaccgtcctcatgcgacgcgctgtgctcgatgcgatcggaggattcgacgcctcgctcgacggcgtcgaagattgggactgctggttacgcggtgcactccacggcccggtggcactccttcacgccccgctcgtcctctaccgcgacagtccgggtggcgtctcgaaggatctccgacgcctgcgcgcaggagcgatcgccgtcatggagcgcgagcgccagcgcggggtgctccatcccgacgacgcacaggaccttctcgcatggcacctcgaacggctcttcgtcgccgaggtcctggttcgcgattggcccggtgcgctcgacgcgctgaaggacgtcctgctcgctccgccccacgctcaccttcgcgctgcgaggggcctcctcggaccgttcctcctcgaacgactcaaccggcggcgcggtcgcgccgcggcgtgatgacgtggtgccacaaccagagtccgagcgccaccaccacgatcgccgccagcacagccgtactggtcaggcttgccgaggtgaggaccgagctgtagttccttccagccacgtaaccgagacccgtgtagagcgctgcccacccgacgccacctaccacgttggccggcagaaagcgacgacgatagggcatctcggccatgcccgcgatgcccggcaccagcacacgaaggacggtcgtgaagcgaccgacgacgacgccgagtgctcccctgcgttggacgaatccaaccgctcggtcacgttgtcgcttcgagagcaggcgctccgggaccttggcaaggagcggctcgccgaaacggcgccccacccagaacccgaccgagtcaccgacgatggcccccagcgcagccagtgatcctgactcccacaccgggaaccggtgctccgcagcgagcaccccgccgagcaccaccgacgtctcgccagggaagatgaacccgagaaagatcgacgactcgagagctggaaagccaaagaccaggaccaagaccagccatgtcggaaccgacagcaaaagccgaatgaataccgccacgccacgcgctccccgagtaggctagatcgggagactaaggagtccgatggtactcgcagacgtgctcggtccgttcgacctgatcgtcgtgttgatcgtagcgctcctcatcttcggcggttcgaagctcccgaaggtcgcacgctcactcggaacagcgacccaagagttcaagcgcggcgcccaggaaggtccgaagcgcacgacgtcggagcccccttcgccagagagtccctccagcgacgacgcaagctcctagcgcggcacgccccaccgcgctgtcgcaccaccatcggtgatgcgtaatcgcctgtgacaggtgtgggtgatgcgaatcggtgctgcgtgacgtcacctcgcacccgtgagcgcgaaggctcgtcggcaccaagacgaggaaccaaagaccggctcagtgccacctgccccggggacggctgcgacgctcggcccgactatcggtacgaccgtgcgagcgctcacgcacgagtctcttcatcgcgcgctccgggcatcgcggctcccgcgcgaagctcccgtcgacacgattcactccggcaccacatgctggcggcgctgcgcgtacgcacggacggagagcgtccggcccgagcacccagctcaccctggttcgatggctcgtgcggacgcacaggcatctgctcgctcgcccaggagtgtccacacggccgagagactctctagggtggcgttctaggaggtggcgatgcgagcagcgttctaccgtcgctttgggtcactcgacgacctcgaggtcggtgagctcgacgaacccaagctcgggcccgactgggtccgcgttcgcgttgaggccgcggccgtcaatcccgtcgattggaagattctcctcggtcgcctagccccgatgatctatgccacgtttccagtcgtacccggttgggatgtcgcgggcacggtcgaggaggtcggacctgccgtcacgcgctttgcacccggcgacccggtcttcggctatgcccgcctcgacttcgtgcacgtcggcacgttcgccgagatcacctgcgtccccgagcgagtcctagcacgccgcgacggcatcgacgcggccaccgcagccgcgatccccctggccggcctcacggcctaccaggccctgaccgaacgactcacagtcgcagcaggcgaacgtctcctggtggcagccggagccggaggcgtgggaagcttcgcaatccagatcgcgcggatcctcggtgctgacgtcctcgcgacggggtcggccgcgagcgccacggcgatcagcgacctcggtgccgagccgatcgatcgcaccgtcgcgctcgcggaggctctcggtgggcggcggatcgacaaggcactcgatctcgtcggtgcagactggtcccgcgaggcgcttgcgatcctcgccgatccttcgcgtctcgcctcggtcgccgacccgagcgtgcgggccctgggagggcactacgtcttcgttcgaccagaccccgacggcctcgacacgctcgccggatgggttcgagagggacgtctcactgttccgatcgccgaacgattcgagctccgcgacgtgcgccaggccttcgagctctccatggggggccacacccgaggcaagatcgtgatcgacgtcgacgcatgaccgtcctgctcgacccgtccgacgtgaccgctcggctgacgcctgccattgccatcgaaggggtgcgcgacgcgctccgggccgcagctcggggcgaacttgccgcccctgcgcgcacagtcgttggcgtgggagacggcgcactcgtcttcacgatcggagcagcgccgtacggctatggctttcgggtctacgatcggttcggctcgacctcggtcgacgaccagctcgtcgcgctctggtcgcgagacggccgactcacggcggttgcccacgggcccgagctcggccgccggcgcaccggagcgatcggcgcgatcgccatcgacgcgttgcgtccaccgggcccgctcaccgtcggcatcgtgggtgcgggacagcaagcgtggcaccagatctgggcccttcgcgcgttgcgccagatccacgaagtgcgtatctttcgccgcaacgcggccgcgcgagccgaatggctcgagcgcttccgccgcctcgtcgaccacgtcgccgaagccgagacagcagaagacgcggcggtcgaggtcgacgtggtgatcttggcgactccctcgacccagccagtggtggatccgagcgcggtgcccaaggacgccctcgtcagctccctggggcccaaggacatcggagcctcggagctgcccgcgctcctcgtcgatcgtgcacgcatgatcgtcacggacgcaccagcccaactcggcccatcctcggttgcgaccgatcgcgcgctcacgccactctggtcgctcatcgaggatcctccgcgcaggcgcgaaggatccgtcttcctttcggcggggctcggagggaccgaggtcgccgtcctcgcgcgcgctctcgacgctcgcgccggctgacttttcggccacccaacccgcccacggcgcacctccgtgcgaccgggagggagggagcgacgacagaacaacgacccttggcgcgccgccccactccggccattacgggctcggtaccttctcgcgacctcagcgcgaccgcgccgagccaaccgcacccggagccctaccatgccctcgatcgatggtcggccacctcccgcgaccctgctccgagacgagggagcggcggggctcgtgtgccccgccgctccaagccacactgcccgccgcgctactcgcgcgtacgggccatcccggcgttctccggctccgaccaggaggcgcgcttcgactcttgggtcgccccgtacgctgcaccgagcacgaagccgatcccgatcatcaccaaccagactccgtacacgaagcccagcgcgaccaaccagacgccagcgcccagtacgaacgggaagatcgtgtgctcggggaactgtccgatcacgccggagatgtcagctggctccacgacggacacgtcctcggggcgcggcttcatccgcctggaccaccagccgatgtagagacctggcaacagcccaagtccggccgaggccagcagcagcacggaaccggtcgactcgtggctccagaagaagtacacgagcaagatgacgacgaagaacgaacctaccccgaggtagacccgcgactcattccgcactctcgtcacctcccgtcacgaccggcactgcatcagagtgctccgggtggttcatgtcccacaccgggcgcgtcgagcgcaccggcggcagcgaatggaagttgtgcgctggcggcggcgacgaggtcgcccactcgagcgtatgaccatcccacgggttgtcaccggccggtaccgggtgacgccacgaccagtagaggttgacgatcagcatcgccatgccgataccgaggacgtacgcacccaccgtcgacacacggttcaagaatgtgaagttgggggagtacacgcccacccaccgcggcatcccgcgaaggccaagcaggtattgaggcatgtaggtgatccagaagccgatgaagctgatccagaagtgcgccttgccgatcccctcgtgcaagagccgcccggtgaacttgggataccagtagtagaaccccgccaacatcgcgaacaccgtcgtcccgatgagcacctggtggaagtgtgcgaccacgaagtaggtgtcgtgcgtgtagaagtcgatcggaggcgacgccaacatgacgccggtgatgccccccatgacgaacgccgcgatgaatcccaccgcaaagagcatcgaggtgttgaacttcacctgcccaccccacatcgtcgcgatccacgtgaagaccttgatgccggtggggaccgcgatcagcagcgagagtgccgagaagaacggcaacaggaccgtgcccgtggtgaacatgtggtgagcccacaccccggtcgacagacccgcgatcgcaagggtagcgaagaccatccccttgtagccgaagatcggcttgcgcgagaacaccgggaccacctctgagatcatgccgaagaacggcagggcgaggatgtagacctcggggtgcccgaagaaccagaacaggttctgccacatgacgggcacaccaccgccggacacggtgaagaagtgcgccccgaagtgtcgatccgcgtacagcatcacgagcgccgccgtcaagacagggaaggcgatcaggatcaggatccccgtgatgagcatcgaccagacaaagagcggcatgcgaaacatggtcatgccaggcgcacgcagatagaagatggtggtcaccaggttcaccgcgctgaagatgcccgagaagcccaccatcgcaacggatgcgatccacaggtcagccccgggtcccggcgagtaggtcgccgtcgacagtggggtgtagccggtccaaccaaaggcggccgcaccactcgccgtcaagaacccgaacagcatggtggtgcccccgaacaggtagaaccagtacgagaggctgttcaaccgcgggaaggccatgtccggagcgccgatcatgatcggcaccaggtagttggcgaacccagcgaacgcgatcgggcccgcaaacagatagagcatgatcgacccatggatggtgaccagagcgttgtacgtctggagcgacacgacatggccgttcgggttgaacagctgcgtgcgcatgagttcagccatcaatcccgcgatgaagaagaacaccagcgcggtgtacatgtagttcttgccgatcaccttgtgatcgacggaggtgacccaccggtagaacccccccggctcccgatgttccccctgctccaccggctgctctgctccgaggagcagctccggctcgtgcagcgtcgtcatgcgctggccctcccttgctgctgatgaatccaggtcatgaactggctcgcggacacgaccttcacgtagaagagcatgtcagcgtggtacaagccgcacaggtgcgagcaacggcccacgaaactcgcatcgtgctgcggggtgaaatcgaagtagttgacgacaccagggagcgcgtaccgcgagaagtcgaagttcggaaggtcgaacccgtgcacgacgtcgttcgacaccagccggaacgtcgacgtctcgccgacgggcagcaccaacgtcgggtatcccgtcggcccctgggtgatctcggtgacgtggtagctcggatagacgaacttccagccccactggaacgccgtcacatcgacgcgcagcgccggtttcttcgcgacagcatcgaccttgttctccactcgaaccgtgaagaagaacagcaccgcgacgatcaggatcggcaccgcggtgtagaagatctcgagcggcgtgttgccgtggacctgcttcggaatcgcgtcgccccggcggcgaaaccggatgatcgcgtagatgagcaaggcaaacgtgatgccgcccacgaagatcgaagcgacgaagaacccctgccagaggtggaacgtcgcgttcccttgaactgtgttccccgtgtaggccccaaacgtcggtagcttgcaggccgcaagcaccgtcccagcagcagccacgaccgcaggtccgcggagtcgtcgacgccaccgtcgacgattggtgatgctccgcctcgacatctcagtcacgtggaacctccagaatccccggtcgcccatgaccattgccgttaccgctgcccgccgattcggactcgtcgtcctcgtgtgcatgtccgttcgactgcggctgcgtcgccgccatcgcctgctcctcagggagcgtctcgaacgcttcttcatgaccgttgtgcacctggagctcgacgaaggcgaacgcaccatcgtcggtacgacggatctcgaccggaaccttcggctcaccaatgtgctccttgtgcccgacctcgcgcgtcagcaggtacgtcgcggtaccggcgagcaccggcatcgcgatcaagagcacgcgcatcgtccacagcaccaagttgagcgaggtatcgaagaagttcgcgagcacgtcggtcgcactggcgaagaagagcacgatgtagaacatcagcacgcccacaccgatggaggtccgcaccgggtgctcacgcggacgatcgcagatgttgtgctcctcgttgtctcgcgtgaaccgacgctcaatggccggccaggcgtacaagagcccaaaggtgatgccaggcaagagcaccgccgggaagaacacgttcgggatcatgtgtccgccataggttgggccgaagaccacctcccagctcggcatcagccgcagcgcgccgtccaaccagcccatgtaccagtctggctgcaccgcatagctcaccttgtaggggatgtaagggccatacagccagatcgggttgatctgcaccagaccaccgagcgccgcgagcaccgccgccgtgatgaagaagaaaccaccggcctgcagtgcgtacgctggccagaacgcgatgccgaccacgttgcgattggttcggccccgccctgggtactgcgtgtgcttctggtgccacatgatcgcaaggtgcgctccgatcaagcccgcgatcgcagccggaaggatcagcacgtggatgatgaagaagcgcgggatgatcgcggttcccggatagttcccaccgaagacgaagaaggcgagatagctcccgaccaccgggatcgagagcaggatcgagaacgcgatgcggatgcccgtgccggagatcaggtcatcgggcagcgagtagccgatgaacccgttgatgatcgacagcacgagcagggtcaatccgatggtccagttgatctcgcgtggcttgcggtaggccccggtgaagaagatgcgcaacaggtgcacgacgatggccgcgatgaagacatcagccgcccagtggtggatctggcgcatgacgaggcccgcgcggacgttgaacgagatgttcagcgtcgacgcgtaggcctctgacatccgctggccgcgcagcggagcgtacgagccgtggtagatcacctgctgggtggacgggacgtagaacagggtgaggaacacgcccgtgaagatcaggactacgaacgagtagagggcgatctcccccagcatgaacgaccagtgatccggaaagatcttgttcagcgagttgcggacgaaccgtgccgagccaaagcggtcgtcgatctcgtccgccgcttgcagcgctcgttcctccaacgtactcatgcgccacgctcccagaacccaggaccgacgggctcgtcgaacccggcctgcgcccgaaggacaccctcgctgtcgatgtagagcggcagctgtgggaggggtcgcggcgcgggcccgaagacgttggtagccccggtcaagacgtcgaacaagctctggtggcacggacagaggagctgctgggtgagttcctggtagagacccaccgggcaccctgcgtgcgtgcacaccttcgagaacgcgagatacccctgtggcccccacgtctcacggcccggccgcgtgacgaggtcggttgtcgctggacgaaccagcacaacctgatcgatcgcgttcatcggggagttctcccaaccctcggggaacaccgtcagcatcccgccgacctcgaggtcgttcaccgtgacgacacgaccactggccgtcacaagccgtgaacctgccttccagtcggtgaggaacagggacttcccggggacggggccgagagagcgaaggaacgggaagaggttgatcaacccgaaggctccaaccgacgcaccgagcagcctcaacaagaacgagcgtcgctgcacctggttgagtcctcggctcagcgatgcatgcatcgcctcgcgctcgacgtcgtccgagcgaagctcgtgacgctcctgcacgtagggaccctggggcacgaggtacttgccccacgcgacgataccaacgccgatgccaccgagcgccacgaacagcaacgcgccttcgacctgtggctgtccaccgagccagtaggtcacgcccaagccgatagtggcgagcaccgacaagctgaacgagatggcgatcagccgctcgacgaacggccgacgctctggcgtctcctctgtcgaggaggttggaccagtcctcgagacggtcatcgaggagccctcccgccgatccaatagccagcgaccatcaaccctcccaaaccgaacacgatcgcaacgagtccctccgtgaccggcccgacatgaccaagacccgcgccgccgcgatcattcggcgcgtggaggtactcgacgtagcgaaccacgtcggcgacctcctggttcgacagcgtgccggggccgaaccgtggcatgttgccagggccggttcgaatcgcctcggcaacttgcgtcggggtggccggatagagcgacggggcgaacacgttgttcgcgagggcatcgcccacacccgtgatcgtgtgacaggcggcacaatcctccgagaagaggaactcacctcgggatatgttggccgccttcagattgacgctcggaatgccaggaccccccggcgccaacgacacgatgtacgaggcgatcgcctcggcctgctggttggtgaggcggggcggcttctcgatcgcctgcgtcgtcggatcggcgagcggcatgcggccggtcgtgatccagaagtccaccgtggcggctccgaggccctgcaagttcggcgcacgcgtcgacccttgcgcgtccacaccgtggcacgtctcacagtcctcagcgaagagcgcttgcccctcgggaatcagacgcttcggagggttcacgtacacgatcggtgaaccacccgacgagccgccggagttcggtgcctgcgccagtgccgtcgacggggccgccaccatggccacggcagcgagcgtgccaaggccggcgacaccagcgatcgccgacagcacgcgcggtcgtcgcagcgaacccttgctcaaccaacccaccgagttcactcccttcctcggacgcacctagtgcaccaggaacaggcacgcaaagagcgcgacccacaccacatcgacgaagtgccagtagtacgacagcgcctggaacccagggagatgtcgacgtccccccttgacgcctcgcaggcgcagcagcaagaacaacatggcgacgaggcccacgatcacgtgcagtccgtggatccccgacatcacgtagaacagcgacccgtaggcattggtctgcggaccgaaggtcaaggtggcccactccaccgcctggttcgcgatgaaggacccacccatgacgaaggtgagcgccacccaccacatcgccgcacggggccgatcgtgctccgcctcgaacaaggccttctgcatggtgacgctcgacagcagcaagatcgtggtgaagatcgccgactgcaccgtgtcgaggtgcgtgcccgcgggtggccacggcgagccgacgtgtgctcggatcgtgaagtaggcggcgaagaggccactgaagaacatcagctcggatccgagccacaccatcgtgcccacaccgagcaacgacggtttcgagaacctgatcggctcccgccgtggcgcgccagctagcgtcgcctcgaccatgaacgcaccctccagcccactcaagcctcacccatctgcgagtgcctcgtggagccaggagggagccgacgctgctgcacacagcacgacgtgctgcgtcgctcgcgtcaacgcgacgtagatcgaccgctctcccgtcggtcccttcgcaagggccgccgcatcgagcacgactaccgcgtcgaactccatcccccgaatcccaggcacatccgtcactctgatcgtatcgaggtcgccgagtcgagacaaaatcgagccgataccccccactgtgttctcggcgacggaggggtcgaggacgagtgcgacggagtgcacctcgttcgcgagcgtccgcacgcgagcgagcgcgaactcgaccacgttctcgccaagatcgtcgatcagctccacggccccaggggtccgacggagcacgacctcggcaccttggtcatcgccgaggatgcgctcacggaggcgagcgaccgctcgtccgatacgcgcaggcgagcgatagttcacgcgcagctgctcgatcgacacatccttcaggcgcagctgctcgatgacggcgctccacggctggaccccccacggggccagcgactgcgcccggtctccgacgagtgtgatcgatgagcccgacagccgccggcgtatggctcgagcggccatcgggctcacatcttgggcctcgtcgaccacgacgtgtccgaagacccgcccctcgtgggtgccgagcaggctgtcgagctcgtcgagcagcggcacgtcctcgacctcccacacgtgccgagagggatcctcccccggctcgagcgcaaggagagcagcctcgtcggcactcaagacgccacgcgtggccgatgccagcagagctggacgcgcgcgcatgtcatagagcacctcctcggcgctcagacggggccacagccgtgccatcacccgctggaaggcctcgagatggcggatctcctggcgcacttcgcgcacgatgtcctcgtccgagtcatccgggaagcggggaggccaatctgccccaggaccgaacagcgccacgactcggtcgtcaccaccccacgcctccctgatcagcggcccgccttggaggaccgcgtgtgcgagcgcgtcgaggagcgcatcttcgaccgagcgacgccgctggttgtggcccccgcgcacggatcgagtcgcagcgatcgcgcgacgtgagagctcgggcgtcacggtcagcacacgagatccgaacgggatctcgatacgatggcggagcggacgctcacgatcgcgaaccgccctggccagaaccttcaccatgcgcgggcttcctcgcagtgcgcgcgattcgggcgtcgagtccgtatcgccaacaagcgtccccggtcgcagtgatgccaatgaccgcagctcgaccccactctcgccgagcgaaggcaagacgtcgcgcacgtagagcacgaacccaggggtcggtccgaccacgagcagcccctggtgttcgagccgccaccgataggtgtagagcaggtacgccgctcgatgcagcgcgacggcggtcttgccggtgcctggcgagccttccaccaagagcgcgtggccaagaggtcgtcgaatgagttcgtcctggtcggcttggatcgtagcgacgatgtcgaccatctgagctccgcgcggtcgctcgagcgctgcgtagagcgcggtcggtccggcagtcacatcctcgctgccacgccccgacaacacctcgagctcgagccgacgcagctcgccgtgttccaccgcgaggtgccaccgacgctccacgcccatcggcacctgtgccgtcgctcggtagaacggttcggcgaccggagcgcgccagtcgacgacgagtggatcgccgtgctcgtccgacagggagacccgtccaatgtggaaccgctcctcgtcgtcgcggtcgagtcgtccgaagaccaaggcgtggtcaccaagttcgagggcctcgagtcgacgcagcgcattctccacgaagacgtctcgctcgagccgagcctggtgcgtaccaccacgctcctgggcgagcgcctcttcgagcgagcgctcgacccctccccgaaccgcgccaagccgccgataggccagctcgacgaagcgccgctcctcttcgaacgcctcgtcgaccacgcggccccaccctcctagactcgggagcacttcagtctatggcctcacccgtgcactcacctgagccagcgctcctcgcggcgcttgcccgtcggcccggtcaccacgttcccgtttggttcatgcgccaggctggtcgctccctccccgagtaccgcgcagtgcgcggcgtggagtccatcctcacggtcctcgaggatcccgaactggccgcgacgatcaccctgcagcccgtcgagcgctaccacgtcgatgcggccattctgtacagcgacatcatggcaccgctcgccgcagcaggggtcggggtggacatcgtgccgggcctaggtccgacgttcgacccgccgatccgtgcacgcagcgaccttgcacgtctcgaccggttccaccccgaagcgctcgaggccatggcgtcaacggtccggctcgtcaccgccgcctcccccgtgccgctgatcgggttcgccggcggacccttcaccgtggcgagctacctcatcgaaggtcgcccctcgcgtgactacagcgccacaaagcggctgatgctcgccgatgccggcctgttcgccgccctcctcgagcgcctgaccgacatcgctgcggccagtatcgccgtccaagtcgaggcgggcgcaagtgcggtccagatcttcgactcctgggccggagccctgtccggaccagcctttcgggaccacgtcgcccgccacctccggcgcctcgcagccgtcatcggcgagctcggcgttccgtccatctacttctcggtcggcacggcgcacctcgaggccgacatctgcgaactcggcttcgacgccgtcgggatcgactggcgcgttgacctcgaagggttcgcgactcgccacgggagccggctcgcactccaggggaacctcgaccccgcatatgtcttggcccccgtcgatgtcgtcctcgccgaggcacgagcggtcctcaccgcctcggctcccgcgcctggctatgtcttcaatctcggccatggcgtcctgcccgaatccgatcccgacgttctcgcccgcgtcgtcgacctcgtgcacgacgagggcacccggctgcggacgaacgcgctggaggcgacttcgtgaacgtcatcgtcgtcgggggaggcatcagcggacttgcggctgcatgggaggcggcgcgccacggtgcatccgtcatgctcctcgagtcctccgaccggctcgggggcaagctcctgacctcacacgtcggcggctcgctcgtcgaactcggccctgattcgctcctcactcgcacaccgagtgccctcgaactcgtcgactcgctcggactcgacctcgtggctcccacagccagccgagctctgctctggtcgcgaggtgcgcgccgccccatccctccaggcctcgtgctcggcgcaccaccgaacctcgaacgtgcgctcagctcggatctcgtcggtcccatcactcgccttcgcgccgcgtggggtgtgatcgcgcgatcccggcgtggccacgagaccgacgacctcggtcgactcgcagcgtggcgttgggggcgaacctggagcgaacgacacatcgagccactcgtcgggggaatcaacgccaacaccatcgtgggcctgagcgcccgggtgagcgcacccagcatcctctcgatgccgcccagcggcccaccagcaccagccccctcccgaccgacgcgccctgcgttcgtcgccccttctggaggcctctccaccctcgtggacgccgtagcgcaggtcctcgtggacctcggcgtcgatgtgcgctcctccacctcggtcaccgaactcgctccggcccctcacggcaccgccgtcaccacctccgacggcagctcgttcagcgctgatgccgtcgtcctcgctgtaccggccttccgtgcggccgagatccttgcggcctcagcgcccgaagccagcctcctgcttcgcgggattcgctacgcatccgtcagcgtcctggccctctcgatcgcgccgacgctcgcgccgtcgctcaagggcgtcgcgggggtgctcgtcgaccgacgcgagggtctcatgaccaccgccgtctcgctggcgtccgagaagtggccgcactgggcaggggacgacgcgttgctccgcgtgtcggcgggcaacctccacgacgtgcgcccgctcgatcgggacgacgatcgcctgcgcgacgatctcgtcgccgaggccgagggcatcctcgaggcgaccctcgagatccgcgatgcccgactcgcgagatggacgaacgccttccctcacttcgcgccgtggcatctcgatctcgtggagcgaatcgatcgcgaactgcgcgacgcactgggctcgaccgtggcgctcgccggcgcgtggcgtcgcgggagcggcatcccgacgtgcatcgcgagcggacgcgacgctgctcgagcgacgatcagccgagacaactgaccgcgccgtcaggcctccgaccgctcggccaccccggccgcatcaaaggtcgccatctccgcgaggatgcgcgccgcggaccgcaccagcgggatcgccagcgccgcacccgagccctcaccgagacgcaaatccagatcgagcaggggacgcagaccgagatgctcgagtgccgccgttgcgccgggttcgaccgatcgatgcccggcgatcacaaagtcagccgccacgggatcaatccctgccgcgaccagcgtgccagcgagcgagatcaccccatcgaccaccaccgggatccgcacatccatcgcgccgagcactacgccagcgatgactgcgatctcgccaccgccgagctccgccaagacgctcatgggatccgtgggcgggccggatcgtgcgagggaccgctcgatgacctcgatcttgcgagccagttgcgcatcgtcgatgccggttccacgacccgtgaccgcagcgggtggcctgcccgtcagcgccgcgatcaccgcagcgctcggcgtcgtgttgccgatgcccatgtcgccggtggcaaccaggtcgatgccgtaggcgtgcaggctcgacaccagcgcgcggccagcctcgaccagtgcgcgagcgtcatcgagatcgagtgcggcttcttgggcgatgttgcccgtcacgcgccgtcgtgcgacgtcgaggagagctgggtggcgctccagctccgtcgcaacaccagcatccaccaccaccaccgacgcgccgacctcgcgcgccagcacgctgatggcagcgcctccagcgaggaagttcgcgaccatctgcgccgtgacgtccctcggccagggggtcacgccctcgtcgacgacgccatgatcgcacgccgcgacgacgatagcaggacggcgcggcaccggcggggggtcgaccccagcgatgccggcaagctgggcgccgaggtcttcgagcacgccgagtgagcctgccggcttggtcagacgaaggtgatgcgccctcgccgcagcctcagcgcgttcgtcgcgccccttggctgcggatcgcgtggcgtccaccccacgatcggtcggcgcgcgcatcaagcgacagggtccgggacccggggagtcccaaacatgaaccggctgaagatcacgtacttgccgacccacacgacgccgaaggcgacgagtgatgcgaggttgatgagcacggcatcggtcaggtgaccaacgtgggccgccgaggcgcgagcctgcgtccacgcgacggtctcgatcgaaacccacagcccgatgaaggccagtgcccagaacgggatgacctccttcaggaggtgtgagcgtcccgacttgccccaagcccagcgacggttgaggtagtacgaagggatggccgcaacggccgtcgcgaccacgttggaggtcacggcggaaaacacgcgcatcacaccaaagagcaagaacaggatcgcctgagtaatcagcacggaaatgaccgaggtcacggcgtacttgaccgacgccggaccaaaccgagcggtgatcgcgtcattgaggtggagtacgagggagcgcacgcggctagcctaccatcgagtagcccgtcgtcggcgacgcgtgatcgtacatcgatcgcatcgaagggatcgttcatgagcgaggctttggaagcggtccttgacctgctcgatctcgagccgatcgaggtcaatatctttcgtggacagagcccgaaggaggaccgacagcgcgtcttcggcggtcaggttgctgcacaggcactcgtcgcggctggtcgcacagtcgagcgtgatcgaagggtccattccctccacgcctatttcattcggcccggagatccgaacacaccgatcctctacgaggtcgagcgcattcgcgatggtgggagcttctcgacacgccgagccatcgccatccagcacggtcgtgccatcttcgccctttccgcgtcgttccaggtccccgaagagggcctcgagcaccagctctcgatgccagaggtacctgatcccagcgccgtcgggacgctggagcagcagctcgagccgtggtcctcgcaggtacgggaatggctcgaccggccgcggcccttcgacattcgcttcgtcacgttgccgccactcgcccgagccgaggggtcccgcgagccagtccaacggatctggctccgtgccgacgggaacgtccccgacgaccccttgctgcacgcgtgcctgttcgcctacgcctccgacatgacgctgctcgataccgccctcatcccgcacgggttgacctggttcgacggcaccatcttcggtgcctcgctcgaccacgcgatgtggtttcatcgcgagggccgcgccgaccagtggttcctctacgacaccgtgagccctacctcccagcagggccgaggattggccgaaggcgccatgtacgaccaagccggccggcggctccttaccgtcatacaagaggggctgatccgtcgggtgcgctgaagcggtctgccgcgcgcacccgacgccgatgtcagcgctgctcgaccggaacgtagtcgcgcttcggagcgccgatgtagcgctggcgagggcgcacgatcttggcgtcttgatcgagcagttcgttccagtgtgcaagccaccccgacatacgagggatcgcaaacagcaccgggaacatctccacggggaaacccatggcttggtagatcaggcccgagtagaagtccacgttcggatagagcttgcgcgagatgaagtactcatcggagagcgcgacctcctcgagcttcagggcgatatcgaggagtgggttcttccccgtgacctcgaacacgtcgtaggcgacttccttgatgatgcgcgcgcgaggatcgtaattcttgtacacccgatgcccgaagccctggaggatgccatggccacgcttgatggattcgacgaacgcgggcacattgtcgatcgagccgatctccgtcagcatgcgtacgacggcctcgttggcgccgccatgccgcggaccatagagcgccgcgcaggccgctgccgcggatgagtaggggtcagagtgcgctgagcccgtgacgcgcatcgccgtggtcgagcagttctgctcgtggtcggcgtggaggatgaacagcacgtcgatcgctcgaatgagacgcggatctgcctcgtagcgaggctcggcgatcttccacatcatcgacaggaagttcgccgggaacgacagcgagttgtccggatagacgaacggcatcccttgcgagaatcgataggcagccgcagcgagggttggcatcttggcgatcagacgaatgatctgtcgatgtctggcatcgggatcgaagatgtccttggcgtccaggtagaacgtcgagagcgcggcgaccgccgagaccaagatgcccatggggtgggcgtcgtagtggaatccctcgaggaagcgcttgcgaacgttctcgtggatgaaggtgtggtgcgtgatctcgtcgacccacgtctcgagctcgctcgcggtcggcaattcgccgtggagcagcaggtacgccacctccagataggtcgagcgttcggcgagctgctcgatcggatagccccgatagcgcagaatccccgcctcgccatcgaggtacgtgatcgcgctctcggccatcgcggtcgataccagtgcgggatcgaggaaccagatgcccggcagcgccttgctccaatcggccgccgaaaccgtaccgtccacgatggggatctcgacggacacgccggtgcggttgtccgtgatggtgatcgactcaggcattgcgacccaccttcctactcagtcgaaactgaagggtcggacgccaccgattcggtgacactccgaccccccaaccgataacggtacacagcggtgtcgcgctccacaaacccgaccgaccgatagagcgcatgcgcagccacccgcgtgggccgcgacgtcaggtccacggtggtcgccccggcctcctcggccagtgcgagcgctctggtcacgagcgcgcgtcctaccccgtggccacgtcctcgctcgtcgaccacgacgtcctcgatgatcgcccgcagtccggtcgggatcggtaccagcacgagcgtggtcataccgacgacgtcctcgccagcccacgcaaggaggagacgcgtcgcctctgaggacacgacccgttcgagatcggcctcggtcaacggtgcagccgtggtcgacagctgtcgaacgaggtggttgaccacggcgagcatgccgggctcgacggtggtggcctcgcgaaccacgacggccgatggcgacgcgatcatcgccgccagcctaggagcgccgacgcgatccctcgaaccgcgaggatgaggacgactagcatgggagtcaatggtggagttcgcctggcaccgccgcgttcgtcagcgccgcaggccagcggcgctcatcttggcgttgtccggttggaccgacgctggcgaagctgcgtccaccgcagcgtccacactcgaacgactcgcggggctcgtcccctacgctcacgtcgaccccgacgagctctacgacttcactgcggtgcgtccgctcgtcgagatcgacgagcgtggggtgcacggcatccaatgggggaccctcgtcctccggggcccggctcgccaacgcggtcccgcgatcttctccctggccggaccggagccgcaactgcgatggaaggcgctcgccagccagattgccgaggttgcacaaggactcgcgatccagcacgtggtcacgcttggagcgttgctcgcgggcactccacacacgcgcccagttgcgctcgtgggattctcgactcgtccggaacttgcacgcaagctcgatctgctgccctcgcactacgaaggtccgaccggattcttgagtgttgcccagggcgtgctgcaaagttcgggggtcgacgtgacctcgatctgggcggaagtccctcactacctggcacagtttccggcctatccggcggccctcgcgctggcgcaagccaccaccaccgcgctcgacctggatctcgatcccacgccggagctcgacctcctcatcgcgcggacggcggccgaaatcgaccagtacgtcagcgacgatccagaactcgtctcctacgtcggatcgcttgagcactcctacgagatcgatcaacgaacgcgccgatcggccgagcggatctcctgggaggcacaacagtacctccgtcgtttcaacgcggagtgacgccgtcgacgcgtccgggccgaggcggatcgaagtaggcggcccacgcgcgggtcagcggttcgtctcgatgaaaggcgcgctcgagccacgggagccgcatcagcgcagccacgttctcggggagctcctcacgttcgaaccaccgcaccgcacgcacctcgagcggatgcgcccgaagcgtcccgccgaccggacgacacaagaagatggtcgaatacatcgcgaccctggtgaagccacgccgcaggccgtcgatctgaccgaggatcgcctcgggcacgacctcgatgccggtctcctcgaagacctccttcacgacgacttcggccgcggagtagccgacgtcggcccaacccgtcggatagagccacacacccgagtcggctcgctggatgagcagcatgcggttcgagtcgtcgacgacgaccgccccgaccgcacacttgggcgtgacgtagccggcgacaccctcggcgactcccctgatgagcgcaccgacggtctcgtcctcgggctccccgataggggcttccgcgttgcggagtctcaccacgactcgcaagatctcctcgtagcgctcgcgctcgtacccagaactcgtgaacgcgagtcccgtccgcgcaatgctctcgatctcgaggagcgccacctcgagatcgcgtcgctcaagctccatgagggcacccctctgtccgcgcacggtcactcgtcacatcccatgctacgctcgagccgtggccgcgcaggtgacctgcaagcactacctcgtcaaaacgctcccgagcggagaccgcctcgagcgatgccgagtcgacgccgcgcgcacactgcccttcgactgccctgacggctgcctcttctacgagccgcgtgctcgtatctcgcggctcgggtgggtcgatccgcgaagcggagactagagccacccgctcgatcaccgacgatctccatcaccgacgatccggcagctcgaccgcggctgcgttcgccgtgccccgggcaccgcgcaggacgaaccggcagccccacgcgccagccgcgaggtcgctcagctcagacgtgcgtccttcgacacgacacccagcgactcggccttcgctcgaccccactgcacctgaatcgcggcgaggtctggcgaaatgtcgaccgcgctgcgcggcaggaggccgcggcgctcgagtcgctcgacgttcggtcgctcgacgtgggctcgcaccgactcgagcacgagacgacgcaccaagccgatgggcggctcggcctgctcctcgacgggtgcgccgagcagggcggtcagctcgttcgccacgtgctcctcgagtgcatccagccacgtcaactcacactcgccctcacgcgcgagctcgttgccgaggcgcaccatgaaggccgggagtgcgtcgagcaacgcctcgagataggcagcgctcgcgcgagcaaacggaagagcatcagccttgtggtccatcgcgatcagctctcgaccacgtcgccgaccagctcgacgtcgacaccgacaccgcggagccactcgatcgcctgctccaaattgtcggggttcccttcgagctcacagacgatccagccactgtcgtcttccacgttcgcccgtcgaatgttcgcgatgacaccgtgatccctcgccaacgtggcgatcacgggttcgttgatcagctcgccctcgtaccagagcttcgccttgaaccgagccatcccgcctcctccgaacctaccggacccaccgagtgctgacgcccacgaaggtcggcgagatcgagcgtagtgtacgtgaagccaaggcgcgagccgagctcggtgagctcctcggcgtgcgccaacaccgccgctgcgagcgctcgtggcacctggatccgcgccgtatcgccatggtggcgcacacgtacatcgacgataccgaggcggtgcaacgcggcttcgaaacgctccacctggctcagacgacgaggcgtcaccggcgtccctgtcgggatgcgcgacgcgaggcaggcggcagccggcttgtccgcgagccagtcgacaccgagctccctcgcaaggctacgaatggatgccttgttgacgccgagctccaagaacggcgcgcgcaccccagcctcctcggcagcgagcatgcctgggcgccagtcgccgagatcgtccacgtgcgcacccgtcaccatgacggcacggcgctcctcggctaccggcccagccgctcggaacaggtgggtcttacagacgtagcaccgcatccggtcgttgcgaacgtaggcggggtcctcgccctcgtgtgtcgcgacctcgacatgacagatgccgttctccaagaccagccgggcgatggcgtcgcgctcgtcggcggcgagcgaggccgaccggccggtgacggcaacggcttgatcgccaatcgcgcgggtgccggccaccgcgagcactccggagtccacgcctcccgagagcagaaccacgacccgttcctgccgctcgaaccacgccgtcagcgcgcgcagctcagtagaggttcgcaccccgacgagcctaggccgcggacacctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgtgacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatttcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagctcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagggccgagcgaggacctccgctggatcggcgagaaacccgacgtagaagcgaccaaactcgccgtagtaggccgacgcctcgtcgtagcgcaatgtgtagacgacgtccttgatgtcgtccggtcgtttcgcgaacaacgtcacaccccactcccagtcggtgagtccggtggcacccgtcaccagttggatgactcgtcccgagaacttgcgccccgacgccccgtgtccatacatgagccgctcgcgctctgcatacggcagcgcgtaccaattgaaggcgtcgccccgacgcttcgccatggggtagaagcaccagttcggaaagccctctggcggcaacaccgggtagaggcgcggacgcttgcggtcctccggcaagtgctgtgagtactcggagacctccgtgatggagacgaaggaatcgacgagcgtgagccccgctcgcgacaggccggcctgcaggtcacgcaagaccgcaaagtcctggtggagggccatgacggcgacctgcgcatggtgaccgagcagactggccgtcatcacctgtgcccccgcagtctcgcactgcttgagttcgcgcagtgcctcctcggcggcgtaaccgggacctggattggcgaacagatgcagcacgccgaggccggttcgcacctgcgagccgccgacctcgtccgaacccatcacctcagtgctgtcactcatgattggtctccatcatgctcactcgtgagcgcgcgatggcgcatcgcagcctcgcgtcgatcagcgatcgtgccagcgccgagggcgctccctgccggtagcgggaccgtcatgggttgcgactcctggagccgatgcgcccgagccacagcgtcgtggtacgcctcgatctgcgcacgcatggacgggtctgcgtagaccgttccatcgatgagcaacccctgacggcgctccatgatcgcgaggatgtcgtcaccggtgatcgtcttctgagtctcgagagcatgagcgacggcgaggatgtcgtagcggtgctcctcgacgatctgggccacgcgctcgtagagggcctcgagtcgccgctcgacacgatcgccgatgccccctttgcgagggtcgtccgcaggcccgactctccggcgctgcggcccgtagccgccgatgccgaggtcgcgaaccgcatccagctggagaatggtgtcgcccataccccacgacgtgtccatcagggccgcgagcctcgaggcgctgaagagatcgcccgagacgcccgaggtgttgtcgccgccgaagaaggcgcgctcgccagcgagcgatgccagacccaccatgatgtccgcttcgaactcagagcgccaccgggtgaatcgctcctccttgggcaagtaggacacgagtccgaggaagttcgaacccttctcgatggtggcgatgtcgatcaccgaattacgccgcacgacaaccgccgttaccgcatggcacgcctcgtggacggcgacggcgtgccgctcgcgctcgacgtactcgacgtcttcgggcagaccgaaggtcttgatctgcttcgcacggatcatgtccggccactcgatgacctcgcggccctctcggatcgcgataatcagcgcctcgttcaccatgtccttgatggcggctcccgacaagtacggagtcatggtggcgagccggtcgatgtcctcgtccgagagagcgtggtggaccttggccaagtagccctggaacgtcctgatgcgaccctccttggacggatagcccaccttgtagatgcggtcgatccgaccggggcggagcagcgcctcgtcgagcacgtctggaaggttggttgcgaggatggtgagaatccggtacttcggcggttcctttggcttgagcccgagcgcgcgccgaacgaccctgttccagaacccacgtggcttctgcaagcccgacagctccgtcagaagggcttggagcgtcccgtccatgccgccaaaccccggcactacgtagcgccagaccgatcggccttgcgcgcgaggctccggcgcactcgcacgagcacgacgaagttcctcctcgaagagcacctgctgggtcgccggatcgaagtaggtgccaccatggcacgtgggcgcatcaccgaggatcggcgaacccgcgaagcggaatctgccatcggcaccagcgatggcgcctcgcgaaccaagcgagtccgcctcgtcgaagaaggcgacgaccccgccatagcgcaccgcgagcttgcgcagacgacggaagatcgacttgaccttcaaaataccgaccccgatgaacatgttcgcgaaggcaccgggctcgacgaagacgaacggcacttgggtctcgccggcgaccgcctcggcgatcagggtcttgccggtgccaggcgggccccacagcaagataccggtcgggacgtagccacccttctcctcgatgcgctcgggatcggtcaggaagatcaggttctccttgatccggtcgagtaccgcgtcttggccccagacgtcgctaaagcgcgtcttgacgtcgccagggaagtagacctcgtagccgcccttggagagataccaaaagatcgcgacgaaggagccaaccccgatgagcagatagaccccgatctcgatgatcgtcgggagcgagttcatcaccatgcccggcacgacgaacagcgcgaacaggggcgagacgtggtagtgggctgccagcacgaccgacaccagcgcaaggagaacgatgatcttcgcagctcgcgcgatgcgatagcgcgtccaatcgtcgcggccgtggccgaggcgctggatcggtcggacgacggcttcttcccacgcctggttccaggacgacgagcgctccaacgccagcacgttcacctggcgcaccacctcgaggaccacgagtacggtgagccaccaatcgctctgaagggtgctcgcaagcgcgacgcccaccggttcgagcggattcgcgttcgtctttgtcgccgtcacccaggcgatgagcaccgcgaggacgacgaggaacttcaagcggtcccacagcgactgcggaggtcggcagcccggccgcgcagcatgccgcctggccccggtggactcggtcatggtgttgcctccactccaaaggaacgaatgattgagtcgatcacacctgcattgcgtgcaaagcacgcgacgtcacatcccaccccgaggacataggcccacgtcgtcgagggattcacctcggcgatctgctcgagttcgatcggcgagctcgtaccgacgcgctcttccacggtcatctcagaaccccggaacccgcccttgcgcacgaacgtctggtaggccttgaccgagaagtggtcgatcgacgacgacggattgaagggatcctgctggaggatcagcgtgcgcaaggtcgccaacgagaacgaatcctgctcggcggaggtcaacgcctgcgccttcacgattccgaatgggaacccctcgctgaagccgttcgagaccgcagacaggccagcgacgtgcttgccaacgatgatgttgccccagagactctgctcgacctgtcgaagcgtcgtcgaactcgcacgaggatcggccgaccggaagacctgctggaccgtaaagcgctgccaacccgaaggaatcgcgtagtagaccgactcgcctgcagcgtcgccgtgactgacgtacgagagcccgctcgccgagcagctcgcagcgagggcacccaacgtgatcgtggccagggttctgcgcccccatcctcgcgaacgagcgaacgaccacactccaccacgccttcctgagcgaatggatccccccgctcggggaccgagccctcttccatgctaccgccttagcttgtggacaactcaggcgcaccttcacgcgaggtgagagcgcagaagccagcccagctctgccacgtccgaggtttcccgctcggctcctgcgaccacgccggtctcgagcagcacaggccccacaacgcatcaaaggggagcaggcaagcctgctcccctttgactgtgcgtcgcctgccgcatgcgacccggcgacgccgtcgtcccttagaagtcctccatcccggcgccagggttgaccgccggcttgggctccggcttgtcgaccacgaccgcctcggtggtcaggaagagcgccgcaatggacgccgcgttctgcagcgccgaacgggtgaccttcacggcgtcgatgacaccggccgccaccagatcctcgtaggtcccggtcgcagcgttcaagccctcgttggggttggtgagtgccttgactcgctcgaccacgaccccaccttcgaggccggcgttggtcgcgatctgccgcaacggctcctccaccgccttggcgacgatcctcgcaccggtcgcctcgtcaccctcgagcttctctgccttgtcgagcaccgcacgctgggcacgcagcaacgccacgccaccgccgggcacgacaccctcttcgatcgctgccttggtggtcgagacggcgtcctcgatgcggtgcttcttctccttgagctccacctcggtcgcggcgccgaccttgatgatcgcgacgccgccggacagcttggcaagacgctcctgcagcttctcgcggtcgtagtcggagtccgtcgcctcgatctcgttacggatctgctggatccgacccttgatgtcggcgtcgctccccgcgccctcgatgatcgtcgtctcgtccttcgtgacctcgacgcggcgcgcgcgacccaacaggtcgagcgtcgtgttctcgagcttgagcccgacctcctcggagatgacctggccaccggtgaggatcgcgatgtcctgcagcatggccttgcggcgctcaccaaagccaggagccttgaccgcgaccgaccggaaggtgcctcggatcttgttcacgaccagcgtcgcgagcgcctcgccctcgacatcctctgcgatgatgaggagcggcttgcccgcttgcatcaccttctcgagcaccggcaacagctcacgcaccgacgagatcttcgagctgaccagcagaatgtacgggtcgtcgaggatcgcggtcatggcctcggtgtcggtggcgaagtacggcgagatgtagcccttgtcgaagcgcatgccctcgacaaggtcgatctccatcccgaaggtctgggactcctccaccgtgatcacgccgtccttgccgacgcgctcgatcgcctcggagatcatggctccgacctcaggatcggcagcggagatcgcggcgacctgcgcgacctgctcgcgcgtctcggtctccttcgcgatggacttgagcgcgaggactgcgtcggcaacggcctcctcgatgccacgcttgagtgacatcgggttggcacctgccgcaacgttcttcaggccctcgcgaaccatcgcccacgcgagcacagtggccgtggtcgtaccgtcaccagcgacgtcgtcggtcttcttggcgacctccttcacgaggtcggcaccgagcttctcgaacggctcctcgagctcgatctccttcgcgatggagacgccgtcattggtgatcgtgggtgcgccccacttcttgtcgaggacgacgttacggcccttcggtccaagggtcacccgcacggcgtccgcaagcttgttcatgccctgctcgagcttgcgccgagcatcctcgtcgaacgcgatgagcttggccatcgttgcctccctggtctctcgcgagcagcgttttcaccacgtctgtgacggctctctcggccgcccagcatgcgtggttagcactcagctatgccgagtgctaatgatagcacctcgccgctgcttagccgccggcgaccgcaggaacgaccgacaccacatccccgtcgccgacggtggtcgcaagaccatccagaaagcgaatgtcctcgtcgcgaacgaacacgttcacgaagcgccgcggctcaccctcggcgtcgaggatacgctcggcaagctcggggtgctcactcgccaccacagcgagcacctcaccaaccgtctgcgcctcgccgaccgtgagttcgcccgcgccgcccgcaaggctgcgaagctgcgctggaatgcgcacccgtaccgtcactccaacccccatttccctctcgctcccgaccgctagcgcgcctgggctccgagtaacgaccaaaacgcatcgatcgatggacggatcacggtgccggtatcgacggtctgctcgatggcttcgaccgtcttcaggccattgccgctcaggtacgcgaccaccgtctcgtccggtcgaacgatcccctgcgaggccagcttggcgagcgtcgcgaccgtcactccacccgcggtctcgacgaagatgccctccgtgcgcgccacgagcgcgatcgcttcgaggatctcgtcgtcagagaccgcgccgatcgcgccgccggtcgctcgtgcgacatcgaccgcgtaactgccgtcagccgggttgccgatcgcgagcgacttggccaccgtcgatggcctgaccgggcgcaccaacgagcgacccgcctcgaacgcctgcgcaaccggtgagcacccctgcgcctgggcaccggatacccgcacgctcggcggctctggcatgagtccagcgagggccagctcctcgaaacctcgatggatgcgcgtgagctggcttcctgaggccaccggcacgacgacgtgatcggggtagcgccaacccagctgttcaacgacctcgaaaccgagggtcttcgagccctctgagtagaacggccgcaggttgacgttggcaaagccccaatcaccgcgctcggagacgatctctgcgcacagacgattgacgtcgtcgtaggtcccgtcgatcgcgacgatgttcgctccgtacaccgcggtggccaacaccttgacgcgctcgagattcgcgggaatgaagacgtaggcctccatccctgcccgagcagcgtgagccgcaaccgagttggcgaggttgccggtggaggcacacgatgcgacgcgcatgccgaactcacgagccttggagagcgcgacggccaccactcgatccttgaaggatccggtgggattcaccgtgtcgttcttgaggtagagctcccccagaccgagctccgcggccagcctcggggcgggcacgagcggggtgaagccagcaccgaggtcaatacgggcctcgtcgcgctcgatgggaagcagctcgccatagcgccacaaggtcggtggccccgactggatccgctcgcgcgtgacacgtgccgcgatctgctcgtagtcgtaggcgacttcgaggggaccaaaacagaactcacacacgtgggttgggctgatcggataggtccgcccacactcacggcacaccaggttgacaaccgctgacgacatcgtccctcccgccgccatcgctcgggcattggcacctggttcgacgtatcgaactggttgccgcggtatcacagggcccgtccctacaccgctctcgatgattcggcgtcactcatgctagcgactcggtcggcgctctgcgctgctcgcacgcgtgccaatggacgcacacgacctagcgtgaggtcatggctccagcgcgccagtacctcttcgtgacgaatcgagggccgttcgcgatctcgccgtccgggtcgctccacgaggcgggcggtggcctcgctgccggcctgcgaggactgctcgcaacgggtcaagcgcgatccgtcttcgccgtcgacgacggaccagaacgcgagcactggagcgccgtcggcgacgatcgcctcatcccagctgctgtcccggaggaagtgcaccgtagcgcctacgacaccatcgcgaacgagctcctctggtactgcgctcatcagctgttcgacctcgcgttcgagccgatcgacgacgctcactcgcgaagggcgtggtcgcactacgaaacgttcaacgagctcatggccgaagcagcgcacgccgttgccaatgttgacgacgtcatcgtcgtcaacgactaccacctctatctcgtgcctcgggcgctccgagcacgcggctggcaaggcacgctggtcttcttcctacacatccccgtgccgaccgagcaggagtacgcggtcctgccggcagtggttcgtcgggccctcctcgatggcatcgccgaagctgacctcatcgccgtccacgcaccgacgtgggccgagcggctgcgagcactcttcgatgcgagcggactcgtggcgccgccgatcgtggtcgcccccctccccgtcgacgtcgttggattgctcgagcgtgccgcacgtcccgatgtcgccgaagcgggcgagcgcctcgacgcaaccggcggcgcactccccacgatcacgcgcgtcgaccgcatcgagccgtcgaagaacctgctgcgtggcgtcgccgcgatcgaccggatgctggagctccgccccgacctcgcgggccggttccgagccctccacctcgcctacccctcgcgcggcaacctggacaagtaccatcgcctccgttcgtcgctcgtcgacatgatcgacgccgtcaacgaccgctggcggcgttcagggtgggtgccgatcgaggcgcacctcagcgacgacccggcacgatccatcgctgcctaccagcgcttcagggtgctgctcgtcaacccggtgcgcgacggactcaacctcgtcgcacccgaagcgagtctgctcgcccccccagacgcccacatcgtgctctcgcgtagcgcgggtatcgcagagcacatcggagaccatgtgacgctcgtcgacccgttcgacgtcgacgagaccgctcgtgccctcatcgatgcgctcgagcggcccggtgatctcgaaccggtgcgccgctgggttcacagcaattcctgggatcgctggcttgccacgatcaccccgaccgccacggagacgcgatgacaggctggagggacgtcgtcacggctctcgtcagagcgcaccgcccgctggttgcgctcgacttcgatgggaccctcgcctcgatcacggcggatccctcgcgcgccagcatcgctccggatctcctcgacgatctgagcgggctcgcgcgcacgctgcgcatcgcgatcgtgtccggaagacctcgctccttcctcaccgatcagcttggcgaccttgccgtgcggatcgagatcgcctccaactacgggcgcgacgagacggccacgcccgcagatcgcgacctcctcgaccgggtggcgagaggccttgcggacctcgcggccgatggcgcgctcattgaacgcaagccgacgtcggtggccctgcacgttcgggagcatcccgaactcgccgctcgagccgcggtgacggtccagaggttggccgccgcctaccaccttgatcttcaagaagctcgccaggcatacgagctgctcttgccttcatcggcgacgaagggcacggcagtctcgtccctgatcaccgacgacaccgacttcgtgctctacgccggtgacgacgtcggcgacatcgccgccgtcgaagccgtgcgcggtcacggcgggccgtcgtggtgcctcgcgatcgactctggtgagctccctcctgcgctcgcggcgatcagcgacgaggtcatcgatcagcccgaactgcaccgccgtctccactccctccgcgaactcctcgcctcgcgtcacgccgatcatgacggtcctgtcgacgattttgctcaacgaagtcgcgaggccgaccgatagccaccgcagtgatgacccgaggagggccatgatggtctcggttggcacggaggtaggcgccgctccgtcgcgtcgtgccgacatcttgcgcgcaacgtgggagctcctcgccacgaccggagccagccacctcaccatccgccgcgtcgcccagggagcggccgtcgaccccgccctcatctaccactacttcgggtcgaagcgcggcctgctcggagcggctcgcgacatgccagagggcctgagcgacatcctcaaggcccagcgagggccactcgaacggcttcggatcctgcaaaccccaccgtgggcgacgtgggtcagcgccctcgtcgcctcggtcatcgatgatcgagaggacgcgctgcgatcgctgcacgaactcatcgcgagcgtcgacaccaacggcgccctgccgcgccttgcgctcctcggcttcttcgccgatcgcttcttgctgcacgtgtggtcagctggacccgatccggccgcgccgttcgatcatgagctgctgcgctagcgcgcgcgggtcatccgcatcctgaaggtcggcctcgagcggcgatgggacggtgacgagacgagccccgggccacagtgcgctgagacgtgtcgcacttcgatcgacgctggcgacccagccaccagcgagatcccatgctggaccatcggcccgtcgcacgacgaaggggccctccagcgccacgcgccacatccagctcagcgcatcgacggacgcccgaaagagatcaacgggcaccacgacgacgaggtcctgcggtcgcaggtcgagctcctcaagggcggccacgatggcgcgatgcggaccgaacccggcatcagcgacagccgcggctcctgacaccccaggaccgacctcgacgacgcggtacgacgcacgttcgagtgcgtcgcgcaaccactcggcctggatcgcccctccctcgcgggggagacgagccttgtcggtacccatacgccgcgatcggccacccgtgagcaggagcgcgacgcgcaggcgtcgagccggagccgactcctcatgccaccccaccatcctggtaggctaggtccatggacgcagcgacgccgttgatcgatcccttcgggcgggagatcaccgacctccgcgtctccatcaccgaccgctgcaacttccggtgcacctactgcatgccggaagagggtatgcactggctggaccgaggcgaactcctgagtttcgaggagatcactcgcatcgcgcgcgtcatggcgacagccttccggctccagtcggtgcgcatcaccggtggcgagccgacggtacgagcgcaggtaccgtcgctcatcgaacagctcgcgcaggttcgtcgccccgacggcaccggtctcgagctctccatgacgacgaacggcgcgacgttcgcactgctcgcggacgacctcgtctcggccggtctggcgcgcgtgaacatctcgctcgacaccttgcgtcccgagcgcttcgcacagatcacgcgccggacccgcctcgaacgggtcatcgagggcatcgacgcagcaatccgcgtcggtctgtcaccggtgaagctcaacaccgtcgtgatgcgcggcgtcaacgaggacgaactccctgacctggtgcacttcgcggtcgatcgtggcatcgaagtacgcttcatcgagttcatgccgctcgacggggacgggcactggtcgccccgcgacgtcgtctccgaggccgagatgctggagctgctcgccgcgcacttctcgttccaccccctcgcacggtcatcggctccggcgaccacctacgaactcgatgatggatctgggcgcttcggggtcatcccgacggtgacgcacccgttctgcgacgcctgtgaccgcgtgcgcctcagcgccgacggccgcttgcgcacgtgtctgttcgcgctggacgagcacgacctgcgcccgctactgcgcggtggcgcaggcgacgatgcgctcgccgagcgcatcgtcgccatcgtcggcacgaagtgggcaggccatcagatcggtaccgtcaggttccgccggccatcgaagtcgatgagccaaatcggcggttgaatcggatcgctccgtggcgaatatgccacccggcgagtcattcctggcctagagtgtggccatggccgacggcaagctgacccacttggacccgctggggcgggcccgcatggtcgatgtgactccgaaggagcccacgcaccggagagcgctcgctcgctgcaaggtcttcatgaagcccgagaccacggcgctcgtcgccaacaacgccgtgaccaagggtgacgtgctcggcgccgcgcggatcgctggcatccaagcagcgaagcgcaccccggacctcatcccgctgtgccatccactcctcgtcggctccgtgtacatcaacttcacgctcggcgacacctacgtcgaggtcgaagcccaggtcgagaccgtcgaccgcaccggggtcgagatggaggcactcacggcggcgtccgtcgcagcgctgaccatttacgacatgtgcaagtcgtacgaccgcaccatggtggtcggtgacctcgcgctctgggagaaggtcggcggtcgctcaggccactggcgtcgggaggaggccgtcgagctgtgaccatgcgggtgctcgagggaatcttggccatcggctggatcgccatcctcagcgcaccgatcgtcgctcggcgcaacgaccctgacggatttgtctcgctgcgacggtaccgcaaggctcgggtggcactcgcgcgtcgcttcgatggtacggtggcggttgaactcccgattccttcctctccacggggctcgtcccaacagctggtcagacgtcgtcgggtctatctgctgctgggagccgccctcctcgctgggctcatcgcactgcccgtcgatccgctcggagggtttctcacgagcctcgtcgccgcgaccatgttcgttggctacgtacggttgatccgccggcagcggacaccgagtagttcgattcgccagatggtgattcagcccgaaccgagccgctagcatgctcgttcatcggcgaccacgccgatgaaccctcgggggtgtagctcagctggtagagcgctacgttcgcaacgtagaagtcggcggttcgagtccgctcacctccaccgacggtcagcctcacctgctggatctggtgggtccgatcacggtttgcatgacagcacgcgatgggttcaccagcgcgcgggcacgtgctcaacagacccgaccgcgccgagctgttggcacacatcgacgggcgcagcggccgttcgacggcatcgtctcttcgcgctcggctggtgcgtgtgcccacctccgcgagcggcgtctcgcaacgatcggttgaaccgagtgtgcagcgagccggcccgcttcgagcccctgggagtcctcgggatcgggagtgccgggcatacccgcagttcggcacgggctcgccgtggcgtggtcctcaaggaggtagcgatctccttcgtcggccgccccctcgagacatcgatgggggcagggggagcagtctcacccaacattgacatggaggggaactccgagcacagcgggttgcgccgctcgaggctgcctggcgcaacaatccggagcgcttcgtacgcaagccgccggagccgcctgccctaccgaggcacgtcttgatcaatccgccagaggaagtggcagcgccgacacagtgaagtgccgaccaggggtgtccgtcaaggctttgacaggttccggagggcgtacgatgcacgagcccacacgatccccgtgatgccgatcccccgtctgcgaggaatcaacgcatcgtgcgccgataggtaggccacctcggtggagattccccgtcagcgagaacacaacgctgccaccgcattcaggtgagcgctaccggtatggctcagtgctccgatgtgctcgggagccttgacagaacatcgtcgtcggatcgaccaaggagctgtgccagcgctccgagccgctcggggaccaggcggtagtacacccacatcccgcgccgctggcggctgacgatcccggcatcgagcagaaccttcagatggtggctcacggttggctgcgccaggccaagaggagccaccaggtcacacacgcaggcttcacccagaggcgcaccctggagtaggctgatcaattggagccgagcaggatcagccacagccctgagcagggtggcgagtctctgggccgctgcccgatcaagcgtcgggcgcgtcagggttggagtgcagacatcggccgccgtcgactgaccggcatcaggacggaccagcggccgtacggcgttcctcacagccctcatcctacaaccgccctctcggcaccgaagggatccgtcgaccgtggcctggatatattgatgaccatcaatacattacggtgcaaccacgcaggtcgaagaccgaccgccccgttgggcggcgtcaccaacgtgcagcagcactggacgtcaccgacgagcagcagccatcggcacgcgcatcgacctcgaaccgtgccagcgacgaggaccctcggacccaggcacgctcctctgataacccctcggtgtcccttccctccacggcggttggactctcagggagtcacgaactcccgaaggccgcgccgtagtgccactgcgcggaacacccgagcgcgccgacagtccccatcgcggagcgcttcccagtcgtgcagccgaaggcgtatggagctcgcgtgctgagcctccacggacccgccctcatcgtcacggccatcgcgatcttcgtcgcgaccctggccctcgtgatcacgcaacccaagggactgtcgatcggctggtcagcgaccggaggcgcgctgctcgctctcgcgctcggcgtcgtccacctcaccaacgtcgtcacggtttggggaatcgtctggaacgccaccgcgaccttcgtcgcgttgatcgtgatttctatggtgctcgacagagtggggttctttcggtgggccgcactccacgtcctgcgcgcagcccacggcagtgccgtccgtgccttcttctacgtgctcatccttggcgcggtggtcgcagccctctttgcgaacgacggcgcagcgttgatcttgactccgatcgtgtacgagcaagtgcgtgcactcgggttcgggcctcgtcaggcgctcccgttcgtgatggcggcaggcttcatcgccgacacaacgagcctcccgctcatcgtgtcgaacttggtcaacatcgtgagtgccaactacttccacatcggctttgctacctacgccaagacgatggccccagtcgacctcgtggccttcgtcgcgagcaccgcggtcctctacctcttctatcggcggatgctgcctggtcgttacgatccgaacgcgcttgccgctccccacagcgccatcgcggaccacggcctgtttcgggccagctgggtggtgctcggggtcctgctcggcggctacttcctctcggagccgctccacttcgtggtgtcgatccccgccggtcttgcggcgatcttcctcctgctcctcgcctcccgctctgccgcactctcctcggccgccgtgctccgcgaagccccgtggaggatcgtggtgttctcgatcggcatgtacctggtcgtcttcgggctgcgcaacgctggtctgaccactttcctctccgacgccctcagcgcaaccgctcgcgccggactcgtgccagcggcccttgcgagtggcttcggtgctgccgcgttgtctgcggtgatgaacaacttgccgaccgtcctcatcggtgcgctgtcgatcaacggagcacatctcgcaggactcgctcggacggcgtcggtgttcggcaacgtggtcggatcagacctcggcccgaagttcaccccgatcggctccctcgcgacgttgctctggctccacgtcctcgagaccaagggcatcaagatcagctggggccgctacttccgccaaggcatcgtgctcaccgttccggtccttgccatcacgctggcggccctggcagggtgggtcgccattgcgcactgaaacagcgtcagcccgcgatcgatcaaggagccttcgagagcaaggagcaaccatggacccacgacgtcgtctcgaccagccgcagccgacgagtgacccccgaccgatccggtgccgatacccggccgcctttcacggaggagacctcgggccagccgagaggcgcatcggtcatctcggacccggtgccgctcgatgggcgcagaggtcagcatgatgcgccttctgtgcatcggagggagcgacggcgggatctctgccgcgttgcgcgctcgagagctcgacgcctcggccgagatcaccgtcgtgctcgcagacgactacccgaacttcagcatctgtggcatcccgtaccacgtctcgggcgacgtcgccgactggcacgacctggcccaccggacgcgctcagacctcgaagcgctcggtatcaccctgctcacgggacacaccgcccgccgcatcgacgtcgctgggcacacggtcgtcgcaaccgatgccgacggacgcgagatcagcctcggctacgaccgcctcgtcctcgccactggcgcgacgcccctccgcccaccgatcggcggactcgaccagctcggccacggggacggtgtccacgccgtccacgccatggaagaccttcacgcggtcatggcgagtctcgccacccgcgcaccgtcgcgagcggtcatcgtgggggccggctacatcggcctcgagatggccgaggcgctcacaacccgcggcatcgccgtgagcgtgctcgaagcgctcccccacgtcctaccgacgctcgacggacccctgggcgacgtcgtcgccgaggaactcgctacccacggcgtggcggtctacacctccacaacggcgaaggccatcacgacggaaggccgtcggctccgcgtccacgccacgtgggcacccgaggctgagcccagagcgctcgaactcgacgccgaactggtcctcgtcgtcaccggggtcgcccccgacaccgcactcgctcgcgcggccggcctcgagctcaccccgaggggcgcgatccgagtcgaccgaaccatgcgaaccaacgccccagacgtccttgcggccggggactgtgtcgtcacgtaccatgccctcctcggcgagacgtatctcccgctcggcacaacagcccacaagcaggggcgtatcgcgggcgagaacgcccttggcggcgatcgccacttcgccggcagtctcggcacccaggtcgtgaaggtcttcgacctcgtcgcagctcgtacgggcatccgcgacggcgaggccgagcgcgccggttttcgaccgcgcaccgtcgcgtcctctgccgacgatcacaaggcctactatccgggcgccacctccgtccgggttcgcatgacaggcgatctcctgagcgggcgcctcctcggtgtccagatggtcggggcactgaccagcgctgtccacaagcggatcgacaccgcagcagccgcgctcttcgccggcctcagcgtcgatgaactcggcgacctcgacctctcctacaccccgccgctcggcagtccgtgggacgtcctccaggtagccagccagcgctggatcagtgaagcacggcccgtcgacgacgcacactgaggcgtggacggcgcgactcacacaacgagcaggggccgtcgcggcgaactcgcgacggccaggctaaggggtctggcgagcgcgagactgccccatgtcgggtgagctcggggctgattccgccgaccgcgcacctaccagttcacgacccgacatgaagcgcgacacttcgactcgtgcgctagcgcaccccatcccgtcatcgcaccccgccgcgggcactctggtccccaccaggggccaccgaagcacacgagccctccccgggaccaccccgagccccatgggatcggcgcgcagactcctggctcccgactgcgctcgtgagcgtgcggctgcgacctgcacgtcgagcggcgctgtggtagcctgatgcttgccacgggagcccagtcgggctgagagggcggaagagccgccgaccgttggaacctgatccggctcgtaccggcggagggaggcagtatgaacaccattcctgtcgcgtcattgcggcgccgtcacgtcgacgaagcgccaaccgatcacgtcgtacaagctgcacacccgcagcagcgccgcgtggttcgtgaggctccgccactgccccatgacctctctggcgacgacgataccgtcctcgtccccttcttggaggtggcgaccgccgagggtcccgtcatcctgccgacgagcctgcccggtgccccactcggatcagacggcctaccacaggtccgggcacaggtcctccgccatcgctatggcgccaccgtgacccgtacgctgcctggggggccgctgcccaacggtgctcccgcccgtcccacgtacgccgccaaccagatcctgacgcagcggaccctcgcgcgccgcggatttggctcgtgggagctgcgcttcgtggcagcccgagagcaggtcacgctcgagcgcgtgctcgacgacgtcgcgagcgggcgggcggtcgtgccggcaaatcccaaccatccggaactcgaaccgacgatcatcggccggaactaccggaccaaggtgaacgtcaacctcggggcgtcgagcgtacgcgccgacatcgacgaagaactcgccaaggtcgcggtggcgctccagggtggcgccgacaccatcatggacctctccaccgggaccaagctcgcctgggtgcgcgagtggatcctgcgcaacagctcggttccggtgggcaccgtgccgatctacgaagcgctcgatcgcgtcggtggtcggcccgagcggctgagctggtcgctgttcgccgaggtgctcgaggagcaggcgctccagggggtcgactacgtcacggtgcacgccggcctgctccgcgactacgtgccgctcgcggcacgccggaccaccggtatcgtctcgcgcggcggctccctcatggccgcatggagtcagcatcaccaacgcgagaacttcttgttcgagcacttcgatgagctgcttgctatcgccggtcgctacgacctcacgctctcgctcggcgacggcctgcggcccggctccaccgcagatgccaacgacgaagctcagctggccgagctccgcacgctcggcgacctcgcacgacgagctggagaggtcggcgtccaggccatgatcgaagggccaggccacgtcccactccacaagatcgcggagaacgcactgctcgagcaagaactctgcgacgatgcgccgttctacaccctcggacccctcgcgatcgatgttgcggcggggtgggatcacgtctcatcggcgatcggagctgccgtgatcggagcgcacggggcagccatgctgtgctacgtcacgcccaaggagcacctcggcctcccgaacccggaggacgtgcgtgcggggctcatcgcctatcgcatcgccgcgcacgcagccgatctcgccaaggggatcaacggcgcacaggcgtgggacgatgccatgagccgagcccgctacgagtttcgctggaacgaccagtttgccctcgccatcgatcccgcaggagcgcaggcacaccacgacgaaagcctgccagcgcgcgcagccaaggatgccgagttctgctccatgtgtgggccgaacttctgcgcgatggcacactcgcatcgcgcgcttcacgacgcctgacggcaaccgagacagcgctgccgatcgacactcgttcgcgtcgcgatccgatcggcgcaccgcacagcacactcggcgacagtcggccatgcgtcgctgtggtcgatctcagccgagagcactcgcatctcgagccggacctgggtcgacgatggcgtcggaacgaccgacaatgcctcggcgacccggtaggggcatcgaccgagctgggcaccggaacctcggaccagcacgccaccgagacgaccagacgctcggtagcccggctcgggcgcgcctgtgctggtgcgtgagcgggcccgctcgcgacgtcatcgtcgggtgcgcaccagcatgcctgaagtctgcttctcccatcttgctacggtggagccgtgccaaggccacagaggacgtcgagctcccggtcgtcggaggggctcaccacgaatccagaagtgacgtgtcgcccatctcgcagctggtcgcgggggcaccacccctacgctggtctcacagccgtactggccaccaagcacgacaagctcccgctcatcgctcctccactggaagcagcgatcggtttgcaagtcgaagccgtccccgtcgacaccgacgtcctcggcacgttcactggcgatatccctcgccctggacctgcgctcgacaccgccatcgccaaggcgcgccttgggatgagagcagctggccgttccctcggccttgcgtctgagggcagcatcggccccgacccagccctcccgttcgtccatgccgatcgagagatcgtcgtcctcgtggacgacgagcacgggatcgtcgtgtgggagagccatgcgagctgggatatcgtcgccgcctcgacgaccgtccgccccgacgatgacctcgaaccgtttctgcgcgaggcgcacttcccggagcaccaggtcatcgtccgtccgaaccacggagtgctgcatccgatctacaagggcattgcctccctcgaccacctgacttcggccattgcagagtgtgctcgtgctgcgacagacggtttggcccgcgtcgagactgacctgcgggccaacgcgtgtccctcgcgtcggagcgcgatcgcagctgctgctcaacgccttgccgatcggatcgctgctcgctgtccgggctgcggcgcacctgggtgggggcgtgtcgacgtactcgtcggcatcccgtgcgcgtggtgtggcaccgaggtccccacaccacgcgccgagatcgacggctgcgtggcctgcgattgccgccagatgcgtcctctcgtcgcagccgagcatcgagccgacccgagcgaatgtcctgtgtgcaatccgtagtgaagaacgagagacggtagcggtcgtcacacagcgagcacggcggagcgcgtgaacgttggccacctcgcgcaccgacgcctgtccccttgaggacaggatcccagcgtcctcgagacgttcgacaatgctgatcaacgaggcccatggctgcttcgttctccctcaccagagggaacaccgctcgccgcgcgcgtgctcgtagatcgcgcttcgcctccggtcggtcaccaccagtcagcgagctcggtacgacataccgcagacaattgtcgacgccgttcgagaactgaacgatgtcaccggtgaacagtgaacagccgaccatggagggtgatcgctgtggaagactgggcactcgtcaggcggctggtagctgagggcgtccccaaggctcgcatcgccgagcgactggagttctcgcgcacgacggtcgtaaggctggccgcccggagcgagccgccgagctatcggcgagccccgaccgacagatcccttacgagcgtcgaggcccgggcgacggccccgctcttcgcagacgagcgtgacctcagccagttccgaacggatgcagcctcactggtcctcgaccagcgccgcgccatcgctgactgaggtgccccagaagttatagacacccaggttacttcatgcgagccccctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatgccgtgtcgggcacagaaggccacaactcgatggtcgctgaactgactccctcggtcggtgtgccagatgaccccctgcgcgttggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccgccgatgccgcccctggccatcgctgccgccaccgtgttgtggctcgtcaccacgccagcggctcagagtgccgccgtgatccgtcgtgcgccgtaggtgccagaggatgcctggtggaccgcgaccactcggtcctcgaggtcgcgtctcgcacatgcccgacgcgacggtgctacctgggtgcgtcgccatcggtcgtagccagcccgggagacctcgaggaagcgtgccatccgcttgatcttgaagcgagcgtactccgcctccatcagcgcgaatctctcttgcgtggtggcttcgcggcgaagtacgcggctgcttttcccaggaactcgttgtccttgcgcagctcctcgagctccctgcgcaacctgatgagctccgtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggtgtaggcagcggccttcttttgacccgggatcagcggtgcgaactgacccacccgtggcacaactataggtggtagtggtgaggatcgtggtgctcggcgtcacctcccttcgccatggcctcggccgcctggggcaacagtccaccggggagccgctgcttggtccggtccttcaggcggtagctctcgcctcggatgttcaggaccgtggcgtggtgcagcaagcggtccaatatggccgtcgcgagcacctggtcccccaccagggtgccccactcgccaaagcccttgttcgaggtgcagatgatgctcccggtctcgtagcgagctgagatcacctcgaagaagattcccccggcctccgtcgaaagcgcccggtaaccgatctcgtcgatgacgagcactttgggggcgaggtacttgcgcagacgcctcgggctgcccatgccctcgaggtcggccaccatgcgggccatggtggtgaagtagacggagtgcccggcctcgagagccgacagggcgagccccaccgcgaggtgggtcttgcccaccccaggaggtccaaggaacaccacgttggtggcgttcgccacgaaggcgcacgaggcgagctcgttgacgagggcgcgatccaccccggcggcaaagtcgaagtcgaagtcgccaaggcccttgcgatggggcaggcccgagagcttgagcctcgtctcgtagctgcggtggcgacgctcgtcgcgttcggcaccgaggagggagatgaggaagtccacataggaggcctcgcgttgggtggcggcctcgatggcggccccgacgagctcggcgctgcggggaaggccgagctcgccaaggagtgcttcggcgacctcaagcatggctcagcgcctcgtaggcatccagcgagcgcacctcgaccgtggtgtcgacgagctggcgggctcgggggccacggagtgcgccagcgagctcggcgcgtgggatgccctggtactgctggggcaggtagaccaccgtgcgggtcttgaacccaagcgagtgggtggcgatcacccttcctgtctcgtcggtgatctcgagggtgcgccctctgggcagcacccacaccgtgcgcgtgacgtaggcgattggtactccgtagctgacgccgccgaaggagacgaagccatcgaggctcacccgacgagggcggcgcacgaaggcatcgagctcggcgcgtggcggcaggggacgtagggcctcgcgctcggcacggtcgaagacctccatgggcgtagcaccgaggctcggatgcagcctgtggtcgcgctcgaggctccagcgatgggcctgctcgttgaggtcggcgaggtcacggaagcggcgggctggccagaagtgctccttcgcgtagcggatggagcgctccaccttgcccttggtctcgggccgtcggacccgacacagcgagatcgagatcccgaggtagcgggcgagatcgagcagctgggggtggtactcgtagccgcttgcggcgtccccgccgagcacgacggtcttcatgtggtcggtgagcaccacgttcgtgagtcccccgaagtggcagaaggcctcgagcagcgcaccgatgaagccgtagctgtcggcgctcggggcgaaggtgacgaaggtgcgccgcgagtagccaagcgtcgccacgagccccgggatgcgtcgctcctcgcccctggcgtccacgtaggagaagatgccccagtccacctggagctggtggccaggcggggtctcgtagcggcggatggggacgggtttcggaggtgcggtgtggcggatggtgcgcacgtagtcgcgcacgatggtgaccttgccggtgtagccgagctcggcgatccgttccacgatggccggggccgaggtgagcccgtctgccaccagccggtcgatctcggccttgtaggggtccagcttggaaccccgtcgggggcgggtggccttccccgaggtgccggcgccgtcgcgcaggtagcgccggaccgtgttccgggagtggcccgtgcgccgcgcgatctcgcggtagccgtagccctcagcctgcagttcgaatagcctcatcaaagacctgcccttcagcatcgggttgcccccttcttctggacccttgagggcaacctaccctggagggtgggtcatttttgttccgctgctcgtgggtcagttctagcccgctgcctacatctggggcggctcagatgggaacgtgaccttcgtgggtttgctattcgtggcaagcgtcagacagccagcgctgtacttgcgttcaagcaccaaccggtcacatagcacctcatatcgcttggcatacgacgcacccgcgaagatcggatcaactggaaagtacggttccacgttgcgaacgggcgcatggactttcgcacagtcctccagcagaaagaagtacccgaggaaaggcgcgggatgcttaccgaatcgaccttcccggtatgccgtccaaatgtcctcggcgttgccgatggcttcttccgttcggttgttgaagttgttaccgaagctcggaccgacctgtgacttgaattccacagccacaaggagctggccgtcaacgaccaccagcaagtcccacttcctttccggtcggtaatagccgggcagctcgagcgccgtgcggaccctgacatggtcaggctcgagcccagcatcgacgagtacgtccgtgagcagcacttcgagcgcacccatctgcgctcctcccgtgaccgcaccccgggtgcctgcgcttccccccatttgcttgacagtctgaatgtaggccacggccacctcttcgcgggcccagatgagctcgtactcgacgggcggtaggtacccgaggctcgagtgcaggcggacggtgttgtagcgctgaatccagctagcgatggcagagcgggcctcgtcgaggttcgcgaagcggtagcgagccaccagctcgcgctcgcaagctcccgcagaaggcctcggccacggcgttgtcgtcgcgaggtcgcgaccctgcccaccgactggcgaagcccgagcgtcgcgcagagctggcgaaccttccgggagaggtactggttggcgcgatcgctgtggacgatcgccccagcgaggctgccccgagtcccgagtgctccgcagatcgcctcgaccatcaggtcatcgggcatgcgacgctggagcgaccagcccacgatgcgccttgagcgcgccctccttggccaccgtgcggatgcgcatgatcacactgcgatcgacctgccactggtccgcggcctcgatcaccgtcacctcctggcgcaccagctggaggaagatctcgtacttctgcagagtggtcaggaaccgcttcgcacggcgtccagcccggtcagttccacgggtctcctcggtcatcggaacatggtcttccactcgtcgtggagacccgcggatgctgcttgattcgtgggccgatccctatcgcgaagtcaggcgcaaaccaaggccgtgtggctccgtgtgatcctgggaagcaccgaatcccacacaacggagagagggcggcagataccgtcgtgccgtcatgacggcatagtggtaacatgaagccatggcaaagaaaaagacgaccgtctacctcgactccgatgtactcacggcgacgaaggctgcagcgctcacctccaagcggtcggagagcgcggtcatcgaggatgcgctgcggtcatatcttcggagcggccacggcgatgcggcacgagatgagctgcgggaactcctgaagcgtgtggccttggcaagcgaccttgacgaggatgcagcgctcgcgcaggcagtagacgaggtccgagcggttcgtcaggagcgtcattcgcgatcggtgcgtggtgggtgagctgcgtcgtgttgtcttcgacacaaatgtgttcgtggcggcggtcacctcacgagacggcgtgtgcgcccggctcctccttgctgcgacaagtgggcggtatcgcctcatcgtctctccgatgctgctcgacgagctttctgcggtgctcgtgcggccgaagttccggcgatacctgagcgtcgaggacgcgcgtcggttcgtggaggtgatccgggagctggcagacgtcgtggacgatcccccggaggaggatgatcccatcaccggtgatcccgacgacgacttcctcgtcctcctggcggaggtggcgggtgccgacgtgctggtgtctggagacccggacctcaccacggtgcagcgtccgggacttgtcgtgaggacgccccgggcgttcctggaggacctggagcagccgatctgacggcggacatccccggcagggctcagtgagccccaccgggaacgagcccgggcgctatgccgccggggctgctggagcgctcttccgggagagcgcttggagtcggttggcgacgatctcgacagtgcgtcgagtgctggcgtcggtggcgtgccactggcgtgagttaagcctgccagccacgtacacgagccgacccttcgtcaggtatcgggtcgcaaactcggccgcctgaccccagagcacgacgtcgaagaagcccgaatgataccctgcctgcacggcgatccgtacggtcgtgacgtgcttcccggaaggagtctcccgaagatcaggggatgagatgaggcggccgatgagggtcacctggttcacggactctccccggctctggcgggatgccgccattgcggcggtcatcgtggtggttgtgttactgcgcattgctgcacctcttgttgtgtggatcgatgccacggtgacaagcgggcagactgccgagcggaattggccattaagccggtacggcttctcgctcttgggccttgcagcggacaggcaggggtctgctatcggggatgctcgcgtcccgtatggcgttcgtagacgatccagaagggtccagaaactccctgccaccgccttgacctgccaggatggagtcggcgaggctgctcagcgtagtgccctcctgtagacctcggatggaggtggagggcaccagcccctgcacgtacgcagctgactccgtcagcggcgagttctcggagcgtcaagggcagcgctcgatcgctgccaggcgctctgttgccgttgagcgcggctacgagcatccgagcactataggcaccgccgaagcaggtgactcgctggcaccttgtctgcaggaggagcatcctccttgggcgtgacaacttccgctggggcggtgatgccgtccacccccaaaggagatgcggaagaagcacaagatgatcgacacgagattgatcagggcactgcgtacgcatgccctgtgcatgcacacgcagggatccctacgagggcgacatcggcaagcccgccgctgcgcaaccgcagctcaccggcgacgtcgcgctgcgcacaccctgcatcggcatgcgtacgtagcgctgagcaggtcccgagaaatccacccgagaaactcgcccctcggacgagcgccggaatgacaaaccgctggccagacacctgcacccctgcacgaggtgcgtgcttgaccagcggtcatagtggcgggggcaggatttgaacctgcgaccttcgggttatgagcccgacgagctacctggctgctccaccccgcggcgtggagaacagtgtagcggcgctccctctaccccgccgccttgccggtcacgctcgcggccttgagctccgacaggatctgaccgatctgctcgatgtcgctctggtaggccccgaggttgccggacttcaaggcggcttgcgcctcactgtagagctgatcggccttggcgagcagcccggcggctgaactcggaacggtagccgtcgtcgacgtgcgcgacgaaccctgcacgcccgacggcacgacgccgaagatgtcgcgcaggacacccgcgaacgtcggctccatcgcaacctgcgtcccgtacacgccgatcacttccttgatctcaggcagcggattcgcctggctcgagacgtacatcgggcgaacccacaggaggttctgaccgagcggtagcgccgtgaggcccccgagcgacacgttcgagccgtgctggtcgagcagcgtgatctcctgagacacattggtcgcagacacgatgcgcgacgcaaccaatgcggggccgtcgatctggcccgaactcggagtcgtcaacgccacgagctgcgtcggatcggacgccgacgcctcgccaaagagcaggccggtcaggttctgctgcccgccgctctgcgagaacggcacgaatgcctccatcagtgccagctgcggcgaggaggtgccgggcacctttgccatctcgtagatcgggctcatcaggttttggctcgtgccgccgaagctgaacgagcttcccgacgagatcgagccgttctgcggctgtgccgacagcgaccacgcgttgccacccgagtagaacgtcgacggattcgtcacgtggtagatgccgtacatcgccgactgcacggcgaggagatcactcgggtagcggaggtgactcgcgatcgcggctggcatcgccgagaccggctggaagacatggggaaacgccgcctcgtaggcctggatgatcggatccgaggggtcggtgacatagaagtgcatggcaccggtgtaggcgttcacgaccaccttcaccgagttgcgaacgtagttgaacgacgtgttggcaagcggtgcgctcgacgacagcgcctgcgtgttggcctgctccgaataggggaagttcgctgtggtggtgtagccgttgatgacccagtcgatgtggccgtcgacgatcaccggatagggattcgacccgtagtgcaacaccggcatggccatctcgacgcgctggaggagatcgcgctcgaacatgatgcgcgagtgggtggtcagcaggctcgacaccaggatgttgatgtcgccgaagcgcatcgcaaatgccgcacgcacgagcagcgacgagagtcggacaccgcccgagccggcgtagtgggtctccgacgacgccccatcggggagctggtagtcgatctccgcttggcggctgtcagcgatcacgtagcccgagagaccttggccgtagtagacctgcggctgcgtgagcgtcggagcaccgcccgacgaggtcggcggaagatcacggatcaagaagatggggttgcccgcggccgagatctcgttcgccggtgccagcgcgacaccgtaaccatgcgtgaactgcagatgctggttgacccaggactgggctggaaggttcgctgcgttcagctctcgaacgccgatgatgaccggtgtgggcttgccgttgatcgtgtcgttctcgatcgagagcgaggggaactggtagtacgagcgaatggcctggagcttgccgaaggtctgctggggcgtcgaggttccccagagccgcgccgcgccaagggagtccaggttcgcctgctccaccgacgaactcgtattcgcggtcgcagaatagggctctgagggaacatcggcgatgtcgtaggcgtagcgcgtcgcagcgatgttgcgcgcgatgtagggaagctccttctgaccctgggcgggatccaccacgaacttctggatgatggccggatagatcgctcccagcacgatcgagatgaacgcccacaggcccagcccgatgaccggcaacacccaaccctgacggaagatgttgatgacgaacaggacgcaggccaccgcggagatgaagatcagcagattgatcgcggggagctgggcgtggacgtcggtgtagctcgctccctcgacgaagcccctggtcgagaagtccaactggtaacgctggaagtagtaaccaatggccttgatgagggccatcactgcgagcaggaccgacaggtgggccttcatcgagggtgcgacccgctgctctcggcgctggggctggatcgatccggtcaggtacccgacgaccgcggtgagcacgaacgtgaaggccgcagcaaggaagaaccacgagatcaggaactcgatgaacgggagtcgaaagacgtagaacccaacgttgacgtgaaattcggggtctcgcatcgggaaggactcgctgtggccgaagagcagccagttcttccattcggcaggtgcttgggaggcgacgatgagcgtcgtcaccacggcgagcacgacgggcagcacccaccgacgacggttggcgaaggcgcgatagcgctgcaccagttcgtcgtcgtggtcggccggttggcgcaggccctggcgttgcgcgacgaccatgctggtgagcgcccctgcgaggtagatcgccgcgaacacgacccacagctcgaccttggcgagcaggaccccgctccacacctcgccgaggtgatagttcgagaaccagaggtaatccgtgaagaagacggcgagacccttgagcgacagcagcaacacgatcgcgatgacgaccacgccgacgaggatgagctgcgcccgtgatggtccgcgacgctcccgggtcatgtcctgggggacgcgcataccatcacgagcctaggcgaagaccggcacaacgaggcaccggcacccgggatgcgctggcggtctctcatgacctgttgggaaagcctcgtcagcagcgacgacctcggcgagtgcgttgtcctcgcagtcggggcaggcacgacgcgtcgggtcgaggagccagcggtaccctcgcggcgcaccgacgctccgcacgcccgcgaagaaggcatcggtggcggcgtcgtgcgcaacctcatcgagtcgaccggctcgaagctcgcggtggattgcaccgacccgctgcgcgagctcctccggctcgccaccatcctccatcgtgcgcacgagcatcgcgagcacttcgtcgtcgagacgagcgacgagccgtgcaagtgcgtcagcgacgacgccatctgtgccctggtggtgcggcgcgacgatgccgccgagaccctcggcgaactcgaccccagccgccacgttccgttggatatggagttcgcagctcgcgcgcaacacggacgggtcggcccgcagctcgacgagacgagcggtgacctcctcgggatcgcgctggcgcaagtcggcaagcacctcgttgatgaggtcccccacgacgcgcttgacccggcgcgcaagatcgaccccgcgcggctctgcgagctcgagatagcgccggtacaacgatggtggacacgtattggcatcgtcacgatcgggctcgacgtcgccaactcgccccgcatcgccatcgtcggcctcagcgccgaggaccgcggactcgccacggtcgtggttcgtgtcgccaccacgctcgtcgacctcgtcaagttcgagcgtgtcgtcaccgtcatcgcgcacggccaagggctcgcgctgggcccgatcaggggacacgacctcgccggcgccagccaccgcctcgctgggagtgacgacatctgcagtgatggcgaccgcaccaccagcgtccgcgaggctcgagaacaagtgctcgaggcgctcgagacgctctcgtgcaaccgccgaccgatggctgggggagtcgtcgaccggcttacgtgcaccctcgccgagagcctcgctcgagggctccgagtccggtgacgttgcgtccgatggcgtcgcacctgggagatccgtgtccagaagtgcctcgtcgtgcggtgcaccgtcagccagtgcggtgtcccggagctccgtgtccgctgacaccgagacggccggctcctcgtctcgcgacgcctcgacgctctcgggcccctcgtgctcgtcggctcgagccgcacgtggccccccctcgtcccgtgaggcggtcgccaccgcatcgacctcaccggtcgtcgcaacgcgaggagcgagcacgtccgaggcgagtgagccggatggcccctcgacgacccggaccccactcgccggcgcaccctccccagcgagcgccgccgaaggagccggggcaccaacagggtcggcatcggaggcggtgctcgtcgcgtcgtgggcctcgtcggcgatcatccgaatgagcgacgtcacctcggcaagatcgaggtccggtcgcgcgagacgctcggcgacctcgctcaggtcggaggacgaacgctcgcgcgtgtctgcgacgtccgtcgacggatcgatcggcgtggtggtctcggccccgtcgctcggaggactcggaggctccgcgactgcgctactcggtccggcgatctcacgccgttcgacgaccgacggctctgcatcaaccccatgacgccgcgttcgccgctccaccgcgtcgacctggaccagcgcctctgtcgcaaccgttcgcacctgctcgagcagctggcgcagcgaaaggcgagtgaggtcgagattcgcaagttcttcgcgccgctcggccaccttggcctcggcgtcggcgaggagcttacgggcgtgctcgttggcgcgcagcaccagcgatcgcccctcttgcttcgcgctctccacggtggtctgggcagtccgatccgccattcgcgtgagctcactcgcctgagcgcgaacctgctcgaggtaggcctccgcagcctgccgcgcctcgccgagggcggcctcggccgcatgacgtgcctcgtcttcgatgcgctgcgcctcgcgtcgtgcacgctcgaggaggtcggcagcctgggcttctgcccgacgacgcagtgctgcggcggcctcggtcgcgctccgcaagacgtcggcagcttcgcgaccgacgagctgggcagcgcggtcggggtcttggagcgcgccgtcgagctcgttcttgaccttgagtgcctcggctcgcgcctcgtcgcgctcgagttcgcgcttggctccctcgcgacgagactcctccagcgcatcgcgcaggcgggcgacctcgtcgcgaagttctgagagcgtcgaccgaacgcggtcacggtcgaaaccgcgccgcacgaccgggaactcttcgtctggctcatctcccgagcgccacatcgctcctcctaccgagcgctgtgcgccgccgcctccggccggagccggtcgaggagctggagggctccacgcaaggtggcagctgcaagcacgcgcattctccccgccgcgtcggccctcgcctgcacgatttgcgatgttgcgacgatgaccgtctggatgccggcaactctagccgcgaggagacgctggcgaagtccggacacggccacgagtgccccgctcggatcgatcccggcgagcgcggcgatcggctggcgcggggcgcgggcgagcagcgcaggacgaagttcgtcggcgatcgccaggcccaccgccagccctgacgacgccgtgtcggcgtcgggcaggcgcagctcgagatgcaccggcgtgatggcggcggtcgcaggtgaggtcacgagtccgagttccccggcgaccgagggcaccgtcaccgacgagacgaaccgcgagagtcctgaggccgtcgaacgcaccaacgacaaggtcacacgcgtgtgggtgacggccgcggcgacggcgctggcgaacgctgctggcgtcggcacgggaacgccgtcgaccccgaccacgagatcgccagcgtgcacgacaccccggagcggagacgtcgggagcacaccacgcaccacctggccctccatcgactcgacccgaacgccgactgctcgacaggccgcgaccagcgcagcgatctccgactgctgcgatgcgctgagcacggctggatcgccagaacgtgcccccacgatctcggggaccaccgattcggcggggtcgaagcttgcgatcagccaaccaagtggcgagagcggtcgcgcggtcgtggtcgcgctcgcgatgtccagcgtggcgggcggccgccccgccacgcgcacgagcggcgcgatcgccacggtcgcacccggcgcaagggccacctcaccgatgcgtccgaacaccccccacccgagcaggaggagcagccatccgacgacccacagcttcgccccggcaacgacggcgtcgctcatcctcctctgacgcacgaggggagcctacgagttccgaggccgaaccaatctgtaatgatgattacactcatgagcagaccgaaggaggctctcatgacaacatggctttctcgcgccgaagccgcgtcagaactcgtggcggcgagcgcactgctgttcgaggcggaggtgatgtcgcgctccggtcacggcaatctctcctgccgcatcggcgacgacacgatcctcatgacctcgtcgggatcgatccgcaacctcgatccttcgacgctggccgtcgtcggactcgacggcaccgttcgcgaaggggcgatcgcgccggagaacgccgagatcatcgagatgcacacacaggtctaccggcttcgccccgagctcggtgcgatcatccacacccattcaccgaacctcacggccttcgcctatgcccatgagccgctgcccattcgctccgagcccatgcttcggttcggccaggcggtcgcggttcccgtagcgccctgggcgcctcgcggatcacacgagtcggtgggcgggatcgtcgaagcactgcggaacgccccagagagtcaggcggtgctcctcgccaatcacgggttgctggctctcggtgccgcaccaacggcggtggctcgcctcatcgtcgccctcgaggaagcggcgacggaggagcgcttcgcggcagccctcggtggcgccaaggactttcccgccgatgcgctcgccaaggtccaagcctcgatggcgagggtacggtgagcacgtccgaccgcttctcgtcgattcgtgacgggtatctgcggttcttcggctcggtccccgcgtcgttcgaggagcgggcgcgggtggcgcgtctcgttggtcgagaggcgaccctggaggccgcagaggccctccgagccgccgcgatctacgacaatccgctcgggccgcgcctgcagcagctcgtccacttcggccagctcctcgtgctcggcgaggagggccctgcggcgctgcacgcccgcaccgcggttcgccacggcgcaacgatggccgatctcgtgggcgtcgtcgagactgcgctcatcacggccggcgtccccgcctatgcgctcgggatgcgcgtgctcgcagcactcgatcatgtcgacgagtccgacacaccctgaactcggcgcgggctggctgctcggagcagtccaccgacacatccgttcgcgctgggcggagcggattcgtgcctacgacgtcacgccaccgcaggctgcggcgcttcgtgccctcgcgagcgccccaggactgtcgctgcgggagctcgcgcgacagatcgaagcagagccgatcaacctgtcgcgcacgctcgaacctctcgaggaacgtggcctcgtgtgtcgcgagccgagacccaacgatcggcgcgctcacgcgctcgtgctcaccccacgaggcctggacctggccgcctcgctgaccgcggccgcggccgagttcgagcacgagctggccacgctcctcgacccaggcttcgaccagacggtggcgtggctccatcgcgccctcgccaccttgcgcacgtccgagccgtcgcagccaggctgacccgcacggcctggcgtacccgaggcgcacacgacacgtctaccatctcgacgacggcacccgacgggaggcacccatggcacgactcgagatcgacgcagggtgcgctcgctgcgctcgggccggcacgcacgcccaacatctcgctggcccgatggacgtcgtcgagcgacccggactcgacgccgtgcgctacgtcgacgatgagggccgagccttcgcaggcttcgacgccatcgtcgccgtgctcgccggtcgctggccacggttcgctcgggtcggcacgatccgctgggtgcgggccaccgggacggtggcctaccgagcggtggcgcacgtccaccgcgtgggagatcgacccgacagctcccagcacgagggctccgagcgcccgccgcgaggctaggtcatccgcgagaaccgacggatcgcgatcggcgccgccacgatgacgaaccccacggcgaccgcgagcgatccgaggagcgaggcgccgaggctcacaccgaccagggcgcgggctcccgagccgacgatctcgaggcgagccgcgtccatgaccagcgagaccggctggtagcgcgcgaacccctggagccaacccggcagggtctggatcgggacgaacgcactcgagacgaacgtgaggggaaagagcacgggaaagctcatgagctgggccgcctccgcactcggagcgtagagacccacgatggcgaacaaccaggacagggcgtagctgaacgccaacacgacgaccaatccgaccacgaggccgacgagatgatgcggacggaatcccacggcaagtccgacgacgacgacgatgacggcggtcgcgaggttgcgtacgaggtcggcggccgtacggcccagcaggaccgcagcacgcgagatcggcagggcgcgaaagcgctccatgatgcccgacgcgaggtcttcggcgagcccgacgctggtggccgctgcgccgaagatgatcgtctggaccaagatccccggcatcaaaaagtcgacgtaggggaccccgagtcgagccgtgatcaccccgagcgacccgccgaagacgtagcgaaacagcaggacgaacatgaccggctggatgaacgagaagaacagcgactgtgggacgcgcaggtagccacggagcacccggcctgcgagtacccatgcgtcggcgatcacgctcccgccacgttcgtgtgcgatcacggcgctgctcatgccgccccctcggtactcagctgcccgttggtgatcgcgagaaacacgtcgtcgagcgttggttcgcgtatcaccatgccctcgatcgcgaccccggcgccgtcgagcgcacgcagcgcgatcatcgctgcctgcgcaccgttctcgacgccgagctcgaccacgcggccatcgacgcgcggatcgggaaacccggccgcccgcagcgcctcgacgaccatgggcggcggctccgcggcgagccgcacctcgaccaccgtcgccccgaggcgagccttcagggaggctggcgttccctcggccacgatgcggccgtggtcgacgatgacgagtcgctccgccagtcgatcggcctcctccaggtactgcgtggtgagcagcacggtggtcccgctcgctgcgagatccgccacgatcgcccagagcgcgaggcgactctccgggtcgaggccggtcgtgggctcgtcgaggaacagcaccggcggctcagcgaccagtgctgcggcaaggtcgagccgacggcgcatgccgcccgagtaggtccgcagggggcggtctgcggcccctgcgagaccgaaggcctcgagcagcgaccccgcacgctccctggctcgacgccgaccgaggtggcagagccgaccgaccatctcgagattctcacgagcgctcaggcgtgggtcgaccgcagcgaactggccagcaagcccgatgcggcgacgaacgacgtccggctcgccaatgagatcggcgcccgcgacgatggcacgtccgccgtcggggacgagcaccgtcgtgaggatgcgtaccagcgtcgtcttgcccgcaccgttgggtccgaggagaccgaacacctcgccgtgggcgacgctcaagctgacgccggcgagcgcgacgagatcgccgaagcgcttcgtgaggtcgtgcgcctcgatggcgagtggttccatcccggtcaacctactcgctgtcgagatctggcgcgtcgctcagtgtgacggcagcagatcgccgatctcggctcgctcggcgatcagctcgtcgcgcgtcacggcgatccgagccgcgagcggttctggcacatcgagtccctccacgacgtgtacccgctcaccgtcggagcggaccgggaaaccgaagaagagcccctcggggatgccgtactcaccggcggacaccacaccgagcgcttcccagtcgtcggctgcgctcggatggatcaccgagcgaaccgagtcgatcacggcgttggctgcgctcgcggcgctcgaggcaccacgcgccttgatgatggccgccccccgctgctggaccgtcgggatgaagtgctcgtcgaaccatgccgcgtcgtcgatcacttcggtggccggcttgcccccgatacgcgcgtgccagtagtcgggcacctgggttgcggagtggttgccccagatcgcgaccgtgcgcacctcgtcgagcgcaacgcctgctcgctgcgcgagttgggtacgagctcggttctgatcgagcctcgtcatcgagaaccaccgctccgcggggatctctcgggcgttctcgcgtgcgatcagcgcgttcgtgttgcacgggttgcccaccacgagcacccggacatcagaggccgcgtgctcggcgagcgctcgaccctgaggacgaaagatcgcaccgttgacgccgaggaggtcgcggcgctccatgccagccttgcgcggcaccgagccgatgagcagggcccagttcacgccgtcgaaaccacgtgcgagatcggtggtgagttccatccgacggagcaacgggaacgcacagtcgtcgagctccatcgcaacgccctcgagagctgccatcgccggctcgatctcgatgagcgacagctcgatgggcgtttcgggcccgaagacgtcgcccgcagccagccggaacagcagcgaataggcgatctgaccagcggcgccggtgacggcgacacgaacgggtgtggtcatggtgctccttccatcatccccccgtcttctcgtccccccgacgaatgcgctccgcgacggcgtggccgaactcgctggtcgagaccttggtcgcgccatcgcgcaaccgtgcgaagtcgtaggtcacgatgccctcggcgatggtccgctcgagcgcatcgacgatggcgtcggcgacgtcattccagcccaggtactcgaacatcagcacgccggacaggatgaccgaacccggattcaccatgtccttgccggcatacttcggggccgtaccatgggtcgcctcgaagatcccgtgaccggtgacgtagttgatgttgccgcccggtgcgatgccgatgcctccgacctgggcggccagcgcgtccgagaggtaatcgccgttcaggttcgtcgtcgcgatgacgtcgtagtcccgaggccgcgtgagcacctgctggaaggcgttgtcggcgatcgcatccttgacgagcagcttgtcgccgggatcaccaccacagtcgtcccagccaacggcgacgtccgcgaactcctcacgcacgagctcgtacccccacgcacggaacgcaccctcggtgaacttctggatgttgcccttgtggacgagcgtcaccgagcggcggtggtgatcgagggcgtagcgaatggcagctcggatgagccgcttggacccatgggccgacacgggcttgatcccgatccctgcatcggcgccgagctcccacccgaagcgctcggcgaggaactcgcgcagcgcacgggcctcctccgaaccagcctggacctcgaggccagcgtagacgtcctcggtgttctcgcgaaagatcaccatgtccacccactccggatggcgcaccggcgacggcacgccctcgaaccagcgcacgggccgcaggcagacgtagagatcgagcagctgacgcagggcgacgttcagcgaacggatgccgccaccgaccggggtcgtgagcgggcccttgatcccgacgagatactcacgaaacaccgacagcgtctcgtccggcagccacgacccggtctcgcggaaggccttctcgccagcgagcacctcgcgccactcgacgcgacgcccatgggccgcgagtgccgcatcgaagaccgtcctcgcggcgggccagatgtccaccccggttccatcgccctcgatgtaggggatgatgacctcatcgccgacgatcagccgaccgtcggctcccatgcgcaccggagttgccacgggctcatcctatcccaccgtctcaaagcgccccagtcaggcctccggatcctgcctcgagccgccacgtgcaagacgatccgcccagcgctccacgtcggcaagctcgtcggcgttcgggaaggcgtcggggtccgccagcgcggcgccgacgagctcggctcgatcctcccgcaccaacagctggccggcgaagcgctgactcgcggcctccaccgccgcgaggtccatgccgaacaggttcgcgagcgccagcgtcgccggctcctgctcgcgccgatccgccaggctctcgatccagcccgcacgcccaaagaggcggggccgtagctcctccagcgccgctcgcgcgacgcccagcacgaagctggcggtcgtcgcgagttcgcgaaggttggcttggcgtgccgggctctcctcggcctcgaagaggccctcgagcccgaagcctccgagctcaccgagtcctgcgatgcccccgcgctcgaggagcctacgacccatcgcctcggcatcagcacgcaggtcgaggaggaacaaccgcagctcgacgtcgagacggtcggcgacgttcggcgaggcgatgagcggtccgcggaccgcatcctcgagcaccacccagaggccgacctccgcggcgggtgccccgagttcggcggcgactcgtccgatcgccgctggcgcgaccgtcgcgccagcgtggagggatcgtggcagtacgagctccgtccccgacagcgacgccatcgcgaagtgcccaaggaccgagccgagctgtgcattgaccatcatcggaccagcttgggctgcgagggtcgcgaacaagcgccccatctcgggatccatcgcgtcggtgaactggggctcggtgacgaccgtgccaccgagagcacgctcgaacaacacgaggtactcgcgcagctcaccgacgagctcggtgtacaggtcgcgtgggtggagggtgcgcacgccgatctcgacctcgcccacgacacgcaccgcgagcgccgactcgggaaggtaacgagacgcgatcggaccgagctcctcgaacggcgcgcgttccgtggcgccgagcgcgtcggctccggagagcgcgagctgggcaaactcgtcgcgcacccgtgacggatccgacccctgggcgctcatggcacgcgcgaggtcccgcagtaggaactcgaacgggttctggggctcctcatcgctcgccatcgctcctcctcgacgtgcctgccgcacccaatgtcgtggcacccacgcagcaccccaccctattcgccccgggaagcggacgaggagtcctacgatggaccaggtgagccacctcgaggctacggtgcgcgtcggccacgacgcccggctggtcacctggtaccgctggagcccgacggcgacgtgggtggtgatcgtcgagcccggcgcgacccatgactacctcgtcccggtgatcgaccagctgggtgcagccacctacgacccgatcggcaacgggcgctcgcgtcaccttccgcccgatgcgatcggccgcatcgggcgcaacctcgccgcggacgaactcgcagcgatcctcgaggcgctcccgggccccaggcgactcgtcagccaccacagtgcgtgcatcgccgcactcgacatcctcgccctcgtgccggagctcctgagtgagatggtgctcgtcgctccacgtctcgggcctccgcccgcacggctcgaccccttcgcgacggagcatgcctcgtcgccgtggcacgacgcgacccgcgcctggatctcggccgacccgcgaccgctcgagcactggcgcaccgaggtggcaccctcggttcgcgacgcgctccgggtcccggcgtcgacgagcaccgtcgcggtgcgcgcgctcgtcgacgccgacgacacggaggcccgtaccctcgccgagaccctcggagttcccacggaggtcttccccggacgcgatctcgcgctcgccgactcgtctcggttggtagccgcccttgctcgctgagtgttcgcgcagaatccggcgctgctcgcaagctgtgcagcctcgggcatctagcctggaagcacacctcggtcgagtcgtcgcgcgacaacccgcgagtcgacgacgaggtgcgtcatccaccgggcaatggggccagaggtgcgaggaggcatggtggtaagcgggtcgtgggagtcgacgacagccaccacgtggcttcgccttgagggcgctcccatcgatgaagccgcggtcgcgacgttctgccggcggccctccgtgggcgcggtggtcaccttcgctggcacggtgcgcgatcagggcgagggcctcagcggtatcatcgccctgcactacgaggtcgccctcgaactcgccgccgcacgcctcgatgcgatcgcagcacgtgccttcagcgacgctcccgagctccaagcgctcgcggtccaccatcgtctcggacgcgtgccgctcggcgagcccgccgtcgtcgtcgccgcagccgccgcccatcgcgacctcgccttcgacgcggcacgcttcgtcatcgacgccgtgaaggtggcggttcccctcgtcaagcaggaactcaccgaggtcggcgcacgatgggccccgagcgccacgcccctcgaagacttccccacacagaaggatgtgacgtcatgatcgagctgctctacatcgccatccccatcgcgctcgtggtcatcgtcgcggtcgtctccagcatgcgcgagcaccgtccccatgacgtgcgctcgagcgtctccacgttcgagcacgcccgtcaggcgctcgagcgccgcaccaccctcgacgcgagggagcgccccctccgtgagcgtggatctcggggtgcacccgagtgagccgtatcgccctcgatctcggtacggcgacgacgcgcctcgcgatcggtgccgagccgccgcacgcgctggagagccttgcggccatcgacgtcgagcgaggcgacgtcatcgccgttggcagcgcagcacgcgccgtggtattgcgtgagggcggtcgcacgtcgctggtgcacgtcgtcgacgctggcgtcccggtcggcccgcaggtgctcgccggcttcctcaagcgcacgctacgcgaggtcggcctccgctccctcgggcacggcgaagtcgtcatgtcgatgagcgaactcgccacgagcgtcgagcgccgcatggctgcgcgcctcatcgaccgcctcggtgcgtccgccgtgacgctcgtaccgccgtcactgagcgtactgcgcgccgtcggcgccgatccagagttcggctcgttcgccatggtggtcggggaagcctacaccgaagcaggcatcgcggcgatgggcagcctttgcgcgagtgctgcgagcaaggacggtgttcgcgatctgcgaagggccatcagagagtacctctggagcaatcacgagctcgccatcagcgacgagaccgcctccgaggtgctcacccaactgtgcgatgtgtctcgccccacccagagcgcccgtgcccgcatctggggacgacgccgaaccgacgcagagagtaccaacgtcatcgtcgatgcgagtgcgctggtcgccgcgatgactccgacgctgcgctcgatcgaacagctcgccaacaccgcgctcgcgcgggcgcatgcccagctcgtcgccgacatcgccgaacggggcctcgtcctcgctgggggcggcagctacgtaccgggcctcgccgcacgtctggcgaacgcgctcaagatccccgtgacggtcgctgacgagccactggacgccgtgcttcggggtctacgcaccagcgcgcgactccctcggcgtcgttcgcccgcgccctcctaaggggcgcacctgacgcacgcacctcggcacgctgccaagtgccctgcttgcaagaccccgtcgcacggtgctgacgccgctgcaccgctctcgcgccgagtccccgcggtccaaggtccggcgcaccgacgagccccgcgtgctcgcgtcggtgagcccatctgcgcaatgctcggcagcgacgagtcgcacgacacgccgacccggtggattcgacccgaagggccgagccgcccagcgacccaccggagccgacggctcgcccggcatgcaccacgtcgccctcgccagaggtgacaggtcgctcggtcggtaagtccacgccgatggcccggcggatcgatcgtacgttctcactctccgtgaagtttcttctctcagtggtcgatactcctcctgtacgcaccgatgacgggtcgcacgggccctggaaccggcgatcaaggaggagctatgcgtcgccacggatgggtagcaacagtcgtcgccagcgccgcgctcgcgctcggcatcgtggccactccggaagtcgcctaccgcacgccagctgcaccccggccgcagacccgagcagcgctcgcagcccccatcgtcggggtggccgccgacccaagcggccaaggctactgggaggtcggcgccgacggcggcatcttcaacttcggcggcgcgcccttcgatggcaacacctacaccttgggactcacgggtctcggtgggtcacgtccgctcgcagctcccatcgtcgggatggccgcaacccccgacggcaagggctattggctggtggcggccgacggcggggtgttcagcttcggagatgctggcttctacggcaacacctacaccttggggctcacgggactcggtgggtctcgtccgctcgctgctcccatcgtcgggatcgtgcccacccccgacggcaagggctattggctggtggccaaggacgggggcgtcttcagcttcggagacgccggcttctacggcaacacctacaccttggggctcaccggtctcggtggctctcgtccgctcgcagccccggtcgtcgggatggccacaacccccgacggcaagggctattggctggtggcggccgacggcggggtgttcagcttcggagatgctggcttctacggcaacacctacaccttggggctcacgggactcggtgggtctcgtccgctcgcagctcccgtcgtcgggatcgacccgagccctaccggtgccggctacaccttggtcgcggccgacggcggggtgttcaccttcggggacgcgagcttcgacggcaccacctactcgatgggctacacgggacttggggggtcacacccgctccctggcgccatcgtgggggcggccgaggcccccggggacaccgggtactggatgaccagcgcgagcggctccatcttcgccttcggatcggcaccgttcgacggggacacctcgactatcggcctgacaccgaccgtccagaacgccctcgccaaccccagcacgaacctggccccaaccttcgacgcggcctgcttcgagcagttcctcgcgagcggaacggttgggtcgaccgcctgtgatcaagacgccatcgccgccatcgatcaagcccacagcgacgagggcctcccgccgctgtcgctcccgtccaacttctacgcgctcacgaacgccgagcagctcttcgtgctcgtgaacgaggaacggatccagcgaggcctcccggcgctctatgggctggcaggcaccttgaacgccgacgcgaccgccggtgcccagtccaacagcgaccccggctttgcgttcacgcagtcgtggccatggcttccggacgcggggagcaactgggcaggcgactatgcgccagcggcgagcatgttcgattggatgtacaacgacggttggggcggatcccaggccgcgacctcgaacatcgactgcacatccgcaacggcacccgggtgctgggggcaccgtgccaacatcttgatcaccgttccccaaggcgccgtcggcgtgatgggagccgcgagcatccccgagagcacactgggtgcgagtggctcccccttcgaatcggacaccatggtggtcggattcgtcccagcagcgtccgtctcgggcctaacctacacctacacctggtccgaggccgtccaagccggagccgatccgcagccgtaggccaagcccagctttcgaactcaaaggcgacggcgactcgctggccgccgtcaatcgcaggacctccagcaagtccggattaccagagacatgacgagtatcattcggataccaggaatggtacatcacgaaccgaatggtacatcacgaaccgaaacgagctgacctagtgcaaacaccgagcccgggcatcgatcccttaggagccctcacggcatcgatatacgactcgcctcggctctacgccttcctcatcggaagcggggtgtcgaccggagccagacagccaagcgcgtgggaaatcctagaccagctaatagcgcagtatgcgtcagcaaccagtaccgatgtgcgcgcgcttggtctaacaccaaccgaatggtggcagcgcactttcgaatctgacgcggaatacagctcagtcctggagcgactcgaacccacaagaggaggccgccagcaacgcctcgagaaactcttcatctcaagctcgccttccgacgcccacaggcacttggccaagctatgttcgattggacacgtgcaggtgatcatgactaccaacttcgatcgcctgatcgaggacgcactaactgagcaggccgtccgattccatgtggtcgatcacaacaatgtcaagggaatgcaaccccttgtgcgcggtgccgtcacagtaattaaactcaatggcgactatgccgatctttacatgaaaaatacgagaatggcactgtctcactacacgcgaccatttacgaccctaataaagcgagttttgcaagaatatgggctcgtggttgttgggtggtcgggtcggtgggatgaagggttgcgaaagctgattgagagcaacagcgcacgcctctaccctatgtactgggtcgcacatcatggtcagctacatgacgaggcacagcggttgcttgatcagcgtggtgcttacaggattgactcacacggagctgacgacttcttcggccggctagccacaggactggagcgtctcagtcaactagcatacacacgtgccaggcctataagagccttacgaggcggccgagtattcaccattagtagtaattggagtccagtttcatcgccaagcacccaaagcggcaagttgtggattcgcactgccgtcacactcatgccagcctcgcagcagggagtcggttatgtcgatgccgccgaaatgtggggatacattgacactccagaaagaagagcgatccggaccgaacttgccgccgcgcgggccgcgtatgacattgccagtcttgttactgtcggccagctaaattctgggcttccggtcgacatgctgaatcaacaaatggaatggcacctttcgaagactgaccagctagatcgagattctgtttacttcgaacttgacgctccgaagagtgactactgtacttgttcggcgcggtgtcgcgtttatcttgggcccgggcgccctgagcaacagggcagcgcaatcatagacatcggcataggcgatctcaaggaccgctccaatcgacagcgaaagcttgctttaggagagctcgcgatcatttggttggaccagctcgacgctgcgattcgaattctaaccgatgcacttagcagtgctacaggtgggatggcaatgattgatacagtggaattccacctagaatatctgggcaagcctgacgaaccgagtatgggtctcgctcaccacgtcgacttctctcttctgggagttggaggtcgcgacgctcgagcagtgtcctctaagtttaggccagctgaacccctaacaggcgcagcaaagctggatatcgtcattgatgcagtaagggatatagcaatgaacactgggtttcacgacccagacattgggattggccgcttaaggagcgaactcgatagcctgcctcgacaagcttaattaccgatcccaaacaaatccataacggctcaatgacggcgcctttatatcgctgctgacgcatgtgaccgacccccgaagccgagtcaaggagccgtaacgtggcgacttcgggctcactggcctcccccctccaggttgagacctgctataggaggaagggatgagccagacaccgagcccaccaccgggcgacggaccagctcgacgacgacggggccgttacccgagccagttccgtagggacgccgcagcgttggtcctcgaccagcaccgaaccatcgctgaggtcgctcgcgaactcggcgtgaacgagcagacccctggtaactcacgtgcgcctagaacgcatccaccgaggtgagcgagagggcctaacaagcgcggagcgcgaggagttgacactgctgagtcggcaggtcacacagctcaccatggaatgcgagccggcgaagcgagcgatgtctcactcggtgaatgagggggacagtgggccgttaccactcagatctcccgctaggagaccaatggcttctccgtggcggcgccagcacgagtcatcggggtctcccccctggttgaaccgccccgggtttcgtgcacacttcgttacgtgtgaacggtctcggactcggccgctaggcggccatagtactcctgctcgacctcaatgggtggaccgcgccccagccggtgcatgagcctgcgcgtgttgtaccagttcaccgaggctctggtctcctcctcaaggtccgtgaggctggtaagaggcccgcgcgcaaagggtgggccaggccgcacgcacacggttgtggagagaccgatcgtggtctcggcgagcgcagtgtcgtaggcgtccccgacggagccgatcgaggccaccatgcctgccaacaggagcgattcaccaacatgcacggccgtcgcggcagagcctgcatccgagtgatggatcgtgctcccggtgagggggtgcccctcgcgtgcttgtcggccctcggccatgcgcagggcacgctcgacgagtcgggtgtcgtggcgacaggagcaggcccaccccacgatggtgccggcgaaggcgtcgatcacgaaggccgtggtggcacgccgcccgtgagccggacgtcggtgaagtccgccacgcacagctcgtcgggtcgctcccgtcggaagtcccggttgacgaggtccggggcgatctcggccttggggtctcgcatgtcgtgcgttgccgtgcacctgtcgcaccccgcaccagccatcagcgcgcgcgagccgttgcagcgtgcagcgggcaaccgggatcccctggcggcgcagagaggcccacaccttggtcgcccctaagagcgactccggcggacggcgacctttagcgtcgggctcatagatgccggcaaggatctcgctgatggcgctctctcagaggcaacggcgcgacggggctcggccaaggtgggcgtcgtaggtcctgggagcgatcgcactgtgcgtgcgctctcgagcgctcggacaatcggagcgaccccgtaggcccgtcggtgctgcgtgatgaagtcgcagatcaccgctggtgcggatcctcgcccgcgcgaagaacgttgtcgctgccttcaagatctcgatccgagcgctcgagttcagcgcgttcgtgcgcttcgagcgctcggatctcggctgtggtcggtggtgatgcccggccgctcgcctgcgttgactcggtactggtagagctacgtgcgcagcgtctctggtgccatggggagccgtccggacactgcctcgatcgctgcccattgactcggatactcgctgcggtgctcgagcacgaggcggatcgcctgttccttcgtctgctggtcccatctgctggccatgatctatccttcccttctctccaatggaagtgtgcatcaaagccggggtgattcaggttgtactacccctggcgacaccgtcgggacgaggcgaggatcccgagcacctggtgctcgcgagcgagccccacgccatctggcacgagagcgacggcacctacgccaagtccccgcatcacccacgagctgcgacacgcggttactgcgtcaaccacaagcgggtggagcgcatgatgcgcgagctcgagatagcagcgtgtctactccgccgcttcgtgcgtaccacgacgcggcaagaggacgcacccctcccagacctcgtctgtcaggacttcgctcctggtgagccagcgcgtcgctctgtgagcgacatcacctacgtccgcaccgacgagggcttctgctacctcgccacggaggtggatctcggatcaggcggatcgtgggctggtcactcgagcgtcgcatgcccgatgggctggtgatccaggcgatccgcggagccctcgggactcggggcagcctgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggctcagagtgccgccgtgatccgtcgtgcgccgtaggtgccagaggatgcctggtggaccgcgaccactcggtcctcgaggtcgcgtctcgcacatgcccgacgcgacggtgctacctgggtgcgtcgccatcggtcgtagccagcccgggagacctcgaggaagcgtgccatccgcttgatcttgaagcgagcgtactccgcctccatcagcgcgaatctctcttgcgtggtggcttcgcggcgaagtacgcggctgcttttcccaggaactcgttgtccttgcgcagctcctcgagctccctgcgcaacctgatgagctcggtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcagcctggctggggcgatcttccacagcgatcgcgagtggcgtcccaccaagtggtgtaatttctgggcggcctgcactccaggagggcgggccaccgggcgatctctggcgtgtcagtcaacagctcgccagaggaggtatccagtggccctgacccgttccgactttacccacttgctctggcgccatcagagcgggcggtgacatcgacgtcatccgggagggggtggagctcgtgctccaggccctcatcgagcgagaggctgcggcggtcattggcgctggccgctacgaacgaggcgagggacgccagacgcaagcgcaacggctaccgcgaccgtctgctcgtcaccaaggccggcgacgtggagctacacatcccgaagctccgccgggggagcttcttcccgagcatcctcgagcgccgccgtctgagtcgatcgtgccctctacgcggtcgtcatggaggcctacgtctgagggagtcagtacccgcaaggtcgacgacctcgtcacggccctcggtgggacggggatctcgaggagcgaggtctcccggatcgtcgcctccctcgacgaggagctggcagggttccgtacccgcaggctggaccatctcgagttcccctacctcttcgccgatgccacctacgtcaagggccgcctcgagcaccaggtggtctcccgtgccgtcgtgaccatcacgggcgtgaatgccactggggaccgcgaggtccttggcgtcgccgtcggggatgggcagactgagagcttctcgcccgagtgcgcgagggagctcagggatcgtggcctcagtggtgtgcgcctcgtcagctccgatgcccatcgggggctcaccaacgccattgccaggtgcttcatcggggcgagctggcagcggtgccgagtgcagcgtgcgcgatgtgctcagccgcattccgaaggggagctgaggagatggtcctggccccagatccgcacgatcttcgctcagccgtccccgggagcggtacgtacccagtacgaccaggtcattgactcccttgccgcgaagctcccagcggttgctgccatgctcgccgaggccaaggaggaggtctgcaccttcacgcacttcccggaggcccactggcgaaaaatctggtcgacgaacccgctcgagcgggtgaaccatgagatcaagcggcgcaccaacgtcgtcggggtcttcccgaacgacgccgctctcctgcgcctcgtcaccgcggtcgtgctcgagcagcacgaggagtgggccgttgccgagcggcactacctgtcacaggagtccatggccgagctcgggactgccacgagcgacgacgacacggcgggcacctccgagacgcctcggccccctggcgctcctccggtgctgccgtcgcccgccgaggaagagcctgcagtggtaggctgaggccagccagggagtgaatttacaccactcggtgggacgtgatccgatcgcgccatccagtacctctcccggaaggtccggagcctacttgcgaccctcggcattcgccagtcagtgggcagagttgcgacctgctacgacaacgccgtggccgaggcctgctttgggagcttgaagcgcgagcttgtggctcgctaccgcttcgcgaacctggccgaggcccgctcggccatcgcgacctggatccagcgctacaacaccgtccgcttgcactcgacgcttgggtacctaccgcccgtggagtacgagctctcctgggcctgcagggaggtggccgtggcccaaattcagcctgtcaagcaaatgaggggaagcccacacaggtgaaggcggactcgtttgttggggactgtcaacatcgaggaattcgagggtgccttggtcaattccaacacccagcacatcgccagcgcagccccggcaacgccctcagaccatgcggcatcatgcaccgtctcgagaccagaccctctcgccgcgacgatcaagcgcgatccgaagcgtcgggcgacgggtcggcaccggatggagtcccactcgtgtcctcgtcatcgacgacgccgagcccaccccgatcgcgaagcaggtccgccgccaccgaccgcacctggcggtctcgatcggtggcggcagcgcggagcgcgcggtcggcacgtgggtcatcgaaggcgcacagcgcaaccaccgcccgccgtcgaaccgccggcttgtcgttgcgagctgcgtcgatgacgacgtcgagaccctcgggcgcaccgatggatccgagcgcggcgatcgccgcttcgcgaaccctgaggtcctcgtggacacgagcgctggtcacgagcactgcgacgtcgtcccgatcgccgacctcgccgaggatccaacaggccgcctcgacgacgagcgggtcagggtctccgagcaggccccgcgcacgctgatgcccgatcgcagagggacccgccccccacagcgccccgacgcggacgtcggcgtcgtcgtgagcgagcagccaggcgagatcctgctcatcaccgcggcgtgccagcgcgatcgccgccgtccgagcactgcgtcctcctgctgccaccagggcgcgcagcgtcgataccggtgcatcgaggacatccaatgggttcgcgctactcacgtatcgaccctagcgtcagccgcaggaccgcacgagcggatcggctatccctcgggcgctacctcaccgagcgccgtcccagatgacgaaagaccagcagggcctgcgtcggatgcctcgatggtgtcgagccaggcgtcacttgcggcaactcgtgcggcctcgtcggggatcggcaccaaccgcgcgagcacgagataggcgacggccgtcgcaacgaggcccacgatccaagaaatgtcgaccccaccgagtgcgcgcgcgacgggtccggtgtagctcacggggccgagttggcccagcaccatgaacggaacctccgacgcaaagccaatggcgtacgcgatcaagccccgagcactccaggcaccgtagatcccagttggggtaaacagatcacgaatggcgtagtgaccacgtcggacgacgaagaagtcgacgaggttcgtcgccgtccacggcacgagcaggtagagcatcagcgtcagcgcggtcgcgacggtgttgacggcgttctgggtgatgaactctgcgatcgcgaaccagaccaccgtgagcacgaccgtcacgccaaggcgccaacgccgactcggcgtgatgctccgcacgctgtcgatggcggtgagcagcgtgagcgagccaccgtaggcgttcatccccatcgtggccacgagtgccgccgcggagaggatcgccgtcaccgatccgagtcccccgacgacaccgttgccggcggcacggagtgccgtgaggccgtcttgggcgttgagatgcacggccaaccaagcacccagcgcaatgagccacaccgcgctcgcggaggcaccgaagaagaccgaggcgatcacccgacgcgtcggcgtggacaccgggagatagcgcgagtagtcggagacgtagggcgcgtaggtgatgttgtaggccgcggacgcggagaactccgccatgaacccgacggtcgtgaagccgaggtgggaactcgccacgtggctgccgtgcacggagccaagcagcaccgcgacggacacgatggccatgaaggggaacgacgcgatgagcagagcccgaaaggcacggtggacccagtcatggcccaagatggcgagggtggcggcgatcagcgtcgagcccacggcgacgacctcggcattccagccgtacgcgctcgagagtccatcggccaagagcacctggtcggtcacgttgaaggcaacgtaggtgaacagtgccgcaaacagcacgacgatcacgccgcgatagccgaactgtgctcgcgactggatcatctgcggcagacccaagcgcgggccctgggagccgtggaacgccatgaagaacgtccccacgacgatgcccaacgtgccagcgaggatcgtccaaccgaccgacaatccgagtcctggcccgatgaagccgatcgggatcgtgaagtactggaagttaccgaggaaccacagcggcgcctgatgccacagcttgccatggcgctcccgagtcggcacccagtcgatggagcgggcctcgatgatgggctgcgctcgcgaggcgtcggaatccatggatcgatcctatcaagggcagcatccacgtgaaggcaaaccgagcatcattcgttatctctcacgcaacgatggcccgcgcgtcacggcggcgcgggccgtcatcgcccgccgatacagcgcaggccgacgacgacgccaggcaggccgtgcatcgagggcgtcggtgagcgcctggtcgacgacgagggtggcgacgccaccaaggggcgctaccgccaccgtgccgagcccgtctcggccgccaggagcgacgacgccggcgatcgtggggcccgccccaccgggctcgacagcagccaccgcgacgacgagatccgactcgatcgcccgtgcgagcgagagtcgaaacggcgcacgcggatcgccgtcgcgaggcgcgagttcgctcgtggtgagcgggcgaagcactggggcaagctccgggtcgacccggacgatactgacgaggaggagccacgcgcccgcctcggctgcccttcgggcgatgcgccaatcgaggagaccctcggccccggcgacggcaaccccacccggaaggacgacgggagcatcgttcggggcagctcgcaggtcgctcgccgtatcgagcactcgtcgctcaccaccgggcatgtgcacgagcgcaacgacacgacagccagccacgcgcgaccacggctcgagccacccaagctcgtcgtcgtgctcgacggtgagcgccgggagcaccagcagctcggcggcgttcggctggccttcgaggatcgcacggaggtcctcgacagcgacggggcgcgcaagacgcatcgccccgacacgacgaccgaccgggatggccgaccatcgagcaccggctcgctccgccagcgccgctcgcgaccactcgccagcgctcgagaggagctcgcgaggcacgcccagcgacggtgcggcacggggccgcctcgcctccacgtcggccaggaccacccctgggccatcgcgtgaggcgacgatcgtcccgtcgggtgcgatgatgcagccacctccgccgaagcgcacgccgcgttcggtgcccacacgattggcgacgaccatcgtcgcaccgacatcacgagcgcgcacccaccacgccagcgcgggcgtgcgctcctcgggccacgccgtcggcacggcaaccactgccggatcgcgcccgagtaccgcgagtggctcgggaagatcgagatcggcgcagatgacgaggccgacgatggcgtcacccacctccatggtgacgcccggctcgtcgcctggtaccgcccacaccgtgtcgtcaacccacagatgtgcctttcggtaggtcgcctcgagaccctgggccgagacgacgacagcgctgttgtacagggagccatccggagcctgctcgacgatccccgcgaccaccgtggtcgcttcgcccgcgagcgcctcgacgatcgcagcaaccgtggggccgtcggcaacctctgcgaccgcgcgcgcctcctcgcgagtgagcagatagccggtcacggagagttccggcgccacgacgagagatgcgccacgagcaacggcggccgcgacgcgcgcttggagtcgctcccttccgtgcgctgggtcgagcgctcctgcagcctcgatgatcgcagcgacacgcacgcggacctcactcaggcgcgagtgcgcgcgtcgacgatggccgcgagcgcgatcgacgccgcgaccgaggcgttcagcgaggcgacggtcgccgccaacgggatcgccgccgtgacgtccaccccgcggcggaccaacggcgcgagtccgcgcccttcggcgccgacgacgagcgcgaggcgctccgtggcgagggtgagcgagaagacgctcgtcgcggcgtcggcgtcgagcccaacgctccacaccccgcgcgctcggagtcgacgaagcgcggccgggatcgacgacaccagagcgaagcgcagccactcgaccccaccggctgcgaccttggtgacggtcggtgtgagcggaacgctccggtagcgcggcaacaccacgccgtcggcgccgaacgcggcggcactgcggagcaccgccccgaggttgtgcggatcctcgagatgatcgaccacgacgagcagcgaaccgtcggcgagaccgtcgaggcccacatcgaccaccgggtcgcagtcggcgaggaccccctggtgcacctcggtgcgcgcgacgcgctcgaaacgttctggcggcaggagctccacggggacgccagcgcgcgccgcggcctcgatgatcgcctccggctcacgcccggcctcgacgatcacgcgcctgacgcgacggcgcccagcccggaagcactcgaggaccgcgcgcctcccctcgactcgttcaccgccgagcccacggccaccacgagggtgcacatcagtcctcggcatcgaccacgccttcgagcagcacgaccgcgagcgcagcgacgccctcgccacgaccgagcgcaccgatgccttccggatgcttggccttgacgagcgctggcgccgcgacgacaccctcgatcgtgcgggccatccgggcgagatacggcgagagcttcggtgtctcgcacacgatggtcgcgtcgacctgcacgacccgaagacctcgaccccgcacgagccgaacacagcccgcgagcagctccaaggagtcggctccgcgaaaggccgggtcggtgtcggcatagaggtcgccgatgccaccgatcccagcggcgccgagcatcgcatctgccaccgcgtgacagagtgcgtccccgtcggagtgtgcccgcaggccaggcccaggcaccgtcaccccgccgagcaccaacggccgtccgggttcgtcggagcgcggatgctggtcgagccccaacccgacgcgcacaccgatgagatctcgcaggtcgcgtcgcgtcgtgaccttgcgcgcagacggggacccgtcgaccacctccacggtccagcccagctgctcggcgacgaccgcgtcgtcggtgccctccagccctgagccgatcaccccagccagcacgccgtagtggaagccctgcggtgtctggatcgcgcggaggtgggctcgctcgagcgtgcgggtcacccgaccgtcgcgcacctccttgatcgtgtccgcaacgggaagggccgggacgacgaccgctgcaccgttcgcaagacgggcgatgaccctctcgaacagcgacaccggtgccaacgggcgtgccgcgtcgtgcaccaggacgaactccggcgcgccctcgagggccgcaaaggcccggcggaccgactcagacctcgtcctcccgccgacaaccgtcgtcgccccttcgacgacccgatcgacctccggcgggagcgccacgatcacctgcgacgacaccgcgcgcgcggcctcgaccgcatgctcgaccagcgatcgattgccgagcgcctcgaactgcttcgggccaccgaaacgactcccttgccccgccgcgacgacgagggtggcgaccgccaccgcgccctacgcgagggccttgtcgagtcgagcctccgcttcctcgggcgcgacgtcgagggcgaaggtcagctcggagaccaacacctggcgcgccttggcgagcatgcggcgctccccggccgagagccccttgtcgtgatcgcgcagcgtcaggttgcgcaccacctcggcgacctggtagatgtcgccggacttgaccttctcgaggtggttcttgtagcgccgcgaccagttcgcgggcatgcgcacgtccttcttccccagaacggcgaagacctcttcgacctcttcgtcgttgatcacctcgcgcaggccgacctcgtcgacggcgtcgacgggcaagcgtacggtgagatcgccataggccaccgtgacgacgaagtactccttggcctcaccgaaggcctcgacgacctcccgtccggtgatcacagcggcaccatgctgcgggtagacgaccttgtcaccgacgtcgaatggcacagcttcctcactttcccgacgccctcgtgcgcgtcgggctcactcgtagcgcttccagtataccaggtcgatcagggtgaaagtccaggtcacctggctattcgtaggacctgaggtgagccacgaccgccttggcccagtcgggatccacgccagccacggtcgccagctcgtcgggttccatgctcgccaacgcatgcagcgaaccgactcgctcctcgatacgcgcggcgatcgatcgcggcagccgcggcacgtggtgcagcagcctggagcccttcgacggcaggttcacgccgaggagctcaccgtcgtagagatcctcgtgcgcgagcgagacgcagcgcgcgcgctcggcgacgtgacgcgccagctggacgacgttcatgagctcgtcgagatccagcgacgccaagagctccttgatgtcgcgcacctcgccctcgtcgcacacccccagaaagtcccggaggacatcggtgtagtcgcggtcgaagtcgagggtgatctcggccgcctgcagtgcgacgaggcgtccgtccgcaccgagttcgaccagatagccgtcgatctcctcccgaatccgacgcaccatctcggctcgctgcagcacgaagaccacgtcgcgcaagctgacctgctcgcgcaactcgagcccgttcagttgctcgagcacctggtcgaggcgcccccgatagcgctcgagcgtcgagagcgcctggttcgcgcgcgagagcagctgggggatgggctgcagcgtgcgcttctcgcggcgtcgatacacggagatcaccgacagctcctccgagaccgccacgaccgtagcgtccacgctctctgccacacgctcggcggtacggtggcgcgtgcccgtctcactggtcggaaggcgtggatcgggcacgaggtgcacgttcgctcgcacgatctgcgacccgtgcgaggacaggatgatcgcgccatccatcttggcgagctcgaacagccgctgtggggtataggcggcctcgatgaggaagccgccggtacagagctcgaggacctcgggcgaatcgcccagcacgacgagcgctcccatgcgcgccagcaagatgcggtcgagcccttggcgcaggggcgtccctggagcgacgctccgcagtgcctcctcgatgcccgcgccttccacgctgctccctccgtcagacgcaggaaccggcaccccggtcgcgctctcgaagcctcgtggagcgcgccgtgcgacagcgcgctccaccgactactcctgtgggttcgagccggccagctccatcgggggcggctcgagtccctccatcacccggaagacgatctcctcgccctccacatcgacgaccaccatgtcgcccgccttgaactcttggtgcaagaggcgctcggcgaggggatcctcgacgagtcgctggatggtacgccgcagcggtcgagctccgagttctcgatcgtaaccacgatctgccaggaagcccttggcggcttcggtcagctcgatgccgatccccttcgcctggagctgatcttgcacccggcggaacaagaggctcacgatcgccatgacctcgtcgcgacgaagctcgtggaacacgatcacctcgtcgatacggttcaagaactccggcttgaagtgcgtcttcagcgcctcgttcagccgcatcttcatccgctcgtggttgacgtcctccgaggacttcgcgaaaccgacctgggcgcggtgcaggtcctgcgtcccgaggttcgacgtcatgatgaggatggtgttcttgaagtcgaccgtgcgaccctgcgcatccgtcaggcgaccgtcctcgagaatctggagcaaggtgttgaagatgtcgggatgcgccttctcgatctcgtcgaagagcacgacggagaacggccgacgccgaaccgcctcggtcagctgaccaccttcgtcgtagccgacgtagcccggcggcgcaccgacgaggcgagcgaccgtgtgcttctccatgtactcgctcatatcgagctggatcagcgcgtcctggtcgccgaagaggaactcggccagcgtcttggcgagctccgtcttgcccacgcccgtcgggccgaggaagatgaacgagcccgatggacgacgggggtccttcaacccagcgcgcgtacgacggatggctcgagacaaagcgctgatggcttcttcctgccccacgatccgatggtgcagctcgtcctccatgcgcagcagcttggaggtctcttcctcggtcagctggttgaccgggatgcccgtccacatcgcgaggacctcggcgatgacctcctcgtccacgacgccgaaacgctcatcgccctcgcgcttccacgccgcctcgagctcggccttgcgcgagacgagctcgctctcgcgcgccgccagccgcttggcttcgtcgaagttctgacgggcgatcgcgccttccttgtcacgacgcgtgcgggtgaggtcgttctcgacctgtcgcaactcgggcgggctggtgacgcgcttgatgcgcagccggctccccgcctcgtcgatgaggtcgatggccttgtcgggcaagaagcgatccgagatgtagcggtccgccatgttggcggcggccaccagcgcttcgtcggtgatggtgacgttgtggtgggcctcgtagcgctcacggagacccttcaagatctcgaacgtgtcctcgatcgagggctcgccgaccttgatcggttggaagcgccgctcgagcgcagcgtccttctcgagatgcttgcggtactcgtcgatggtggtcgccccgatggtctggagctcaccgcgggcgagcatcggcttcaggatcgacgcggcgtcgatggctccctcggccgcaccggcaccgacgagcgtgtggatctcgtcgatgaagaggatgatgttctccttggtgcggacctccttgaggaccttcttcaggcgttcctcgaagtcgccccggtaacggctgcccgccaccagcgcaccgaggtccaaggtgtagatctgcttgccgcgcaaggtgtcgggcacctcgccagcgacgatgcgctgcgcgaggccctcgacgatcgccgacttgccgaccccaggctccccgatcagcaccgggttgttcttctgacgacgcgagagaacctgcatcatgcgctcgatctcgttgtcgcgaccgaccacggggtcgagcttgcggtccctcgccatctgcgtcaggttccgaccgaactgatcaagaatgggcgaaccaccgggtgcgtcttgcccctgggacggtccggccccttgaccgaccgtggggcgaccctcggtcgacgacaggatctgcatcacctgctggcgcaccctggtgaggtcgacgccaagcgcgagcagcaccttggccccggtcccctcaccttcgcgcacgaggccgagcagcatgtgctcggtgccgatgtagttgtgaccgagctggagcgcctcgcggagcgagtactcgaggaccttcttcgctcgaacggtgaatgcgggggagttcggcgtcggccctggcgacggctcggactggcgcgtcacctcctcgcgcagctggtcgagtgagacacccagcgattcgagcgccttggctgcgatcccttctccctcatgcacgagacccagcaagatgtgctcggtcccgatgtagttgtggtggaggagcttggcctcctcctgcgcgagcacgagcactcgacgtgcccgatcagtgaatcgctcgaacaagtctctcgcctcctcgatcggcacctccgggttgaggacccttcgactccgatctggtacctggttccttcattctacccgcaacgctcaacatcgctcgaacatgccttgacgtcggcatcggcagcgccaggctgaaccaccgagttgctccagtctgccacggacagctgggctgtgtctgtgggcaggctcgacagttcgctcacggagtactcacgagaccgccctcgatgtcgccgagcggcagccatcgccgggcgcgtgcacgaggaccaaccaggtcgcattgaccgcgaacacgtgccagatcgcaccgaggtgcgcctccaaccacccgaccgcggcctgcggctgggcaagcaggctgcgatcgaccacgatggagcacacgtcgtggcgggcaaggtaccccggcagctcgtgggccgcccgcgatgccagcgacgcgtcgggttgggtcggttgggccacgctccagagatagccgaggacggcggagtcgttcaaccgagcgatcgtctgcgcgggcaggcgtgacacatagccctcgggcgtcggggtcccgatcacggcggcctcgtagggatagagcgcgatcccagctgcccaggcactctgggtcgggatgaccaccggcacgtagaacgtggtgccaccgaccgctgcgatcccgcggggacgagggaccagcgggagcgcagtgtcggggaacggcgtcggcgccgaaccgacccagagcgccaccgcaacggccgcgacgagccccgcacgcaacagccggcggtggcgacggcgcccgagcgcaacccagacccactcgagcaccgctgcgccgagcagtgccccgaacagcgccgtgagcaccgcgagacgctccggcagggtgtcggacacgaacgggatcgcatcgaagggcaggtacggaagcgggatcggcgtcagcaccccatcgacgtggaggtaagggcccatggacgccagagcgaagatcagcatggcgagcccgagtggcaggatcaaccgctcgagccgaggcgcgagcggaccgtgacggcgctggcgtacgacgatcgcgacgccaccgacgaggccgatccagggaccagcgccagggaagcccgagccgtccgcgaggttcggggcaaggtgccacacgggggcgaggaagtggaaggcgccccacggatcaggcacaaagaaggacagcgcgtcgaccacccacggggtcgagaagggcgtctgcgccccaccgtgaaccgcgagcggactcagcaggagtgcgtcgaggagcggcgcgacggcgacgacggcgacaacaccgaggacgagccagccccgccaccacgccacgagggtcgcgagacgcctcgacgcgagctgcggatgcacgaaccagagcaccacgatggcagcgatcgcgtagatgccgtagtcgtagacgctccagaccacgagcgccaggagcgcgccgagcacaccgaagcgccagagagcgggatcggcacgatcgaagaggtcgaaggcccaacccaccaccaacgcgagccctgccccgtcgaccaggttgagatgcccgagcatctggcccatgaagaacgggctcgcgaggtagatcgcaccggcgacgagggccgcgccgcggccgagcccgacgcgacgcgcgcaccacgccgcagcaccaccgtcggcgacgagggacccgaggagcgcgaggttgtaggcgaggaccggcgtcgcaccgaggtgctcgagcacgcccgcgacgatggcggcaggcagcgcgagggtggcccacgcgaggtccgcacccctcggatagagcacctggtgcgtgaggaagagcccgtgggcaccgaccagccagcccgcgacccagtggatgtaccacagaaactgcggcgagtcaccaccatcgccgatcaccctcgacgtcaggtgagcgccaccgggccagctgagcaggagcgcctcggcaccatagatcacgacgcacgccgcagcgaaggcgagctgtgcccacgttgagccgcgctcgcgcgcttgccgtgtcccgatccgtgccgccgtcgacgacgcagacacggtgtcgtaggctgacattcgcgagatactaccgaacaccacggccgctggcacgtggcgcggggaccaaggacccggggccacacggacccgacgggctctagggtggacgaggtggagcatccgttgccgctcggtgagccgtgggcgggtccgtacctccaggcggtcgaggaagggctgcgtcgagcagcgaccacgaccgatccggacatcacggcggccgccctgcacctcatcatggccggcggcaagcgcgttcgaccgctgattgcgctggcgacggcccttgcactcggcgaggtcgcaccgtctcccgacgaccctgtcgtccgcggcgccgtcgcggtcgagctcgtgcacctcgcctcgctctatcacgacgacgtcatggacgaggcttcggagcgtcgtggggtctccagtgccaacgcccggttcggcaacctcatcgcggtggtcaccggcgacttcttgttggcccgcgcggcgggcatcgcagctcgcctcggtgaagaggtagccgcggcgctcgcggacacgctggccgccatgtgcgaggggcagatcctcgaggttgccgacgcgcaccaactcacgcgcacgaccgagcgctacctcgcgaccatcgcgggcaagaccgcgtcgttgatggggaccgcggcccgcatcccggccatcgtcctcggacgcgaccaagcgatgctcgatgccctctcggctgctgggaccgcgctcggcatgctgttccagctccgtgacgacgtgctggacctcgtcgcgacccgcgagcaactcggcaaggagccggcacaggatctggtggaggggatctacaccttgccggtgatcctggcgctccacgaccccaccgtgcgcgaggccctgctggacgtgctcccacgagccgcagaccccgaaccacgagccgtcgcactcagcctggtccgtcgcagcgacggcatccctggcacgctcggccagatgcgcaggatcgaggccgatctcgatgccgtgctcgccgacacgctcggcatgtccgattcgtggttcggtcggctcgctcgcgcgctcgtcagctcagccgagcacctcgcagccgcggtaccggcacccagcgcactcgcctgagcacccccggcccagtttccaccggtcccaccaagagcatccgcgcatcagctcgcggcgccagagctccgacgtcgccgaactcacggccgggcatacccccgtcggaacgccccgtcctcgggcgcccagctcagtcgagccgacgagcgagcgagccgaccgacgcccggggtgcgccggcgacgagagcagccccgtcacgcggtccatgcgccgattcgctccgcgaccagcgccgctcgtctcctcacgccgtctcgtcggatgcgccatcctcgtcgacatcgctctccgaggatcccgcctccggtcgcagggtcgggaagagaatgacctccttgatgtggcgctgccctgtgagcagcatggcgagccgatccacaccgaggccgagaccacccgtcggtggcaggccatactcgagtgcccgcacgtagtccgcgtcgtaggccatcgcctcgtcgtcaccggcacggcgctgacgagcctgctcctcgaagcgagcacgctgctcgtccggatcgttgagctcgctgaaggcgttgacgagctcgcggcccccgacgaccagctcgaagcgctcgactcgccccggtcgcgaccggtgacgacgagcgagcggcgagacggactcagggaagtccagtacgaacgtcggttcgatgagtcgcggttccacgagctcctcgtagagcgcgaccaacgcccgccccgcctccggctcgagcacggcaagatcgaaccgtcgagcgaggtcgagcagtcgtgcgggctcgtcgaggctgacccgctcgccgaccgcctccgagacgagatcctccatcgtcgccgcgcgaaacggcggggtcagatcgatcacaccgagctcgttctcgccgcgggtcgacccgaagacagcgcgcgctgcgctcgcgagcagcccttccgtgagctcgcgcatcgcgtcgatgtcgccgtaggcctggtaggcctcgagcatcgtgaactcggggttgtggcgaggcgagataccctcgttccggaagtcccggccgagttcgaacacacgctcgatcccgccgaccacaagtcgcttgaggtagagctcaggggcgatcctgaggtacaggtccatgtcgagcgcgttgtggtgggtcacgaagggtcgagcggccgcgcccgaggcaatgggctgcaagatcggcgtctcgacctcgacgaagccccgtgcgtcgagttcgtcgcgaagggctcgcacgagtcggctgcgggcgaggaagcgctcgcgcaccccggggttggcccacagatccacgtagcgctggcggtaacgcacgtcgggatcgcgcacaccccgccacttgtcgccgaacgatcggcgcgcatgcgcaagaagctggatccgatcaacgaggacggagcgctcgccggtcctcgtggtcgcgatcacaccgtcgacgccgacccagtcgccgagcaccagggaatcggccagcgtcgagaacgcctgggtgcgatcggcgcgcagccagagctggatcgctccgctcgcgtctcgaagctccccgaacgccatcctcccttgccgcctgaggcgcaagatccgtccggccacccggacctgctgatcggtgacggtgtcgggcgcgagaccctcgctccgccgtcgcacgacatcgacgggctccaccccgccaaaggcgtacggaggcacgaagagcgctgcggtctcagcgtcgggcgctcgacgttcatctgcgctcatcgtccgtcctctccaccacgccccagagacgcaaggagtctaggctcgagcccgccgtccctggttgcgcgcccagacgagccgcagcccgtggagcgtcagccacggctcgatatgcccgacgacgggcacctcgcagccgatgacctcgcacagcccgcccgtcgcgacgaccggagcctcggctccgatctcggcacgcatgagctccacgaggtgggtgacctgcccgacgacaccgttgatcaccccggactggatcgactccaccgtcgaacgaccgatcgccgccttcggccgccgtagctcgaccttgcgcagcgccgcagcacgcgccaccaacgcatcgagcgcgacgaccacccccggcgcgatcgcaccgccgaggtaggcaccgctcgcatcgatcgcatcgacggtggtcgcggtgccgaagtcgaccaccagcaccggcgcgccatagagctcgaccgcggccaccgcatcgaccacgcgatcgggaccgacctctcgtggatcgtcgtagcggatcgggatcccgacccgcgtccccggtccgaccacgagcggacgaagcccgagatgcccctcgaccatgtccacgacgcttcgggtcacgttcgccgccgaggatgcaacgatcgcgccgacgagcccaccgacgaggtggtggcgatcgagaaaggtctcgacgaggatggcggtctcgtctgccgtgcgatcggcgcgcgtcgccagccgaaggtgcgcgacgagtccctcctcggccgtcgtcgccgcagcctcggtgtcgtagacgccgatcacggtctcggtgttgccgacgtcgatcgtgaccacgtgctcagccatcggcgcctccgatcgcacggttgtcgatgagccggacaccctcgacgcgccaggcagcgagcacgcgagacgcgggcgtgagggcccgcgtcggctcgagcaggggcggttctgcgacctcgacgtagtcgagatcgacccccccgagatcggcgagcaggcgagtccggaaggcggcggcggcgtctcccacacgagcactcgcgcagtgacgcgcgaggatctgggcgacacgtcgcgcctcgcggagcccgaccggcgagagccgccggttccgcgacgacagcgcgaggccacccggatcgcgaacggtctcgaccgcgacgacctcgacagggaggtggagctcggccaccagccggcggaccacgagcagctgctgaaaatccttctcgccgaagtaggcacgagtgggagccgtcaccgtgaacagcttcgtcacaacggtcgcgacaccgtcgaagtggccaggacgcacggcaccctccagccgctcggtgacgcccccgacgcgcaccgagacgaggatcggactggggtgcaactcctcgacgacgggtgcgaacacccagtccgcaccggcgtccacggcggcacgcacgtccgcctccagggtccgcggataggccgcaaggtcggtggggtcgtcgaactgcagcggattgacgaagacggagacgaccacgacgtcgtcgcgctcccgcgctcgccgaatcagcgcctcgtgcccctcgtggagcgcacccatcgtcggcacgaggccgatggcagccccggcgtcccgggcaggtgcgagcgcctcgcggagcccggcgacggtcctgatcagcgggtccacgcgcaccccgcggcatgagcgacgacgggcggtcgctcgaggtgggccaacgatccccccgccaacgaccgcgcgagggcggcgtcgaggtccgcgagcggccacagcacgaacgaccgaccgaacgcgcgcggatgggggacgacgaggcgcggaggcgagctcacgacgacgccgtccatccacaccacgtcgagatcgagcgtccgaggagcgttcgggacgctgcgttggcgaccgtggcgcgcttcgagcgcgagcaagtcgtcgagcaggcgaaacggcgaacggtccgtgcgcagctcgcacaccgcgttcaggtaccgcggttgcgcccccggcccgccgaccggctcggtctcgtagaggttcgacaccgcgacgacctcgccgatggcgccgagcgccgcatcgagggtccgcgctcggtcgccgaggttggcgccgagggcaacgaaagcgcggcgcctcacgagcgctcaccgccatctcggacccgcgtcacgaccacgtgcaccgtggccccggccagtgccagtgggggggcgagcttggtcgcacgaacggtgacgcgctcgagctgcgcccagccgagcgtcgcaacgatggcgtcggcgagccgcgccgcgaccgtctcgaccaaggcacacggcgtcgcaaggacctcgggcacgaggcgatcgagcacgctgtagtcgacggtggtggcgaggtcgtcgccgatcggctcctcggcgacgacgagttcgaccgcaagctcgaccggctgcggcagggaccgctcggcctcggtcacgccgaggtgcgccggttgcaccatgccctcgaccgcgatggtcaggcccactcgcgcgccgcctcctccatggccgcagcgagacgcaggtactcacggatcggccgtactcggtgcacccgcaccacgtccgcaccgtgctcgatcgcccagatggccgcggcgaggctctgctcctcgcgctcgagcgggggcaacgcgggctcggcacgactgagctcggccagcatgctcttgcgcgagaggccgacgacgaccggtgcgccgagggacgcgatttgacgaaggtgcgcgatcagcgccaggttgtgcgcgaccgtcttgccgaagccgatcccgggatcgaaccagacctccttcacgcccagcgcacgcgcctcgtcacgtcgctccctgagccacgccgacacctcgcccaccacgtcggtataggtcgggttgacctgcatcgtctgcgggtcaccctgggcatgcatcgcgatccacaccgcaccgacctcagccgcgaccggtccgagtcgaccgctcacgtcgttgacgatcgtcgcgcctgcctcgaccgccgcccgagcgacggcgggcttgaccgtgtcgatggagacgaccccgtagggagcgagcgccgccacgaccggcaggacccgacggagctcctcggtctcgggcaccggcaccgcgcccggccgcgtggactcgccacccacgtcgacgatgtcggccccctcggcgaagagttcgagaccgtgctcgatcgctctggccgcatcgaagtagcgaccgccgtcactgaaggagtcgggcgtgacgttgacgatccccatgatccgagcgtcgcgacgctcgctcatcggggcggccgtcctcgctcgagctccgcgagcgcgttggggctgcccacctccctgcccgccagcgcctgggtcgtcacgatcacgccctcgcgtcgcaccccccggatggcgatgcaggcgtgctcggcccgaacggtgacacggacgagacgcgcccgggccgccttggcgatcgcatcggcgatctcctgcgtcagccgttcttggagctggaggcgacgagcgtgccgctcgatctctcgcaccacggccgacaggccgaggaccccagctcccgggagatactccaccgagaccgtgcccgtaaacggcaggaggtgatgctcacacagcgaggcaaacctgatctcgtcgaggacgacgggagcccgctgctcgggcgcgaaccgcaccggatcgtcgggctcggcccgatacccgccgagcagttcggccagtgcctcgaccacccgctccggggtgcgcgtgcgcacgtcgtcggcgagcgtcgcaccgagggtggcctcggcccacgcgagcagcgtgtccacggccgcgcgagcgtcgtcgttcgtcggtgcgctcatacgtcctcccgataggtcgcgatgaacgggaggttccggtagcgctcggcgacgtcgagtccatagccgatgacgaaggcgggcgggatgtcgaagccgacgtaggcgatgggcagatcgcctcgaccgtcgtcaggcttgcgcaacagggcgcacacggcgagcgacgccgggttgcgcgaggcgaggttcgtcaagaggtagcggagcgtgaggccgctctcgacgatgtcttcgaccacgatgacgtcgcgcccttcgagctcgacgtcgaggtccttgatgatccgcacgacacccgaggtccgcgtggcactgccataggaggacaccgccatgaagtccaccgcgaccggcagctcgatcgctcgtgccaggtctcccatgaacacgaacgcacccttgagcacccccacgaggaacggtgcgcggcccgcgtagtccttggtgatcgccgctccgagctcgccgacgcgcgcacggaggtctgcctcactgatcaggacatcgccgatgtgcgggtcatccagcgaccacgtcacgggcgcctcccttcggactcgagcccgagacgggcgatctctcgcccacctgagcttaggacgagcgacgagcccacgcgtcgcacgtcgaggtcgctcgggagtgcatgcgctcggcgagtaccatcggcgacctggacgagcgcacgccgatgcgccgccgacagtcgaaggcctgtctggtgtcggacccacgtcgcgagctgggtcgtcgccggcgcgagctccgggtagcgcgcctgcaggcgcacggcctcgcgggcgtgcgccgccgcgcgcgccagcagcgggacgacgtcacgctctgcgatcgcggcggcgagcgggagcagctcggtacgcacgcgcacgcgccgaaagcgtacgtcctgattcatgggatcgacgagcggcacgagtccggcggcctcgcagacgcgcgcgagctctgagcgccgaaggccgagtgccgggtggagggggccgggctccatggcgccgataccgacgagcccgctcccccgcaggagattcagcagcaccgtctcggcttgatcatccatcgtgtgtgcccgggcggcgtccccgagggcgccgaggcgggccgagcgcgcgcgcgcctcgaggttggggccagggatcacgcgcacacggcgctcgagcaccgagatcccgagcggagcgagctggcgggcgacgtcggctccttctcgggccgagcccgggcgcaggccgtggtcgacgtggatcgcgaggacccgcttgccaccgaacgccagcagcgcagcgagacccagcgagtcggcgccacccgagacgccgacgcggaccgggtcgtcatcgagaggccacagccgctcaccgagcgaggcgagatcgatgccgagctcacgagctcggcgctgggcagcctcgacccacgacgggctaggccgcaccgaccctcgccagccacgtctctggcgcgtcgagctcggcaagcgttgggagcgactcggcgcgttcgaacacgtcgagcgcgctgccaggccgttctgcctcgatgcgctcaaagaaccgacgaccgcgctcgtactggcgagccttcgcgtcgagtccgaggagtcgcgcgacgatgcgcgcgagaccccgcgcactgcgacgctggtcgacgacacgagccagctcgtcgtcacccggcacggtccccgaggggagggtccgcatgacccagtccgcgtggccctcgatgacgctcatgatggcgctgacacgagccaacgaggcagcagcacgttctgggaggaccagctcgagtggcccgagctccccgaggcggcggtcgccacccaaccagctgagcagcgaactcaccgcatcgaccggggtcgccggtcgcgcagcgatgacctcggcgagcgatgcgtagagcgtctcgagcagccaggggcgcgcgaagaactgcgcccgatgggcgagttcgtgcgagagcacccacctcgccaccgtggcgagatccgtcccagcccctgacgcgagatgctgggcgttctggcctaccagcacgagcaggggctcttcgtcgccgccccccggcacgtactgccccagaacgcgaggcgagagggccgcgagcaccgcgccgagcatggctccgctcacctcggccgcaccagcgggtaccccctgcgggtacaagcgaccgatcaaggctgcgtaggaacgcgcattgtggatcgcccacgcgcgccgtgacaggttcgcgaccgcgagggtctccgttccgatctcgagcccacaacgagcctcgacgatgggggcgagctctgccaccaggccaatcagatcgagaggcggcggcgctgtgtccgggacgagcgctcggatcgacagcgtcgccacctggtgcgacacggggctcaccatgagctgagccccgaggaaactacccggccttgcgctgaccgcgggttcgcgacgccccgatgggctgatgcgcgtagcagtacttggacttgttgtaaatggagagcgtcgtcgtacaacccggctccttgcacacgcgtcctcgctggtaggtgcggggtgcgtgcccagtcgccagaggttccgcgacgatcgtctcttcccctcggctcaccatgtccagagcaacccacgatgccccccgccctattcctgtcgcgcgtcggagacgtggcggtccttggccgattcctcaaggaggaccatcgcgagacgctcacgcagcgaggtcggaacccgatcgcgtgctcgctccgcgatgaccatgcgcagctcggcttcgaactcgaacgcctcgagacaggacccacagtggtccagatgggcttggagcttgtgccggcgttcgtcggtcagctcgccatcgaggaagaagtacagctggctgatcgcttcccgacactcgggcgtggacggaccccgagggtcgggctcgatctcatgacccttgtgctccggaccagtctcgctcgtcaccatctacgcctcggtctccgctgcccgctccgcacgagccagtcgcttctcgatcaacgcgcgctggagcgcgcgccttccccgatgcagccgactcatcacggttccgagcgggacgtccatgatgtcggcgatctcacggtagctaaaaccttcgacgtccgccaggatcacggccaagcggaactgctctggcagggcctcgagcgccgccttgacgtcggcatcggtgaaggtgtcgaggacctcctcctcggcgctccggcccgcgagggctgcctcgagaccgcccaggcggcgatagaggtagagctgctcgacctcgtcgaggtccgtctcgtccgggcgacggcgacgagctcggtaggcattgatgtaggtgttggtgaggatgcgatagagccacgccttgaggttggtgccctcctcgaaggtaccgaaggcacgataagccttcaggaacgtctcttgcaccaagtcctcggcgtcggccgcgttgtgggtcatacgcatcgccgcggagtagaggttgtcggcgtacggcagggcaagctcttcgaagcgcgcctgatccgccacgtcgcctcccgtcaccagccgagcccgggaggggactcgaacccctgacctgctcattacgagggagctgctctgccgactgagctacccgggcgccgagcgaccagtgtagccatgtgccggggtgggacgctcgagcacgagctcggcgagcaccagaccgatggagagcctcctcgcgagcgagccgctcgcgcgccgcaccgcctgaccccaggaagcatccatcgggttggctcgaatcgcgaccgcgagtccgagccgtaccaacgcctcttgcgtcggagccggcaacgagctcggcgggcgaagcgacgctgcgatctgggccggatgggcatgggccgcaccggtcgcgagcgcggcccaacgctcgagccacgtccccggctcgggaaccgacccgagcgtgtggacgagctcgagatcacgcggcacgagcgcgaggagacgcggcgagagctcgatgcccgcgtcggcgacggcagcctcgatctcggctgcgctcggaggatcgacctggacgcggacgcagcgcgacgccatcgccgtgagctcgggagggatggcgctcgccgcgagcaaccaccgcgtccgcggccccggctcctcgagcgccttgagcaccactggcgctaccgacgccatgcgttcgataccgacgaggccggcgatgcgccagcgatcggcactctggcgtgcgtgcgcaacgagggcacgaacgtcggcgatcgacggggtgtcactgaggatgcgcacgtcggggtggcgtccctcggcgaccgcactgcacaccgagcactccccacagccgccgcgcggacaggtgaggtactgggcggcgaccaccaccaggtcggcgaggccactcccccgcgcgcccaccagcagcacaccggctcgcgatgcatcgagcgcacgctcgatgcgctccgtggtgtgcggacgccagcgtcgaatgccctcagcgacgcgcgtcgtcatcgagcccgagctccgccatgatcatcgcctgcacccgagccgctaccgcgtctcgcgagccgttcgcgtcgacgagccgccatccccacgatcgcgcacgatcggcgtagcgcgcccggatctgctcccacgcggagcggccacccgcctcgaaccggtcgccggcgtcgaggccgagcggctcggcacgatcgaggacgaggacgagatcggcgaccggatcgccggtcaacgcctcgagggcccagatcgcatcctctcccaccttcgggccctggtagacgatggtcgaagggaagtagcgatcgaggatcacgtgcgtgcccgcctcgacggcggggcgcaccaccgttgcgacgagctgtgcacgggcggcagcgaacgtgagcagctcggcccatggtgcgagcgaccgcgtcttgaccacctcgcggagcgcctcggcagcggggtcgccacctggatctctcgccgtgaccacgtcgacaccgcgggcacgcacggccgcgaccgcgaggtggacctgcgtcgacttgccgaccttgtcgggtccgtcgaggaccacgagtttcccccgcgtcacgagccagatcccaagcgcgcacgccgctcggccaagagctccaccgccgtgtcgagatccaagctggccggatcgacgcctcgcggcaaggaggcgttcacctcgccgtcggagacgtaggggccgtagcgacccgaacggaccacgacgcgcgcgccggtgtccggatgggtgcccaactcgagcacgctggccgagcgaccgcgccgcttgggctcgcgaaagcgcgcgagcgcttcggtgagatcgatggtgaagagctgctcgggcttgtcgagcgagcgggtgtcgcgacccttggcgagatacggaccgaagcggccgttgtgcgcccagatctcctgctgggactcggggtcgaccccgaccaaccgcggcaaggacaagagcgcgaccgcgtcctcgtagctcagggtctcgacccgctgccctggcagcagcgatgcacgccgcagcgagcgatcgtcgccctcgccgagctgcacatagggaccgaaccggccggtacgcaggagcacgggttgcccgtcgagttcgccgagcacacgatcgccgagcctgccccgctcgagcagctcctcggcccgctcgagggtgagctcgtcgggagggaggtcctctgggatggaggcggtctcctcgcctgcctggaggaacggtccgtagcggccgacacgcaccacgaccggcgttccatccgcgcgctggccgatcgggatcgagttcacgtcgcgtgcgtcgatctcccccagtcgctcggtgacgagctgatggagaccgggggcaccgttgccccagtagaaatgcgcgaggtagggcgtgggctcctcctcgccgatcgcgatgcggtcgaggtcgtcctcgagacgcgccgtgaaggagtagtccaccagctcggcgaagtggcgctcgagcagctgcaccaccgcgaagccgagaaaggtcggaatcagcgcttgcgagcgtcgccatgcatacgagcgctcgacgagcgtgctgatgatctgcgcataggtcgacggccgtccgatgccacgctcctcgagcgcgcgcacgagcgatgcctccgtatagcgcgccggaggctgcgtctcgtgcccctggggctgggcacccgtcgtggtgagcgcgacaccagcggccagaggcggcaggtcgacctcgtcgtcctcgctgagttgctccgggtagaccgcgaggaaccctggatcggtgagcgtgcggccacgagcgacgaacgtcgcccgctcgatctcgcgaccgtcgatgcgaacctcgggcccgagcgcgacgtcgatcgtcgcgacggcggacatcccgcgggcgtcggtcatctgggaggccagcgtgcgacgccagatcagctcgtagaggcgcgcctcgtcgccgggagcctcccttgccacctcgtccggcgagcgccaacgggtacccgctgggcggatggcttcgtgggcctcctgcgcgttcttcacacgcgagcgatactgacgcggcgcgtcggggagtgctcccgggaagcgctcggcgatgagtcgacgggcttctgcgagcgcctctccggcaagctggacggagtcggttcgcatgtaggtgatgaagccctgctcataaagccgctgggccacggccatggtgcgctgcgcggagaagcgcagttttcgcgaggcctcctgctgcagcgtcgaggtcatgaacggcgcgtccggtcgtcgcgtgaacggccgctcggtgagctcgcgtaccacgccacctcgaccctcgaccgcttctgcgaccgcgagcgcgtgcgcgccgtcgaggaccacgacgcccgtggcgacgcgaccggtcgcgtcgaagtcgcggccggtggcgatacgcgcctcgtcgagggcgaccaggcgcgcggcgaagggcgcgggggcctcggcacgcgagaactcggcgacgacgtcgaagtagctcgctcgacgaaacgccatccgctcgcgctcgcgctcgacgaggagccgacaggccaccgactggacgcgaccggccgacagtcgcggcatcaccttcttccacagcaccggcgagacctcgtagccgaagagccggtcgagcacgcgccgtgtctcctgggcatcgacgaggccgcggtcgatcccccgtgtcgccccgacggcctcgcggatcgctcgctccgtgatctcgtggaacaccatgcgacgaacaggaacgcgaggggcgagcacctcgagcaggtgccaggcgatggattctccttcgcgatcctcatcggtcgcgaggaagagctcgctggcgtcggcgagcagggccttgaggcgcttgacctgctcgcgcttctccggagggatcacgtagagcggccggaacccgtgctcggtatcgacaccgagacgcgcccacggctccttcttcaccgcttgcgggatctccttcgccgagcgcggcagatctcgcacgtggccgacggacgcctcgacgacccactcgtcgccgaggtagcgccggatcgtccgagccttggtgggcgactccacgatcacgagtggctttggcacgaaccgatttgctcctcgctaggactcctggtgggccggctcgaggaactcgtagctcgggttcatcatcgcgagccgaccctggaactcccctaccgtacccgctgcgcggatcgtcgcaccggcggcgatccccggtacctggcgacggccggggaagacgaggaggataccaccggtggcgtcctcgagccgcgccacgctcatcggcatcccatcgagcgtgcgggtgcgcaccgccgcgatacgccccacgaccgtggcctggcgccgcggcgtgcaggccgagacaggcgtggtgccgtcggtgagctcgggcgccttcgtccccaacgtggtgcggcgggccttcgccgtgaccgtcgtacgggcactgcgcgtgcggactcgatagggtacgaggatggccgtggcgtgtggcagctccccgacgacttgggagatctgcaccgccgactggtcgtggagcagcgggccgaggatccgcccgtagacacggtgcgggatgatcgctgagacctcgacgtcgctgcctgatgcgaccgcatcgagcacgacctcggccgcgcctcgccgaaggcggcgatccgggcactcgacgagctcgagctcgaggttcgccaagcctgcctgctcccactcggctcggagcgtcgtcgcctcctgtgcatcgacgacgaggtgcacggcacgcagcgcgtcgggcaggagcagcttggcgtactggaccgcccgcgccgtggcgagatcgacgcgatcgacgaacagcaacaccacgtgcgtccgagcggccggagcctcacaggccgccgccaccccctcctccagggcggcggcctcgcgctcgaagcgacgacggaaccgcgtgaacatgaagaccagcagtgggacgacgacgacgaccagccaggcgcccgaggtgaacttcgtcacgatgaagacgatgtccacgatcgccgacaagatggccgacgatccgttgacgatcgcccgccggcgccagtggtcctccttgtggatgaggtggtagcgaaccatgccgctaccggcgatggtaaagccggtgaagacaccgatggcatagagggagatcaacgaattgatgttggagttcgttgcgacgaggagcacgatcgcgatcgccgcgacgatcacgatcgcggtcgagtagaccaaccggtggccacgctcacggaagcgccggggcaggaggccgtccgtcgccgcaaacgacgcgagcaacgggaatcccgtgaacgacgtgttcgcagccaaggtcaagatcgccgtcgtcgagatgtcgaggatcaccgtgaggacgtgaccgaccgaactttggccaaaggccgcctgcgccacctgcgagagcacggtcggcgctcccgagagatacggcacggcgtgggtcgtcgcagccaggccagacaccccgagaaagagcgtgccgaggatgacgctcatccagatcagcgtcacgcgagcgttgtgcacctggggatcgcgaaagaccgagaccccgttcgagatggcttccgtgccggtgagggctgtgccgccggaggcgaacgacttgagcacgatgaagacgctggcgccgacgagaaggccaccgcctggcttgccggccgggaacgcaccgggggcgatgatggcgtagtgatggatgtggccaaccagcgcgcgaaccgtgcccaccgcgatcatgagcagcatcgagccgatgaagaggaacgtcggcagcgcgaaggtgcgcccggcttcgcgcagcccacgcagattgccgaaggccatgccgatgacgaagacgacgccgatcggcgtgatgaaggggacgagcgccgggatggcggaggcgatcgcgtcgacaccggccgccacggagaccgcaacggtgagggtgtagtcgatgaagagcgatgcggccgcgatctgcgcgagccacaggccgaaggtctcgcgcgcgacgatgtaggcgcctcccgccttcgggaaggcccggatcacctcgagatacgaagccgccacgaagatcagcaccacgatgacgaggagcgacaccggcacgatgaggtggtaggcggcgatcccgaccgccgggaccaagacaccgaggctcgcctcggtggcataggccgacgaggacatgacgtcggacgagaggatcgcgagcgcggtcggtttgccgaggcgctccgaactcagctcctcgttgatcagtggtcgcccgagcagccagttcttcagccgatagctgagcttctcggggacctcgtagctctcgagggcagcgagcggtgtgggctgcgagggggtgaaggagcgcgcgaagcgctcggacggttcctcggacatggtcacttcctcaggcgacggttcgccgctagagcctaggtgacctgcgcccgcgggcagcttcgaaccacgagggctctggaccgcgagcctgctcggtcgcacgcgcccgcggactgtagacttcggccgagcggcctgggcgccgaacacagcgaggggttggggcagtggagtcggtgcacgtcatcgtcgtcgggtgcggtcgtgtgggtgcagagctcacccgtcgactgagcgctgaaggacactccgtcaccgtgatcgaccgcaacccagacgcctttcgacgcctcgggtcggcacgagcgacgaccatcgtcgggtcagggttcgatcgagacgttctcgaggccgccggcatcggcgaggctgctgccttggcagcggtcacgagcggtgacaactcgaacatcctggcggctcggatcgccagagacgtcttcgaggtgcccaacgtcgtcgcacgcatctacgacccccgtcgagcggtcgtctacgagcgcctcggcatccagaccgtcgcgaccgtgacctggacgacggatcaggccctcgcccgcctcttcccgctgcgcatcgagcgtccgtggatggactcatccggggagctcacggtggcggagatcacactgccccccagccggatcggcaaacccatcggcgcgctcgaacgagagggcgagctccgtgtggtcgccgtcgtccgacccggcggagcccgcctggccacggcagggctcatcggtcaagagggagaccgcatcgtcgtcgccgcgagccaacgcgccctggccgaactcggcgcctggtccaacgaagtggggagctagcaccatgcggatcgcgatcgtcggcggcggcaacgtcgggcgcttcctcgctgcggacctccagcaccaccacgacgtcgtcctgttcgaacgagatcacgagctggcggcacaccttgcttcccagcttcgctgcaccgtcgtcttcggagacggctgcgagctgtccacgctggcggacgcgggcgttggcacctgcgacgtcgtcgtggcctcgaccggcgacgacgaggacaacctcgtcgtctccctgctcgccaagcaggaatttgctgttccgcgggtcatcgcacgcgtgaaccacccgaagaaccattggctgttcaaccgatcctggggcgtcgacgtggccgtctcgaccccgcatctcatcagcgcgctcgtcgaagaagcggtcagcgtcggttcgctcgtccagctgctcgcgttcgacaactcgggcgcgcgcctcgtggaggtcacgctcacggcaacgtctccagcggtccaacggacgatcgcgaccctcgggctccctcgagacgcctcggtggtcgccgtggtgcggggagagaacgtgatcgtccctcggggtgaggtgaccctcaagcccgaggatcacgtgctctgcctcgtcgtcggcgagactgaggcggcggtgcgcagcgttctcatcggcgacgaggacacgatcgccgaggccgacgcggccacgccctgagctcgccctcggctcccctacggcaccggcgacaccggtaggctccacgtcatggaggcagcgttcttcgacctcgacaagacggtcatctctcgcgcctcgctgctggccttcggagctcgcttcttccaggagggcctgatcaatcgacgcaccgtcgcgcggagcgtctgggcacagctcgtctaccgctacctaggggcgaacgaacgtcggctgcgccggttggagcgttcggtcctcgacctcacgcagggatggcaccagagcgtggtgcgacgcgtcgtcgccgaggcgctcaccgagatcgtcacgccgctcgtctaccgcgaggcggtcgagctcatcaagctgcaccagctcgctgggcgcaaggtcttcctcgtctcggcctcgcccgaagagatcgtcgagccgatggcagccttccttggcgtcgatggccagatcgcgaccaagccgagggtcgacgaggagggcacctacacgggagagatggcgttctacaactacggcccctacaaggcagaggcgatggccgaggttgcgcaacgagagggcatcgatctcgctgcctcgtatgcctactccgactcctacaccgacctcccgatgctcgaggccgtcggccacccggtcgcggtgaatccagatcgggtgttggcacgcgtcgcgcgcgagcacggctgggagatcctcgagtttcgccaccacaccaaggtgggacgccaccgagtccttcgaaccgtcggtgcggtgggacttgggatcgccatcaccgcgataccggcgacacccttcctgcgccgagcgacgcggcgtcggcgaggagtcgagcctacggacctactcccgccacccctgaggcaatgaggccgtgcacgagacgcccaccactcatcggcctccacgaattcgtatcgtcgctgacaacccgggctcgacgagcgcgcgcgagctccaggccgtcgatgtgagcgcagtgtttccgcgcctccggagcagcgtcgctgcgcgatccctcggcgcggcatcgtgtttgccccacacacctgccgccaggtcgcaaccacgtcgagattgcgtcatgcgtgctctccccgacgctatccgaacccaccaccccgcgaccgctcgtccgacctcctgagtcgaattcctctgtcgccaccgcgagcatctccgtgctcgcaaggatcggccgttcacgaccgctcacgtcgctccctcagcgcgggtgcgaccacggatgacgaccatgagttgtacatgagagcggcaggcctcgctactagcatcgtcgcgcatgaaagccgaggagcgcgttcccccctcatcgctgcagaaggcgctggcgtggatcctcgagccacggcaattgctggcactgaatctcatcggctctctcgccgctttcgtcctcctcggcacctacgagtacttgagatggcgggacttcgacctcggcattgattatgccatccagaaccagggaacattcctcattgcgcatggacatcttgcccctcgtgacaccatctacggtggcggcttcgacaacaatgcgctgacctatctcttcatcgtcatcggccttgtacggacgctcgtaccgacaggcgtgatgctgctcgtactccaagctctcgctgtcgccgccacgtacctgttcatcatgcagatcgtcatccgagtgactcggagacttccactcggttggcgtggtgctgtcgtcatcggttccgccctgctcaccttcctcaatccctgggcgctcgaggctgtgtcctttgacgtgcatggggagcccttcggagcactcggactcgtcgtgctcctgtacggcatgctccgaagccagcgcacatacttctatgcaggcctcgcactcgcgctcctctcaggggccggcacgctgatcgtccttgctggtttgagcgtgggcttgctggcgacgaagtcgacccgccgatgggggatacgtacgacgatcggcgtggtgatcatcggcatcatcgcgctcctcaccggtgactccggctcctcattctcgtcgctttatggctatctcgcgtcctcttcaggcgccacacctggcgcgacggccatcctcagatcgatcgtcgagcaccccacgcgccccgtctcggtcctggtcagtcgctggcccgagatccgcgaactgatcggctacgcggggatcattggcttggcatggccgccgacgctcgtcgctgcggtggcagcggtcgtagcgaacggactgccacagaactcggcgttcctgtccctgacgcaggggttccagaattggcccgtcgaagcagtgctcgtcgccggtggggcgatcgtggtcagccgactggccggagcgcaccatgccaaccacgatgccctctcggagggcgatcgtgcgaacggccggtctcgatggcggctcctcggcggacgagccattgtggccctctggactgcggtgagcgtcgccatcggcatcggggccctcagcacagacctcgggatcccccgcagctggttcaaccaaccctacgcgagtgtctcggccctccgagtggcgcaacgctccatccctcgagacgccgaggtcgtcgccacgatcaatgcaatcgcgcgagtgtctgctcgcgctcagctctttcagcagatcgcccccactcaggcgcagccggtctgcgcagcggtcgtcgacgtcttgatcgaagtgccagggccctatgcggtgctgacgagccaagaggcgagccacgatgtgcgtaccctccttcgtgctccgggtcacacggtgctccaacaatcgggcgtggtgcttgtccagttcgggggtctgcatcccggtcgagaggcgctgatcgtcccgacggggcaggtggtcaccggaccgcaagcggcgagcctcgacgcgtcacagtgtcagtaggtcggccttccgacccatggagcgtccgactccggcaggagcaactccagccgtttggttcgccgcgactctcgccagcgaccgcaccggcgtcccccatctgctcgacggcaccaacgcgcagcgatccatacgcggtgcaggcacgagggggctcggcgttgccggacgactgctgagcgtgggccgctagggccacgtacggcacgcgatcccagcggcactcgatcccagcgaccttgccatcagtgtccgtcgcgtgctcgattgaccctcgcaggatgtcaacgccgccggcgcgaggcgtcgctcgacctgcgccggcgggttccgtcaaccctgcctcgagccctcaccgagtgaccatcgttcgcgtgcaatcgtcgacgcgcatgcaggttcgaaggggcacccaaggcgcgatacgcgctccggtgtcggggatcgagcctcctgacgcggctcgttggcccaggtctgtctccagagcaagcgtggctcgaccaaggcgctccctgctgatgcagcgacccgtctgttccaacgcactcacgccaactgcagtgcctggctcgattggatcgagggcatccgtgcccgggctccgcagggcatctcagcaggcacctcgcgacctgcgtcagcttgcagtcgatcgagaacgagcgaagccaccggacctccagccagcagcgactgcgtccgcacggctgatcacctctcggtattgctgtggcgtgcggccacggtcgcacacgggcccgaggcgcgaatcatcggcgacgacaacctcgagggagctcgcgctcgtgtcgggaggggctctcccagaccccgacgctcgcctcgcgcgaactcccgagggttgctgaaggacgagctcgccgcccgcgcaaggagtccgagggctgctggctccacgaacacgctccaccaccagtcaacaccaagcgccagctgtcacgcgcgccagcttcagctggacactgtcctgctcgaggtcataggaacgccgcgcgtcgccgcgcactcggtcggccgtggcggaccgcgccagcgggagccgatggtcccgccacaaggccgccggtcaccctcgcgacggtctcgcctcgtgccacgggcttcactaggtcaccgacgggcaggcagatctcctcaggcctgcgacgaccatgcgttgacgtagcgtcagccctcatcaccgttgggtcgcgtcagccccggggtaccgaccggagcgaccccgttgaggagaggcgaggggttcggtgacgccgacgacggacgagagtcgagatcaggcccgtcagcgaggcgccaggacgatcacggcgactcctgccgcgacgatcgctgcggcgacgactcgcgagcgaccgcgagcctcacccatgatcgcaccggccagcgcggcgatgaccacgctggtctcgcgcagtgccgacaccaccgcgagtggagcgcgctgctgcgcccacagcaccgcggcgtaggtggcgtaggagagcacaccagcagctgcccccaggccgagggagcggacctcgggccgagtatgcgcacgtcgcgctgcgagggccgacacggatgcgaccacgctcccttcgagcgcaaagagcagaccggcgtaggcgaagggatcggggctgtggcgcacgccgagtccgtcggtcagcgaatagccagcgatcgtgacgccggtcgcgagcgcgagcagcactgcccgcagaccatggtcgcgctgcggcctcgcaaggagcgcgatcccaccggcgaccacgaccacgcccgccagctcgaaggtggtcagtggctcgtggccgatggcgagggcgccgatggcgaccagcaacggcgcgctgccgcgcgcgagcggatacacctgcccgagctcgccagcggccaacgaggacccgagcaagaggttgtaggcgacgtgaatggccgaggagccaaccgcgaaggcgatcgccgccgctggtggtgggccgacgaccacgagcgaggcgatcccgatcgcggcaaccacggcgttgatggtcgcgacggcatcacgaggtgacggtgcaagcttggccagtgcgttccaggcggcgtgcccaacagcggccccgagcaccaccgcgataacgacgagcatcacaccagccacacggatacgtgcacatgcaaccagtttgccgctacactgagggcgtgaccatgccaacgctgtatctgggacatggagccccaccgctcctcgatgacgcgcgctgggttgccgagctgcgcgagctggcgagccgcatcgatcgtccgcagagcattctcgtggtctcggcccactgggaagctcgaccagtcgcgctgtcgtcggtcgtgggcgccccactcgtgtacgacttctgggggtttccggagcgctactaccgcctcacctatccggcaccggggtcgccagacctggctgcactggtcgaggggcacctcggggctgcgggccactccgtggctcgcgacgaaggtcgaggcctcgatcacggggcatgggtcccgctgctcgccatgtacccggaggccgatatcccggtgctgcagctgtccctcccgagtctcgatccagaggaactctacgccgtcggacaggccctcgcgccgctgcgcgacgctggggtcctcctcatcggcagcggcttcttcacgcacaacctccgtgcgctcggacaggttgggcaccctgacggccccccgcccgcctggtccgtagagttcgacgcctggggcgccgaagcgctcgccgacggcgagatcgatgccttgctcgacttcgaacatcgagcgccggctgctcggctcgcccaccctcgcaccgaacacttcgctccgctgttcgtgaccctcggcgcgggcgaagggacgcccgtcgataccgccatcaccgggttctggttcggcctctcgaagcgcacgatcgtccttgcggaggcaccgatcggcgaggtgacacagcacgtctgagcccacgcgcctcgcgtcgagccccgcgcaacgagcaacctccgccagcaagcccgctcgaaacctcgtgtccaacgggacgtcaccagctggctgatggacctctaaggtacctgtgtgcccggcggattcgtcgctgccctcggtctcgctgcgctcgccgcgagcgcacccacctggatcggctcgatcccagtgggtcgtggcgcggcactgccaccagaaggcatcccgtcaccggtccagccgctcggaggcatgctcgcccatgctcccgcgtgccggtggcgcatcgccgccggagagcaaggcgccacgacagccctcaatgcgctgatcgcacgcgtcgagaaccgactgacccggcctgcagcactctgtgtgtcagggacgttccgccagccgatcgtcgtcgagggcaagtggcgtccggctgcgctctggatcgaacctgcgcccggcaccacagcactggtggcgccgggccgtcttcgcgccgccgacgttgcccacggcgttcccgacggcacggtagcggcggtctcgatcgtcggctcgacgggcgtcgtggtgcgagggctcgtgatcgaccacgtcaccgccgcgagcggcgtgacgccagccggcatcgcggtggaggtcgcaggacccaaggagggggtccgagtctccggctgcctcgagcgggggagccgacgatgcggcgacgttgcgctcgtcgacgacaccgtctcgggagtccgtgcacccggtgacgtctggcccccgacgctggccgcgtgtggctccggatccgtcgatgcctacggcatcgaagtcttcgacgcggcgacgacaccgcgggccgccctgaccaacgtggtcctcgccggcgatcgcgtcgccgacgcgcgcctcggacagagcgaggccatcgcgatctccggtgacgtcgccgacgcactcgtcgagcacacgagcgtcctcggcgtcgacaacatcggcatcgacgtcgagggctactacggcacgacggcccaccccaacgacgtcgcgctcgtcgacgacaccgtcgcagcggtcgactcgtggacgaacgcgggctacggcgttcgcgctcatggccgatgcctccccacgccaccggcggcggccgggatctacgacgacggtgcgacctcgctcgtgatcgcccacgaccgcgtactcgacaccaaccaaggcgtcagcctcgacacggagacgaaggatcacgcgaccagcaggatcgtcgttgccgacacgacggtggtggacgctccgtcgctcgcgctgcccgccggaacgacatccgcagctgaaggggccgacgtggccgggtccatcagcgacgccggtcgggccttcgatgccttctacgtggacgccttcggaccgcggacctcgatcgaggacgtcgtcgccagccacgacacgttcgtcaatctcagcacgttctggatgcgtcgcctcacgagccaggccgcggtcatcgtccttgggggtcgctatcggtcgatcgagcttcgatcgcttcgcgcacgatcaggaactggcccggcggcacccataccgctccagttcgatcgcctgccgatcgagtggtcggggatgcggctctgcgacctcgcgttcacgggtggtcctgccggtaccacggtggagacgccgacgaccgcggcgacgtcgatcgccggagccttcaaggggctccctgtccccatccgatccgcgataacgtgcggcggccaagcgcgcccgtgacgtggcgctcgaggcgcgcgtcaaggcaccgagtgcctcaacgagcaggtgcgacgaccctgagcaccggccctccgtcgcacgcgtcgcacacgccaaggccgcggcccagcggctagtgaatcagcgcgacgatgtcctgcacgactaggtacgtcacgagcgcgatcacggcgaggtagatcgccgtcatcgaccagcgccaacggtgacgcgcgacgtggaagcgccgaatcccccgaacgtcgaagatcaacgccagcaccccgaccgggatcccgatctcggggccgaaccccgccaccgcgccgaggcccagtgcgggcagcacgaaggggatgatgacgtagctcaacgtgcaacggagcccagacaggatcatcgcgaccgaaaagagacgctcagcggcctcctcgcggtccgatgtcgacgtcggctccgggatccgcagcagccggcgcaccactcggtccgcgcgactgtcgctccgcgccccgaccggacacgccgtggcccgaagcgccgcgtgatcaaccgggcacgcacgctgctcggccgacgagagagccccccgagccgaggcggtgtcgatcgccggctctcgagcagtatccatgctcccagtgtacgcgagccgcgcacgtcaccagaaaccggcctcgtcgggctctcagggatcgaccaccgaaccgaggtcgtcgatgccccgatagcccggcagcgctgcgagttcgcgatgcagttcgtcgctcgcaagggcggcatcgagcgctcgacgcacctcctcatcgctcggtgccacctcgcggctcacggcgaggaagaagcgctcgtctgcgagcggcgcaaagtagagtccgaactcccgcgccgcgggctcgaggacgacgcccgtggtcgcgactccggtcgcgaccgcttcggccaccatgaggtgagaatcgacctcggtgtcccaaccagggacgcgctcgggcacgatgccctcggatgcaagccagtcagcgaggagggcgcgcgcctcagaaccaggctggcggttcgcgagccgtccctgcacgagttcgaggggacgagtcgcgtctcgagcgcgcgacaccagcccctcgcgccaggccgcaaacgatcgcacctcgataccgggcggcaggggcggcaaggagacccgacccgatggatcggtcgccacgtggaagcccgctgcgtgcacgagaccgtccgcgagcgctcgcagcgcggcttcggagggcgccggccaccagacgagctcgaccggccgagggcggtgcgcgagaggacctgcgagcagcaacagcgccggatcgcaccccgcaaccacgaccgcaggcgcagggcgcctcgtcaccgtggcccgacgagggccgagcagccgagctccagcgggatgaaatcccggcacgatgccgtgctcacccccgcgcggaaccccgacgagtcgatcggcgacccgcgcgacctcgatccgctctccgaccgcggctgggccgacgagctcgatcgcctcctcgcgcccagcaccgctcgtgtcgaagagttcctccacgctcacgccgaagaagcgtgcgagcgccatcgccaccgggagcgacggttcgaaggctcctgactcgattcccgcgaccgcctggcgggagatgccgagtgcgtcggccacctgctgctgcgaaagcccccgcacgcgacgcagccgccgtgcgatctcgctcacgtccggaccttctgatcgaagaccaccgcgtccgtaagtgccacccatccctgcccgagcggccggtcccatgacgtctcggcgcgcagcgaccccacgccgtcgaccgaaacgagctgctcgaggcgtcctcccaccacccgcgcaggctcgaggacccgcgctggggccccgatcggaccatcaggaccgtcggcgaggtgcagtgctgacggccaggcccacgcctcgccccaccgacccacgaacggccccaccataccgagtaagcgcgcgacacgagcgctcgcaggctgtcgctgcacctgggaggcgggcccgatctggagctgcgccccgtcgtcgagcaccagcagcgtgtcggcaacgcgcgcgatgctcgcgaggtcgtgatcgacgacgacgaccgcacaacgcgtcgcactgtcgcggatcgcctcggcaacgtcgtcgacgagctcgtggtcgagaccggccatgggctcgtcgaagaccagcacgctcggacgcgcggcgagcgcacgcgcgatggcgacccgacgagcctgcccaccggagagggtgccgaccgagcgatctcgaagggtggcgaggccaaagtatcggagcaactcctcgacgtcctcagccgacgcacgacgagagaaggccacgttcccgaccacgtcgaggtgtcgaaacagcgcggtgcgctgggggacgaggccgaccccacgccgctcgagcgcgacgcgcacacccggactcgacacgatcgtctcgccgacacgaatccacccttcggcaagaccgacgagcccggcgatcgcgtcgaggagggtcgtcttccccgcgcccgagggtccgaccaccccgagcaccgacccctgagggacctcgaaacgacagcgcagcgtgaacgagccccgtcggacagtgcagtcagcggcgagcatgtcgccctcgagcgtacgcgaggagcgggaacggcaacgccacgacgagcaggaccacggcgtagggcaacgcggtggggagcccagtctcgttgagtgtggtccagatctgcatgggcaggccgtaggggtgatacgccacgatgatgaccgccccgaacgcaccgatggctcgcgcccaggcgatcgagagggcagtcgcgagctcgcccgcgacctcgggcaccatcgcgcgccagaaggcgcgccacggcgaatcgccgaggagccgggcttgcacgacgacgtcgtggtcggcggccgcgaacgctgcagctgcagcaagcacgaagtacggggcagcctcgtagacctcggcgatgacgagcgcagtgaacgtgttcgtggcatcgagccccactcgcgcgagcagccccccgatcggggtcagcggacccaccatgaacacgaggagcaggccgatgacgagcggcggcatcaagagcacgaccagcaaactcgcctcgaggatacgagcgacggcgccaccgcgctcggcgatgacgagcgcgaccggcgtgcccaccgccacgacgatgacgagcgcgaccgcagaggccaaaagtgacgtcccagccggaccgagggcgtccggtgcactgagggcgaccaccagcgcgtgcgggcccaggtgccacagcagcgtcaggagtggcccgagcagcaccacccatgcgacgagccccccggcgaccgccagggcgctctgggcgatccgaagcggctctctagccgtcggcgcgcgcgacagcggtgcgaacgacatgcggaacaccggtccccgtcacggtgggccgcagcagggtgtagccacccgccgcgagcgcctccctcccagcaccatcgatcacgtagtcgacgaaggccatcgccgcgccctggtcgtggcgcccgagagtcgtcaccgcgagcgtgagcgcgtgaccgtggacgacactgccatcgggaagggtgagcgaggccgtcgcgtacgttgccgcgtccgccggatcaccgaagtcgatggcggcagggagcgcaatgtagggcaggtggagctggatcgcctgggagcggaaggcgctcgctgcatcgagctgaccgctctcgagccgagcctcgagcgacgtctccgaatacacctgcgacgggttctcgaggctaccgagcacggcgctcgtcgtggaagccggaaggtggtaccggacggtggcgagttcgaccatctcgtagaacgcttgtccctgggggtcggtggccgggttcgtccgtccgagcaggaagccaggcgttcgcagcagactgaacagctcagtgaagggagctcggcccgctgcgatcgcagccagacgaggagcaaacgacgtgtgggggttgtacgcgaggacgatcggactggaggccaccgtcacgtaccaacgagtgaagcgcggctcgagttcggcgatgggcgccccgccgatcgactcgaacacgttcgggctgatctcgccggcgatgatgtcatgggcaagaccgaaggatcctccgccgcgtccttcgtagacgtcaccggtcgctcgggcgaagtctggcccaatgacgtgctcgttgaggtactcgagcgagccggcgtaggcaacgctcgcggtttcgtgcgtgtgcgaggcactcgcgtgctgcgtcgagccacaggccccgagggcgacggcggcgagcgccatcacagtggcctgggcggttcgcgtcgttcgcatgccatcaaagctagcacaacgccagtcttactggcaacgcgcgtcacgcccgcgccgtccgcgacgctcggcgcgtagactcccgccgtgcaccccgcaagcgagcgacgacgcatgatgggcgagaccatcttcgcgaccatgtcgcgcctcgctaccgagcacaacgccatcaacctcgggcagggcttccccgatacgcccggccccgcactcgcgatcgaggccggcgtacggagcctccgcgcgggccacaaccagtacgcaccagccggaggcgtgccagagctccgcacgcgggtggcctcgatctggagccagcggctcgggcgaccgatcgacccgctgcgcgacgtcacgatcacggtgggcgcgaccgaagcgatcgctgccgcctgcctcgcctggctcgagccaggcgatgaggccatcgtgctggagcctgcctacgacgcctacctctgggccgtacgcatggcgggagctacgccggtcggggtcgatctcgggtccacgatgcgcctcgacgcggagcggctcgaacaggccatcacgccgaggacccgcatgctcatcgtcaactcgccgcacaacccgagcggtatggtcgtctccgacgaggaactcgcggcgatcagcgccgttgcgacccgacacgacctgcgcgtcctctccgacgaggtctatgagttcctggtctacgaaggcagccaccgctcgatcgcgaccttcgacgcgatggccgatcgcaccgtcgtcgtctcctcggcagcaaagaccttcggcctgacggggtggaaggtcgggtgggcgatcgggcctgccgacctggtgagcgaggtgcgatcgcaggcgcagtatctgacctatgccggcgccaccccactgcagcacgccgtggcggacgcgctcggcaatctcgatctcatcgtccccctggtgcgcgatccactcgcccggcaacgcgacgtgctcgtcgacggcctcgccaagctcggcttcacgccactcgcgacccaagcgggctacttcgtgctcaccgacctcggccccgtcgaggccgagaccgccaccgaagccgccctcatcctcgccgagcgtgccggcatcgtcaccattcccatcgagcccttctacgtcgagccggagcgagcgccactcgtgctccgctggagcttcgcacgccaggcgacgacgctgcgtgacgcactggcccagttgcgtcgagccgccgaccggggtctgctcgcacccaagacgcgctaagggagcacgcgacgcccgatcgagcgcgaggctcggccctcgtggtcgagccggctagcgctcggcgtcgcgtcggaccacggcgaccagcgacggggcgacgtggccatgatcggcacggtctcgaacgacctcgagcagttcgatcgaccgctccggaaactgcgagcggatctcgtcctcgctgaggagccgatccggatccggaggaccagcgatgccgaccccgtcgacgtggtggccgatgatgacgagccgccctccggggctggcgaggccgaaggcgagcgcgtgcagtcggcgtcgctcctcggcaggcggatggatgttcgcgagcagcacgaggtcgaactggaggccgagctgggcaaactcctcgatggtggcgtgttggatcgtgacagccagaccttgctcctcggcagcgcgggcaaggcgctcgagcgcgacgtcagccacgtccaccgcggtcgtctcgatcccacgagacgcgagccacagcgcgttgcgcccttcgcctgcgccgagatccactgccgatcgaggctgcactcgttcgacgatgcccacgatcgcaggatccggctcgccgatccagagtcgatcattctctcggtagcgagcgttccagacctgccgcatcgcttcgtccacggcgcctccttcgtccgagccccgggtcgaggctaccgctccctcgctccgagcacgtgtcgcccccatgacctaccatgagcccgtgctcatcatccacacctccgactggcagatcggcatgccagctcggaccatgaccgaggaggctcgccaccgcttccgccacgatcgtgtcgacgccgccgagcgtctcctcgccgaggcgagctcgcgtggcgcgtgttgcgtcatcgtggcgggcgacctcttcgacgacaacacgctgtcggaggaccagatccaacgcacgctcggcgtgatcgcgcgccagcagctccctatcgttgccctccctgggaaccatgacgccctcgagccgcacgccatcctcgcccgcgacgatctccccgaccagctgatcgtgctcgactcttgggagccgcgcaccgtcgttccaggactcgaggtggtcggcgccccgtggcgctcgcgcatcccggggcgcaaccccgcctgggacacggtccgcgccctcgagtcctacggtccgccacccgccgggacggttcgggtcctcgtcgcgcacggtcagtgggagcgctacgacagcgtgaccacccattcgacgctccccgccgatgagatcgtggccgccctcgacacggggctcatccactacgtcgccctcggcgatcatcactcctaccagatcttcgtcggtggacgcgtcgccttcagcggaacccatgaggtcaccgccgcagatgagcgcgacccaggctgggcacttgcggtgaccctggagccgtcgcacccgccagcgatcgagcgaatccgcgtggggagatggcgcatcctcacgctcgcggagacggtcaccagcgccgacgacgtcgcggcgatcgccggtcggcttcgcacgctggaggatccggcacgctgcgtcgtccgcctccacctcgacggcacgctccctctcgcggcccgtctcaccctggagcagaacctcgaggcagccgctgccgccctggccggcttcgagctcgacgtcgagcgggtcgcgagcctgtcggatgccagcatcccggccgactttcaccttcgaggggccgccgccacggccttcgaacgcctcctcgacgaccccgaccccgtctcacaggcagcgctgcggctgctcgcgcgactcgccctcgaggggaacgaacgatgatgcgtctcgtccgcctccgtatcggcgaggcccgccacctccggggcctcgagctcacgttgcgaagtccggggctcaccatcatccacggccccaacgaggcggggaagtcgaccatcgtcgcgtgcctgcggctgctgctcgcgaccccctccacgtcacgtcaccgcgaggtgcaagcgctggccggcccgtctggcggggtcgaggttggtgccgtctttgcgctcgacgacaccacggtcgagctcacgaagcgctggctcacccgacctctcacacagctcgtcatcgccggcgcaggacagctcgatggacgagaagccgagacgcgcttcgccgaattgctgacgactgcgggacttggcgagggtgctggcgatccgctcgtgagcaccctcatcgacaacggagcgggaactacgcacctcgccgcgagcaggatcgtggccgaagccctggagcgacgaagtggcgaggaggccttggtcgatcccgggctgcttgcccgggctcgcaccgagcttgcccgctacgagacgcccggacgctcccagccaaccggggacctccgccaagcccgcgacgaactcgaccgcaccgaggccgcctacctggttgccaccgcagacgtcaacgccgtggctgaggcgcgccgggacctcgagacgatcgccgagcagctggcgacactccccgacgacgaggctcgcctcaaggccgaacaggacgaacgtctccgacgccgcgcggagctcgagggcctcgacgtcgaggtcgagcgatcgtcgcgccgagtcgccgacctctccgatgcgatcgcgcgagagctcgaggccctcgaacgtcagcgtgaactcgcgagcgcgctcgcacgctcgcgagaacgcatcgaacagctcgatcgcgacctcgaggagcggcgcgagcagctcacgcgggtgcaggcgcaactcggtgcttcgcacgacggcctcgaccaagctcgacgtgagctcggtgagctccgcgagacccaggcgcgcgccagggagcgcgaagcgctggccagcgtcgctgcaggcgccgaacgtctgagcgcccaggttgcgagagcagtggagctccgcaatcgcgtcgccgccctcgagatcgctccaccgcgcaggctcgatgacgcactggtggcgagcctccaggaggccgaggccaggctcttggccacgcgaaccgtcttcgagaccgtcggacccagcctcaccatcaggagcgagcggtcggtcgaggtcgtcgtgaacggggacctccaacggctcgagccggcccacgcgatggtgcgaccgatcgacgagcgtatcatcgtgtcgctcggggacgtcaccatggagatctcgcccggctcggcggtcagcgaactcgaggagctcgccgccgaacgcacccgactcctcgcaagtctcggtgtcgcgagcctcgacgaggcgcgcgccctcctcgagaaggctgcccagtacgaccacgaactggaccagctgcgacgcgagctcgcgaacctcgctcccgacggcatcgagcccctcgacgacgaggcgactcgcgcccgtgctgcagcctcgagactcgacgacgcccccgagctcgcacccagcgacgagctcgagcgacgagtcagggccctgagcgatcacgtcgaggcgctcgaggccgctgcggaggaggcacaagtcgccgaacgccggtaccacgaggacctcgaacagctcgtcggcgcacgcgagcgtgaggccctgcaactcgaacaagcagagcgcgaccttgccgcagagccagccgagagcgatcgcgtcgcgcgcatcgaggacctcgagcgcgaactcgagacggagcgccatcggcaccgcgaactcaccgacgccatcgagacccggaaccatctcgacgaggagctggaagtcctcgccaccgagcttgggggcctctcgaaccgaagagccgagctcaccacccaacgacgcctcctcgaggagcgcctcgagcgcgccacaggactcgccgaccgcgtcgtcaacctcgaggagcgcctcgaagggcttcgtcgacgagtcgccgtgctcgagggccagcgcgcggccgcacgacggcttgtcgaggtcttggaggaagaacagcggcgtgcgcgggagcgaaccgaagctccgtatcgacagctcgtggaacgcatcctcaccgccacgctcggcgagcgcgtggaggtgatcctcgacgaacacctcggcgtcgagagtctgcgacggccgacgagctcgcggacggcgcttgcgacgacgccgatcgccgcgctgtcggcaggaacccgcgagcaagtggagctcgcctgtcggttcgcagcgacccagctcactggcgccgtgcccatcgtgctcgacgacgcgctcggctactcggataccacgaggacgcgcatgctcgtcgcacagctcaccgcactcgcgaccgacgcccaagccatcgtcctcacggcccaccccgaacgctacctcggtgcgagcgatgcggaacgcatcgatctcgcgcgtagcaccgagtcctcttcggacaccgcgcgtggcacgtcgccacctccgaccggagcggcctcagaggcgtcgctcgaggacgcggtgcgctcagttctcggcgacgccggtggaccgctcaaccggaacgacatcgcatcccggctggatgcagacccagatgccgtcgcacgggccatccggacgctccgcgatgccggtgtgatcgagcagatcggacaacggcgaggggcccgttaccgcttgtgcgagcgtgatcggacagacccgcacgccacctgatcctcgcaacgtggagccgcgccggagcgcgaacacgccaatggccctgatcgcatcggcggagctgcaacctcgcccacggtggctgaagcgctccagcgacccagcgcgaggtgagcgcgcttggcatgccaatgctgaagccggcgaggatctctccatgagcgaggcacgacgaccgctcctctccggatgacatgaagagaacggtgcccatcccgcctcgcgcgagcgccgtcgccaagggccgctgcccgtcgctgcggtggcgccagcgagccgaacgcgaacagcatgagtgcacgggagagcccaaagggagccgatcatcagcccggacacgcttctcctgcgagccaccagcctgctggtccgcgccatgcaacctcggcgacacagcccgcaagccgtcggccaacagcgccacgcccacgctcgggcgaatgacgaagcagtgcacggcaacgactcgaggacaggctccgcacgggcactcacgactccagatctactgggtcgccaccagcgagcttggttgagggctgcggggcggggggctcctcgtgtcctcacgacccgcctgcccctacgactcgagcgcctcccgaatggtgttcgtggcctcgcgtgctcggttctcggccgccacggtgaggtccgcgtggcgataccagacctcgttcgcaccctcgcgccaggtcaccgtcggggtctcgaggagctcggggtcgacgttggcggcgttcgcctggacgaagtccacgagggagtcgatgagggtgtcggcgaggtagtggggttgcagaccgaggtcgagcagggccgagtgacgggcgttgtagtagtgctcttccttctcgatgcgtgggttgtcgaggtggacgatggtgggctcgaggcctcggcgtcccaggacgcctgccacggtctcggcgagctcgttcagggtgaactgctcggtgaactggttgaagacacggaactcaccaggggcggccgggtgctcgagggccagggtgatgcaggccatggtgtcgcggatgtcgaggtagccacgggtctggccgccacggccgtagacggtgatggggtagccgagggacccttggatcacgaagcggttgagggcggtgccccagaccgagtcgtagtcgaagcgggtcgcaaggcgcgggtcgagcaccgtctcgtcggtggcgacgccgtagacgacgccctggttcaagtcggtggcgcggaagttccacacccgcgtcgtgaagtggatgttgtaggagtcggccaccttggagaggtggtagaagctgtgcggcagcttcgggtagggcaaggtgtcgctgcggccgttgtgggtgatggtgaggtaaccctcttcgatgtcgatgttcggggttccgtactcacccatggaaccgagcttgacgaggtggatctcggggttgacctcgcgcatggcaaagaggatgttgaggttgcccacgatgttgttgacctgagtgcgcaccgcgtggtcgcgcgagatcatcgagtagggggcgctgcgctgctcgccgaagtgcacgagggcctctgggtcgtgggcgcgcatggtctcgaggacgaagtcgtagtcgcagatgtcgccttcggcgatgcggatgggggcacccttgccgagggcgttccaggtctcgacgcgctcggtgaacgaggcgatctcgttcaggggacgggtaccgccttctgcgtcccaacggcgacgggcaccgttgtcgatggcgagcacgtcgtgaccttgggccgcgaggtgcagcgccatcggccacccgatgtagccgtccgcgccgtagacgatgatgcgcatggtggtggtcctcccttgagcgatcgtcattcgttcgtgtccaaggcccgaacgaatgcggaacatcagtttacgaagccaacgaggccgaggcgccgcgtagatgtgagcggttgatcagggccgcttcctcgtgcgaccgagtcgcacgaggaagcgtgtgagtgtcgacggtgttggtacgccatcatgacttctctcccacatggtgcacttgcgcttcttggatccggcgagctcgctccgtcgatggtcgcggtccatcgccagctcctcgccgagctcgacccaccacggccggtcttcctcgatgcaaccttcggcttccaggagaacgccgacgaactcgtcgccaaggcccaggagtacttcgacgtaagcctgcatctcccactcgaggtcgcgagcgcgcgtcgtgcgagcgcgctgagcgcactcgaacgcgggcggttcctcgagaccctcgcctggggcaactacctcttcgccggacctggcagtccgagctacggcttggctcagcttcgcaccgcgggtgcaggacccgtgctgcgtgagcggcttgtcgacggtgccaccgtcgtgctggcatcggcggccgcactcaccgcaggtcgctacacaatccccgtctacgagatctacaaggtcggcgaggatcctcgatggctcgacggtctcgacctcctcgatgccttcggcgtgacggcagcggtcgtccctcactacgacaacaaggagggggcgacccacgacacgcggttctgctacatcggcgaacgtcgccttcgtctgctcgaggaccagctccccccgggcgtcggcatcctcggcatcgacgagcacaccgctgtcgtcctcgatggctctggcaaagtgcgggtgctcgggaagggacgcctcgtgcttcgcgtgcgcggcaacgagcatgcgatcgcggccccggcaacgctggcgctcgacgaactgcgcgaccggctcggcgccacagatcacccacggccaggtgacaccgcctcggcatcggcggctggcgaccttgcggcactcgacgaggccatcgaccgaggcgagatcaccgacgcccttggccagatcgcagcactcgtcggcgtcgacgacgaccgcgtcgtcaccgggctcgcccggctcgcccgacgcctcaccgacgggctcgtcgaccgcgaagcggccatcgccccggttgtcgaagcgatcatcgcacgacgcgaagcggcgcgagctgcgcgcgacttcgcgctcggcgaccacctccgcgacgcactggccgccggaggtgtcatcgtggaggacacgccagagggtactcggtggcggctcgcagaggtcgtacactgatatagcgacaggcgtgcccccatcgtctagcggccaaggacgccgccctttcaaggcggtagcacgggttcgaatcccgttgggggtgccagttcgcgttccgagccgagacgaggggtgacgcaggcgatcgagcgagccgacaatgcggtgcaacagcagcacgtcccacgtaggtcgaatcgataggttccatcgaggcgatggtggcacgagtccacacggctccgccgacctcaccgcagccgcatacgacaggcccaacgtcgatcggagcagcagccagcacaaacagcttcggcctgccgtcatgcgcacctcgccgccaccctgtcgcagcgagacccagtcgatatcgatccaacgtcgtgtgcatggccaccgtgcattgcgctcggtcacggcttgcagggccaacctcgaagagcccccgcgagcgagcagatcgacggctcgatcagtcacacgagctggagcgaggaatcggcgggctcgcaccacgatcgcaggccgcggtgcacctgccacgccgagagccgcagatcacaacccgatcgccttggaacagaccacgcggcgccgaccacgcgcgtgcgccctcgccgcccgcgatggagcgtgcctcggcgaacgagcgctacagtgaccgcggcacggcatcgtgcgcgccgagttccgtcgcagaggactgggcgcccatgagtgcgaatcgcacgatgaacgaggtagtcgtgacgggatccctgacgaacgacacgcgcagtgatgatgctgtgttcaccccacgtccgtgtgaacacgcacgatgatcgatctccacctccactccaccgcctccgatggctcgaacgaccctgcggaactcgccgggatcgtcgccggtgccgagatcgtcgccctcaccgatcacgacaccgtcgagggcatcgccgcgtttcgcgaggcgctctctggcacgagcgccttcatcgtcggggcggagctctccctcgcgacgaccacgggctcgttgcacctgctgtgctacgggactggactcctcgggcccgctggcacgtcgctcctcggcacgctcgccgacgatcgcacccgtcgcaacgagcagctcctcgcacgtgccgcagcgaacggactcgacgttcctctcgaagcggtgctggctgctgcgggagcgacccggctcgacgagaagagcgtcgggcgcccgcacgtcgcagcggtactcgtcgaacgcggctacgcccgcgacatccctgatgcgttcgatcgctacctcgccaagggtcgccctctgtacgtgccgaaggcacgccttcgcttcgccgacgtgatcgagccgctcgctgcgatcggtgtggcgacggtcgtcgcccacccgctcagcctcgagctcgcgcccgatgcactcgaggaccacctgcgcacgctccgtgacctgggtctcgtcgggctcgaggcgcactacgccgcctacgcgccctcgacccgcaccgccttggccgagctcgccgaccgcctccacctcgtcgcgaccggcggctcggacgcccatggacgcttcaaggccggcctgtccccgctggtgggctacggcgacctcgatgtcccggtcgtaagtggcgaggcactcatcgacgccatcgcgcgcctcggcggccatgccgacctatactgatgacgcccagggcccgagggcccttcgccccaccggggacctgtggtgcagctcggagtgcacgccggcctgtcaagccggaggtcgcgggttcaaatcccgtcaggtccgctgagcacgtctcgcacgtgcatcgggtcggatagctcagttggtagagcgcacgcctgaaaagcgtgaggtcaccggatcgaaaccggttccgaccaccatcgtcagagcgtgcgacgaccccttcgtcgctgcctcgatctcccgctcgacgagtgagcgctcgagcgaaacgtgcggtctcgcggccccagcaacgctcgctcaccgccaagctcgctcactgccaacgtgtcaggtcgcggacacgacggccaccaggtcgcccgcttcgatcgtgcacgatccccgacacctccgcgcgcgcaggctaggctcggggtctgcgatggatgaccaccccacccacggctccgagcaaggctccgaagccgaccacccagaggaagcctgtggcgtcttcggtgtgctcgtcgcgtccgaggacgagcaagcctcgttcgccgtattcgacggcctctatgcgctgcagcaccgtggacaagagtcagcaggcatcgccgccgtcgacgacggtcgtatcacggtcgtgaaggacctcgggctcgtggcgtcggtcttcgacgaggcgaccctgcgtgcgctgcgcggtcggctcgcgatcgggcatacgcgctacgccacggctggcgaccgaggatgggagaacgcccagccgctcctccacgaccacgccggcgcccagatcgccgtcgcccacaacggcaacctcaccgacccgcctcagacgccagcccccaacggccggatcccttcggacaccgaacggatcgccgcggccgtcgccgaggccctcggatcggcgacgacgccagcggccgttgcggaagccgtcgcgcatgccctcgcgccccttcatggggccttctcgctcgtcatgaccgacggccagcacctcatcgccgctcgcgatcgccacggctttcgccccctgtgcgtcggccgcttccccgatggcggttgggtggtggcctccgagacgcccgcactcgacgtcgtgggcgcaagcttcgagcgcgaggtggaccccggtgaggtcctcgtcatcggcgacgacgcccaggcgagctcctcgctccccggaccccacttccagcatctgtgtgtcttcgaattcgtctacttcgcgcgtcccgatgccaagctgctgggccgagaggtgcacggtacgcgccgtcggatgggcgagcatctcgcgcgcgtcgcacccgtcgaggccgacatggtgatgggcgtgcccgactctggcatccctgccgccgagggctacgccctcgcctccggtatcccctatggccagggactcgtgaagaatcgctacatcgggcgcaccttcatcaaccccggggctgcgcagcgccgacaggcgatccgacggaagctgaacgccctcgaggacaacgtccgaggcaagcgcctcgtcgtggtcgacgactccatcgtgcgcggtgcgacgacacgtcagctcgtcgccctgctgcgccaggcgggggcggccgaagtccacctgcgcatctcgtcgcctccgtaccgctggccctgctactacgggatcgacacgccgagtcgccccgagctcatcgcctcccgcctgtccgtcgacgagatcgcccaagaactcggggcggactcgctcgcctatctcccgcttgcgcacctgcgagacgccgttggcgtgacccatggctgctgcgatgcctgcttgaccggggcataccccgagacggtcagcgaagcggcagccgcgggtgcgggctcgcggtgagccgagccgccgtcatcgctccagcgcccacctgacacctcgaacctgcgccacgtggccactagcctcggcgccgaggaggccactgtggagtaccgcgaggcgggagtcgacatcgaggcggcggatagcgcggttgcgcgcatcgctcagatcgtcgcccggacgtttacggaacgggtcgcgagcccgatcgggggcttcggcgcgctctacgagatcggcggcctcggtggtgcacgtccgaccctcgtcgcgacgaccgacggcgtcgggacgaagaccgaggtcgcccgggccggcgcccgctacgaaggactggggcgcgacctcgtcgccatgtgtgtcgacgatctcgtggtcaccggagcaaccccgctcttcttcctcgactacctcgccctcggtcgcgtcgagccctcgctggtggcattgctcgtcgatgccatggcagcggcactcggcgaggtcggggcgtcgctcatcggcggtgagatcgccgagcaccccggcgtgctcgagccgggtcaggtcgatctcgctggcttctgcgtcggcatcgtcgatggcgacgcgacgctcggatccgagcgcgttcgcgctggcgaccgcgtcctcggcctccgctcgccgaacctccgctcgaacggcttctcgctcgtgcgtcgcgtctacgcagacgtcctcgaggcggtggcacgcggtgagaccggaccgctcctcgccgacggccgacccctctacgacgccctcatcgagccatcggtgctctatgcccccctggttctcgagttcgcccgcgccggcttgctgcacgccgccgcgcacgtgacaggcggcggcctcgccggcaacctcgtacgggtgctgcctacgggcctcggcgtcgaggtcaagccctgggcctggcccgagatcttccgtcggctcgccgacgacggcgacgtctccctcgaggcgatgcgggccaccttcaacctcgggatcggcatggtgctgatcgcgccacccgatgcggcgagcgcgctccgcgagcgagtacctgacgccgtggacctcggcgtcgtcgaagcgagtgacgaaggagtgacatggtcgaccaccgtgccgtcctgatcgatgccctcgagacctacgggatcctccgaggtagcttcacgctcaagtccggtgccacctcgacctggttcatcgacaccaagcgtgcgatctgtcgaccgatggcactcgctgcgaccgcggaactcgcactcgaggcactcgatcccaccgtcaccgccatcggcggcctcaccatgggtgccgacccggttgccttcgcgaccgcgacgctcgcgcagctccggggccgcgcgctgaaggccttcagcgtgcgcaaggagcccaaagcctacggccagggaggggccattgcgggagcgctggaccccgacgacgtcgtctgtgtcgtcgaggacacgccgacgcgcggcgtctcgctgctcgcggcgatcgacgcggttcgcgaggtcggggccaccgtgtcccaagccctcgcggtcgtcgatcgcggaggcaccgccgccgacgtcatcgccccgactcccttcgtcgcgctggtccgcgccccggacctcggcctgccctacgaaggcagcgacagagcgtcttgacatctggcggcattgagcctagagtccgcttgggaggtgggtgtcgtgcgagtgagagcgtcgtcacggggaacatgggctgcgcggatcggtgtcgtcggcgccctcgccgtcgccgcagcggcctgcggctcctcgggcggggcaagctcgtcgtcgtcgtcgagcaccccgaccgcttcgttgccaccgtcgcagctgctctcggacgcctccgccaaactcgtctcgatgacctccttccgcttcaccggatcggggaacgtggcgaccccggcctcggcgagtgccccaagcgcgggatcgacgaccgtgaccccagccggctacgcgaccttcaccctgtcgggggcggcctcgatccctgagcacctcttcgaggtgacgacgagcgtccacggccttcgcatcaccgagatcgccacccagtcggatctctacctgcactatccgaccgtcgcgacaccgaacgcgaccgcaacgacctggctcgaaattccgtcgtcggtgctgcctatccccacgaacagctcggccttcgcgagcaaggttgcagcagcgctccgagccgccgtcaagccacagcccgacggcaccgcgacggtcgacggtcaaacgtgcacgctggtgaaggccaccatcagcgggtcggcgatgtcgcagctcctctccgcggccgatccgagcctggcaagtcaagcggcgtcgacgctcgacaccgtcagtgccgtcatcacggcggccatcaacagcgcacacgagctcgtccaggtgcacgaggccgtctcgaccagtgctggcgtccaggtgaacctgaccatcacctatgaagaccagaaccagccggtatcgatcaccatcccaccgtcgaacgaggtcgaactgatcacgagcgcgggcgagctgtcgggtgtcctcgggggctcggcatcgacatcggcgaaccaaggggcgtcacagggctagctctacgagctcctcgcaggcgggtacgtgccgtgcgtccgcacgagtatcggtagcggagcgttgctcctgggctgatggctcgagagacctccagagagcgcgaggagaccgcccggccccatgccagccggcatcaccgaagcatcccctatcgccacgtcccgcacgctctgtcgtccctggcgtcgacgctgcgagctggcagaggcatcctgtcccaccatccgcgccagctcgtgatgtcggcctaccaggggacgagcaccggtgatcaatcgctcgtgcggtcgccgcctgcgctcgcgccgccaacggcgtcgtgcgtgatcggacggtaccacgatggccaagcctcctggggtccctcgagtcgcgtcgtggcttcggggaccgcgacgcgccagtggtccgccgcggcgtggacaatggcacggctcagctcgcctgcgacgctcgccggcagcgcctgcaccatccaggcgacatcccaccacgcaccgagtcgcaaccacggaccgacggcctcgcaccaacggtcgagcgccgcgacgtcgtcgggagagccgagcgcaaaggtcacaggctctgcctgcctctgctccacggccacctcgaccacacgaccacgacgccgaacactgagccgagggtgcaggagttgcgcgctcgcatcgagaccgtcgtcgaggcgtgccgatggcccaagggccgcgcggtcgctcacttggcgcgcgaagacccagcgcgccaccgcggcttcgtcgccaggggagaggtggacgaagcgcaggcgccacacctcatcccccacaccgacgacctccgccaccgcccgcacgagccggccgctgacgtcgaacgacacggcccgcaccgtccccggcgcatcacgcaccccatcaggtgcttcgatcgcgacgcccccgaccgacacatcgacggtgaccatcgggacgccgagcgtgaatccgtggaggtagtacgtaccgcgactacgaaggacggcccgcggcccctcgcgcaggttccaggggcgcgcggcctccacccgaccacgaaggcgcccgtgctcggcgcgcacgagcgaggcgccgagccacgctcgcgcggcgacgcaccgggcagagatcgccatgacgctcgcggggtcgcacccgtccgccccgtcgaactcgaccgtcggtcccgcgagcgccgcgaccgtgacctcgatcccgaccggctcgaggcggacgaccttgccgggccagcagacgaggttcgcggggagcagcgccatggtcctcagtcgtcgatcgcgtggcgcacgacgccctcacggatggcctcgcgcatgaccgcttcggcaaccgcaggcgcgacgctccggttgaacaccgatgggatgatggtgctcggagagagctcgtcgtcggtgacctgtgcggcgatcgcctccgcggcaacgagcttcatgccctcggtgatcaccatggcgtgcgcgtccagtgcgccgcggaagatgcccgggaagcagagcacgttgttgatctgattcgggtaatcgctccggcccgtcgcaacgacggccgcgatgccttcgagcgactccgggctcacctctggatctgggttcgcgagcgcgaagacgatcggattcgtgcccatggtgcgcacgtcttcggcggtgatgacgcccggtcccgacacgccgatgaacacgtcggcgcccgcgagcgcctcgcccaccgaccccatgcgacgctctgggttcgtgtgctcggccaaccacgccttctcgccggtgaactcctcgcgcccgctgaagatggcacctcgacgatcggcgacgatgatgcgtccgacaccggcgtggtcgagaatcttggccgtcgcgacccccgctgcgccagcgccagcgatgacgacggtgagctcctcgagcttcttgtcgacgacccgacaggcgttgcgaagcgccgcgagcaccaccacagcggtgccgtgctggtcgtcgtggaagaccggaatgtcgagccgcgaggtgagcgcagcctcgacctcgaagcaacgcggcgccgcgatgtcctcgaggttgatccctccgaaggcaggctcgagcgccgcgatcgcctcgatcagcgcctcggtggtgggagccgtgatcgggaccgggaacgcatcgatccccgcgaactccttgaacagctgcgccttgccctccatcaccgggagcgacgcgtgcggcccgatcgccccgagaccgagcaccgcggtcccgtcggtgacgacggcgacgctgttcgacttgatcgtgtagcgatgcaccagactggggcgctgggcgatggcgagcgacacccgcgcgaccccgggcgtgtaggccatggagaggtcgtcgcggttctggatcggggtcttgccgcgaacctcgatcttgccgccggcgtgcagacggaacacgcgatcgaccagcgagcgcacgtgcacgcccgggacgccctcggcagcttctcggatgcgctcggcgtgctccggatcgcccgagagcaccgtgatgtcacggacgatggtcgcagcatccacctcgaccaagtcgacgccgagaatgttcccgcctgcctccccgatcgcggtggtcaagcggccgagggttcctggctggttggtgagctcgacgcgtagcgtcaccgaatgggagacattgggtgttgccatggcgataggctagcttgcccctcgtcggctaggttggccacgccatggcgaaccccctgcgcaccctcgatgagcgaacccgcgaggtcgccgagcgagcactcacctcgtggatcgcgaccacccctcgctccggctcgctggcggccctcggccttggcgtcgggctcgctgcgctgggtggcctcgcgaccagtgatcgagcgatcgccatcggtcatgcggcggcctcgggcgcacacggcgcgtcggtgtgggagacctcgacgctcgccgcgctcgccctcgccagcgctgaggtgccggtcgtctgctggctcgatgggaccatcgacgaccaggagttcgccgtcgcacgagagctggttcgtcaccgagctcgcgcgatcgccctcaccgactcgccagcgcgcgcggcgctggtccgtgccgccgggtggcaccgcgacgagctccgcggcgacgacctcgtcgcaggtatctcgctgggtcgagacctcgcccggcgtgaaggaccggccgcggtgatcgtgcacacgcccgagcacacggtcgaggcaccggaggaactcctgcgtcgccgagcgcgccgcgcgctccgagatgcccaaccgctcgaggtcgtcgccttcaaaccacccatcacggccgagacggcgctcgaggcggtcgacgaccgaggtcccgacgcccccgtgcgggcatttctcggcggcgcggggatcgttcgcatcacccgcacggggctcgcccgcgacctcgaggtgcgcctccgggccccggtcatcggggtccccgatcccgaggggctcgcgcgagaggtcgccagcgccggtgcgcgtgcggtgatcctcgacgtcgatggcgacacgctgatcgccgcctcccctgcgccaacgctggaactcgctccgatccgcacggaggacgtggcactcgccctcggtgcgctggtggcaggtgcgggcttgcgcgtcgtcgtatcgaccgtcgggcgggtcgcaggagtaggcgagcgcgtcgtgcaccatctcgctgccgacccgagcttcgtcatggtcacctgggcagcaggcgccctcgcaactgcccaggcgcgtgcactggtcgcaggcgagcgacgcacccccagcgtcgtcgagctcgtccagaccgatcccatcccagccgtgctcgacgagctcctcgctccggccgagcgcatcgtcgtcgtggggcccgcggcctcgggcgtggggcagcggctcgccggctggctctttgcccgcgacctccatcgccgcacccagtggtacgaaccaaccgtacccgcgagcgtgctcggcttcgccgcgcgcaccctcgcgagctcctgagcagccctgtctcaagccgccgtcacggcggccgatgacctggtgatcgctgatcaccgaggagggccagatggagagcccgcggcttcgcgagcgcgcagcttcgccaccgctcggcgccgcgctcgtggccgcgggcctgctcgacgagcacgacctcgccgtggcactcgagcagcagacccggagccgacgacgcctcggtgaggtgctcgtacgccgaggcatcgtcccacgcctcgatctcgcccgtgtgctcgcagaacgcgctcgcgtgcccttcgtgaccctcgtcgatcgcgagccacgacgggagctgctcgaggggctcgacctcgaggcgtgcgtccgcgagcggctggtcccgatcgaccgagacgacgatggcacgctcgtggttgcgagctcggaggtgccgaccgacaccgtgcgcgagagcgccgaacgtctcagcggcgctcctgtccggctcgtgctcaccaccgagtgggacctgctccgctacatcgtgcgcgcaggcgccgatcacatcggccgacgagcggcctacggtctcgcggagacggatctcgacctgtcggcagcccacgtgctcacgagggcccaagccatcggcctcgtcgtcgtcgcggtcgtggtcgtcctcgttggcatcgtcgacacccgagcactcctcggggccgcactcgctggcgctgccaccctcctcgcgctcgtcgtgctctttcgagcggtcgttgccttccggggcgccggcgtgccgtgggtcgtgccagagcgcctcctcgacgacgcagacctgccgacctacaccatcctcgtcccgttgtatcgagaggcggcggtggtcccggcgctcatgacctcgctcgccaacctcgactacccaccagagaagctcgaggcgctcgtactcgtcgaggccgacgacgacgccacccgggacgcgctcgtcgcggcgcgcccgccgagctgggtcaccgtcgtgaccgtgccgcccgaggggcccgcgacgaagccgaaggccttgaacgtcgggctcgcgctcgcctccggtgagctgctcgtgatctacgacgccgaggatcgacccgaacccgaccagctccggatcgtggcctcgatcttcgccgacgccgaccacgaccttgcgtgcgtccaggcagcgctgaactaccacaacgcccgccacaacctgctcacgcgcctgttcaccctcgagtactcccagtggttcgattacctcctccccggcctcgaggcgctcgagctgccgatcccactgggagggacctcgaatcacttccgcacgcagctgctgcgctcgttgggaggctgggatccgttcaacgtcaccgaggatgccgatctcggcattcgggccgcggtgaagggtgcccgggtcgccaccgccgcctccaccacgtgggaggaggcgaccgctcgccccggcgccttcatccgccaacggacgcgctggatcaagggctacgtccagacagccctcgtgcacgcccgccacccgatccggctggtccgagcggtcgggccgatccaggccctcgccttcgccgtcctcatcgccggcacgccgatcgccttctggacgatcgtgcccctcgacctgaccttcgtggcctctctcgtcctctcgccgcacgtcctcgtcgatctcgtaccgcgctgggcgctcgccgtcggattcgtcgacctcgtcatcggcaacgccgtggtgatctacctctccatcgtggccgtcttccgtcggcgtcaatggtcgctcgtgtgggccgccttgctcacgccggtctactggatcttgcactcgctcgcggcctatcgagccctcgcccagctcgtgacccggccgcactactgggacaagaccgaccacggagtcgcgctgtgaggggccggcgcattcgctggtggatcgtggccgcgagtgcactcccgctcgcgatcgccgagatcgtcggactccttcgcctgggcccgggcaccgtcgtcctcgaccacgtcgatcccctcggcatcggctcactccacgcggtcgtcgtcatcgccctcgcgaccatgacgccgctcgccgtaggtctcgccatcgcgagcgcgcatcgctggatcgcgactcggctcgaagcgacgccagcgatggtcacggctgcactggtcgcgttgtggtggctcctcgtgctcgcaggcacgacggcggccggggtgatcgacctcgcgctcctcgcactcctcgtcgtgtccgtcgccgaagccggcgccttcgtgctcggcgacacggtcacggctggggtcggcgcagggcttgccctctgcgcgctcgcgctcagcgacccgccccttgccctctgcgcgctcagcatcggcgcggtggtgctcgtgggactcggggctcgtggtagggacgaggccggcctcgcgttcttcgccgtccttgccttcccgagcgcggcgctcgtggtcggggtgcccttcgtcgactggcgcctcaccggcgacgcggccgcgacccgcgcctacgtcgccgccgtgggcatacaccatccgttcgccgcactcgtcgtcgcgtgcggcgcggttctcgcggccctcgccagaccacgggcactgctcgccgcggccatgctcgctgcagccgtcgcgggggccatcgtcgccggcatggacgcacgcgccatctcggcgctcgtcatcgtcggcctcgcggtcgtcgtggtgccattggtgggggggcgccacggcccgacgctccccatcgccgccgccggaacggtcggcgacgacggggcccagcgtcccaacgctgcctagcggcgccgacgcagctcgtcggtcgtgttcggcacgatcccagcccgctcgagcacctccgcactcacgccggcctcgcgccaggtctcgtagctgatccccttgcgttccccatagcgcgctgcatgctcgatgaacgcctcttcgagctccttgttgtcggcctgatgctccaggcgccacaactcactctcgaggtccttgcgctgctgcaacagctcgatccggtgcaccccggttgcgctctcgaggtctgccgtcacctgatccaagagcatacgaacacgctcgggagtgcggcggcgcccacgcctcggcttgttctcctcgagatagcgcaggtaggcgtccacggcctgggactccctacgcccgcgggcgatcgccgcgcgctgctcgccactcatctgacgaccgtcatcagccattgctgctccttctccttgtctccatcaccgcgagacagctgccacttccgaccgaggtccccggtcggcgacccagcgctccgaacgcgacggcgaggtgccgacaccacaaccaagagagccatcagcgcagctcatccacgctcccctcgacgttgcgtccaccggcccaaccacgccgatcgtcggcgcagtcgcgtcggagccggccagggggagtcacctgagccgtctcccacccacgcaaaaccgccgagacgaacccgccggaatgagcgagccggaacgccgcttcaggctctcgccaggcgaggcgaggcccacactctcctgatcgtcctcctgatcgtcaaacggtgtcgaggtcgccgctcttccctacttcccatgagctcgatgctcaccaacaaccatcatactggccggacgagttcatccaatgtatcgcaccgacacagcgaatcaggtcgtctttgcaatgcaattgcgatcgccaccgtgcgctcataattgctgcctcccagctcgagcgtgggcgtgacctccgatcgcacaatggcggcccggtaggctggcgccatggacgagccgcgccaccgatccctcgggctgaccgacgacgagtacgagagcattcacacgttgctcaggcgcgagccgaacgataccgagctcgcgatgttctccatcatgtggtcggagcacgcgtcctacaagtcctcacgggcactgctcggccgactcccgtcacgtggttcgcgtgtcatcatgggccctggcgagaacgccggcgtcgtcgcgctgacggactcggtggcggtcgcgatccgcatggagagccacaaccatccgagtgcgatcgaaccacaccagggtgctgcaaccggggtcggcggcatcctccgcgacatcttcaccgtcggagcacgacccatcgcgctgctcgattcgctgtggatggggccccaggacgacgcgaggagccgctggatcaccgacggagtcgtcggcggcatctctgcttacggcaacgcggtcggggtgccgacggtcgggggcgagctacgggtcgatgcgtgctacggcgccaatcccctcgtcaacgtcgtcgcggtgggtgtcgcgcccaccgaggcgctcgtgcgtgctcgcgccgagggtatcggcaactacgtcgtcctcctcggcgccccgaccggacgagacggcatcggcggggtctccgtgctggcctctgccggcttcgatgccaccgcggagcagaagcgcccgagcgtgcaggtcggcgatccgttcgaggagaagaagctgatcgaggcgtgcctcgcgctcatgcgcgccggcctcgtcaccggcgtccaggacctcggcggcgcgggactgacgtgcgcgacctcggagacggcggccgcagcgggcgtcgggatggacatcttcctcgacgccgtgccacgtcgtgagcccgggatgacgccgatggaggtcctgtgctcggagtcgcaagagcgcatgctcgccatcgtcgagcccgggctcctcgacgaggtcatcgcgacctgccgacgcttcgaggtgaccgcgtcggtcatcggggtggtgcgcccacccgatgcggagggcccgtacgccggtgaaggagttctgcgagccttcgagagcgacgggggaccgctcgccgccgtcatcccggcgcggctgctcgcccacgacgggccgcgctatcgacgccccatggcgccgccggccgacctcaccgagcgacgcgcacaggtcgtgaccctcgatgcgccgggagcgacgctcctcgccgaggtcgtcaacgacccgatcgaccccgccggggtgtggcgacgctacgaccacatgctgtttcgcacgagcctggtcgaaccaggcgccgacgcggcactcctgcgtgtgcgcacgcccgaggtcggcgacaccggacgcgccatcgccatcaccgtcgatggcaacaaccgctggacccgtgtcgacccgcgtcatggggctacgtggctggtcgccgaaggcgtcgcgaacctcgcgtgcgtgggggcaacgcccctggctctcgtcgactgcttgaacttcggcaaccccgagcaccccacggtgatgtggcagctcgccgagagcatcgacggcatcgccgaggcagcccgagcactgggggtccccgtcgtcggtggcaacgtcagtctctacaacgaggcagacgggatcgacatcgacccgacccccatcgtgtcgctgctcggcgagcgcgccacgccgaccgcgccggtacccgctccggagcgcgcccacggcagcctcgtcgtcctcgcgccacgaggggcagaaccccagctcgcgggctcgcgagcggcggccgtggcgggtgtcgatggcggcaccctggcgccgctcgactgggaagcgcaccgtcgtctgtgcgacgcggtggcggacctcgtcgtcggggacgaggtgagcgcggcaaccaacctgtccgccggcgggctcgcgcgatcagccgccaggttcgcccttcgcagtcggcaggaggctcggctcgagaccacggacacgctcgcgctcgtcggcgagcacccgtcgcgggtcctcgtcgccaccgacgacccggagaggctcgtggcctgggcgtcggcgaaggacctcgacgcgaccgtcgtcggctcgctggctccgtcgggcgagccagccctcgtggtcggcgcgcaccggatcgtgctcggtcgtacccaggacgtgccggcgctcgtgccgaccgacgcctaaccgagcagaccagcgagcaaccggccggcgggctcggcaagaccgtagcctccgccggctcgctccggatgcggcatgagaccgaccacgcgacccgacgcatccgcgatcccggcgatgtcgtgggccgagccgttcggattcgcgacgtagcggagcacgacgcgaccggactcctcgagcctgcgtagcgtgtcgtcgtcggcggtgaagttgccctcgaagtgattgatcggcagcgacagacgctcgtgtgccctcatcttctgggtcaagacgctctcgacgctcgcgacctcgacctcgacgtgctcacacaggaagctgaggcccgcgttcttctggagcgcgcccggcaggagccccgcctcgcacagcacctggaagccgttgcagatcccgaggatcgggaccccacgccgcgctgcatccatcaccgcgcccatggccggcgcaaaccgtgcgatcgctccgggtcgcaggtagtcaccgtaggagaacccaccagggatcacgacggcgtcgaccgctccgagctcgctctcgccatggtggacgaggcgggcggtgacgccgagttcggcgtaggcgccgaccacgtcgtgctcgcagttcgtgcctgggaagacgacgacggcgacactgctcacggggcaacgacctcgagttcggcgatgcgccacgtctggatcaccggattggcgaggaggcgctcggcgagcacgctggcctggtccagcgcatcacgctcgtcgacggcgcgaagctcgaggcgaaaggcgcgtcccgcactcacgttgacacccggcgcgagctcgaggtgccgagccgcgtccgtgatggcccgcccctcggggtccgcgatgcccggtctcggctcgaccacgaccaacgccacccaggtgtgcgcactcatgcccgctctcctccgtagggatcggcgctgcccggccactcgtcgaacgagcgtcccgtcagcgtctcgtagaccgtcacgtagcggccacgcagctcaccgacgagatcgctcggcaggggaggtggcggtccctcgccacggaaaccctcggccacgagccagtcccgaaggagctgcttgtcgagccactgggggttctggccgaggtccccggcgacgatgcgagccgcgtcgggcgtagcgatctcgtcggcgagcaccaacgcacgcccgtcgaggccgaactcgaacttcgcatccaccaaggtgagccccttcgcgtcgaaccaggacgcgagcagggagaacacctcgagggaccggtcggcgagctcgcgagcacgccgctcgccgacgagctcgccgagctcgtctggcccgagcggcaggtcgtggccgacgtgagccttggtcgtcggggtgaacaggggctcggggaatggagcaccgaagtcgaggtcccgtggcagctcgcgaccgaacgcggtgccgtcgcgctggtaggactcccaggcgctgcccaccagccgaccgcgcaccacgcactcgaccggcagcatcgcgagtcgccgcacccgaagcgtacgaccgagccacacatcggggacgtcggtcgcgacctcgaggaggtgggtggccacgtcgctcgcgacgcgctcgaaggccgcggccgcgatggccgtgagcagccgacccttgtcggggacgagctcaggaaggacgacgtcgaaagcgctcacgcggtcggtggcgacgaccagcagcgccgcctcgtccctcggatccacccaggtctcacggaccttgccgacaccaacgcgcgtgaggctcacgatgcctcctcgagacgagcgaacaggggggcaaggttcgcgaccaggcgctccgcggaggcgagctcggcgagctcgcccggggagagcggcacggcggggtcgtcggccagcgcatcgaggaagggcacgtcctcgtccagggtgcgagcggccgctgcctgaacgatgcggtaggcgtcgtcgcgagccatcccgcggcgcacgagtgcgagtagcacctgctgcgagtacacgagaccgcgtgtggcggcgaggttctgcgccatcgcctcggggtgtacggtgaggcccgccacgatccgcgtcgccagcgacgtgccgtagcaggccacgtggaaggcatcgggcagcatgacgcgctcgaccgacgaatgcgagatgtcgcgctcgtgccagagggcgacgtcctcgagcgcgggcacgacggccgagcgcgcgagacgggccatgcccgagaggcgctctgcgagcactgggttgcgcttgtgcggcatggccgatgagcccttctggccgacggcaaagggctcggccacctcgccgacctcgctgcgcgcgaggtgacgaacctcgagggcgatggtctcgagcacggctccgagcgcagcgagcgcccacacgacgtccgcgtggcggtcgcgggggatcacctgcgtcgccgacgtgggacgcaagccgagggcctcgagcgcgtgacgctcgatggccggcgagagcgcggagtaggtcccgaccgcgccggagagcttgccgacgctgatggtctcgcgggcagcgacgagacgagctcgcgcccgttcgagcgcgagccagaacagggcgagcttcgcgccgaacgtggtcggctcggcagccatgccgtgcgtgcgacccaggcagacgaggtcgcgcgtctcgagcgcacggaccctcagcgtgtcggcgagtccgtcgacgagctcgagcacccgatcggtcgcgtgcacgagcgccagtgacagcgcggtgtcgacgacgtcggaggaggtgagaccgaagtggatccaccgcgcagccggatcggcgatgcgggcttggagcacgtcgacgaaggccgcagtgtcatgatgggtgatgcgctcgcggtcgttgacggcctcgacgaaggcttcgtcgggcgtcggggcgagctggcgtaggcgcgcggcatcctcggcagggatctcgccgagggcccccagggcgtccgtcacggcaagctcgaccgcgatccagcgcccgaggcgcgcctcgtcggcgaagagtcgcgcgatcaccggatcctcgtagcgagggatcacgccaactcctttccgaccacgccgccgatgcaccatgccccaccgtccgccgcttcgcgcggcgatgagcgcgcgacgacgtcgtcggaccgtgggctcactcggcgcccaagcctagatcgctgcgccaggtcgcgccctcgatgcgaatcgcctgacgggcccgataggccacctcgcgcgccgtggccaggtcgtcgccccggcccacgacggtcaggatgcgcccaccggtcgtggcgagggcgccgtcggcctcggcacggaccccggcggtgtagacccgcgcgccgaggcgctccgcctcggcgatcccctcgatgcgatcgccaccgatcgacgcctccgggtagccacgggccgccatcacgatcccgagcgccgcgccggcctggacatcgagatcgccgatggtgcccccgcgggcagcggcgaccagggcgtcgacgaacccttcgccgaggagcggggcgatcgcctgtgcctcggggtcgccgaggcgcacgttgatctcgagcagcgacaggccgtcctcggtcgccatcaagccggcgtagagaaaccctcgatagacgatcccgacccgacgaagctcggcgaggagtggctcgagcacccgatcggtggcttcttcgatgagcgagtcgttggcccagggagccggtgcgtaggcacccatgccgcccgtgttcggaccgaggtcgccgtcgaggagccgcttatggtcctgggcgacgggcaacagccgcgcatcgcgctcgttcaccaaccagatcatcgagagttctcggccaccgagaccctcctcgatcacgaggcgccgacccgcatcgccgaacgcctcgcccgagagcttggcccgaacgtctgcctccgcggccaggcggtcgcgggtgacgagcacgcccttgcccgccgccaacccgtcggtcttgatgacgtaggggggcccgaagcgatcgaagagcgcagcggcctcctcgatcgtggtggcgacgccccagcgagccgtcgggaccccggccgcgtcgcagagccgcttcatcgcgatcttcgaaccctcgagcgccgcccctgctgcacctggtccgacgacgaggcgccccgcggcgcgaaggtcgtcggcgagtccggccacgagcggagcctccgggccgatgacgacgaggtctgcctcgatggctctggcctcgtcggcactgacctcgaagcgggtcgcgatcccggcgttgccaggggcgaccaccaccgaggctcccccacgcgagacggcgtcggcgagcgcgtgctcgcgagctccggagccgacgatgagcactcgcatgggctctacgagagctccacgatctggtcgcggctcgggccgaccccgacccagcgcaccggcacctcgatccgcgcctcgatgaactcgaggagccgacgagccgccgcgggaagcgcggatgcagtggtcacctgtccgatcggggtcttccagcccggcagcttctcggtgacgggatgggcgcggtgcagatccgactggtgatacgggagctcgtcgaccctctcaccagcgacctcgtaggcggtgcacacctggatctcgtcgaaggtgtcgaggacgtcgagcttggtgatggcgagttcgctcaccgaattgacgcgcaccgcgtgctggagcagcacgaggtccagccagcccgtgcggcggcgccggcccgtgttcgtcccgtactcgtgaccacgatcaaccagcgcatcggcgagcggcccctcgagctcggtcgggaaggggccggcaccgacgcgcgtggtgtaggccttggcgacgccgatgacctgatcgatctggcgaggcccgaggcccgagccggtgcaggcgccaccggcggtggggttcgacgacgtgacgaacggatacgtgccgtggtcgagatcgaggaaggtggcttgggccccttcgagcaggatcgtgcggccctcgcgccagagtcgctggacgagccccaccgaatcgacgatccgaggcgcgatcaggggtgcgtaggtaccgaggtagtcggcgacgacccgctcggggtcgatgggtagacggttgtagcccttcgcgagcacgaggttcttctcgcgcagcgccacgtcgagcttggcccggaagatcttctcgtcgagcagatcctggactctcaggccgatacgggccgccttgtccgcataggccggaccgataccgcgcttcgtggtgccgagctgtgccttgccgaggtagcgctcggtgagtcgatcgagctcgtggtggtagggcatgatgagatgtgcgttgcccgagacgacgagccggctcgtgtccacgccgcgctcttcgagcatgcggagctcctcgacgagcaccttcgggtcgacgaccacgccgttgccgatgatggggatcacgccgggatagagcacgccgctcgggacgagctggagcgcgaacgcatcgccgtcgacgacgatggtgtggcccgcgttgtgtccaccctggtagcgcacgacggcagcggctcgccctgcgagtaggtcggtgatcttgcccttgccttcgtcgccccactgcaggccaacgaccacgatggcgcccacgccacctccttcgactcgggtgccccgccaggctagggcacgcggaacacgaggggttcgccgttggcgatctcgagcgagaccacctcgtcatcgtcgaggtcgcgcagcaccttcacgaggccccggagcgagttgccgtgcgccgacacgagcacggtgtgcccgtcccacagcagcggcacgatgacgtcgtagtagtacggcagcacccgatcgatcacgtcgcacagcgcctcggtacgaggcacgagtgcgagcgggagcatgcggtagcgctcgtcggcatgcaggagacgctgggcctcgacgtcggtctcgggtgggcgcacgtcgaagctccgacgccacagcttgacctgctcgtcgccgtagcgagctgcggtctcggccttgttgagtccctggagcgccccgtagtggcgctcgttgagccgccagctgcgcagcaccggcagccaggggcgctcgagttcgtggagcatcagctcagcggtcgtgatcgcgcgctcgaggacggaggtcacgaggacgtccggccgaaggccgtcggcctcgatcgccttggcggcctccttcgcctccgcgacaccctggtcggtgagtggcacatccacccacccggtgaagcggttctccgcgttgtacgtactctggccgtgccggacgaggatcagcgtgcccacgtggctcgagcctagcccaccacgccaatggtcaagaaccggctggtcggtgaccgattgaaccgtgtgggaatgtttctgcggcgtgaagcgtcctaaaacttgatattctgtgactcaagcttcgcaggggctctcgcgtcaggagacgccgatccccacagcccagctcacagcagacacggacggacagcaagcacggtcgtaacaggcaagcacaacacaggaggagcagccatgcccaaggcagtcggcatcgatcttggcaccacgaactccgtggtcgccgtcctcgaaggtggcgacccggtcgtcattcccaacgcggagggtggacgcaccaccccgtccgtcgtggccttcgccaagaccggtgaggtgctcgtcggcgaggtcgccaagcgccaagccatcaccaaccccgatcggaccatccgctcggtgaagcggcacatggggaccgattggaccatcgacatcgatgggaagcactacacgccccaggagatctccgcgcggatcctcgccaagctgaagcgagatgccgaggcctacctgggcgacaccatcacccaggcggtgatcaccgtccctgcctacttcgacgacgcgcagcgcacggcaacgaaggaggccggacagatcgccggcctcgaggttctgcggatcatcaacgagccgacggctgcggccctcgcctacggcctcgacaaggaagccgaggaccagacggtgctcgtcttcgacctcggcggtggcaccttcgacgtctcgatcctcgagatcggcgagggcgtcttcgaggtcaagtcgaccgcaggtaacacccacctcggtggcgacgactgggaccagcgcatcatcgactggctggtcgcgagcttcaagaaccaagagggcgtcgacctctcgaccgacaagatggcgatgcagcgtctcaaggaggcggccgagaaggccaagatcgagctctccgcgtcgctggagaccatggtcaacctgccgttcatcacggcgacgaccgaggggccgaagcacctcgagatgaagctcacccgagcaaagttccaagagctcaccgccgatctcgtcgaggcgtgccgcgcaccgttcgagcaggccattcgtgatgcgaacctgtcggtcggcgacatcgaccacgtggtcctcgtcggtggctcgacccggatgcccgccatccaggagctcgtcaccaagctcaccggcaaggagccgcaccgcggcgtcaacccggacgaggtggtggccgtcggtgcggcgatccaggccggcgtgctcaagggcgaggtgaaggacgtcctgttgctcgacgtcaccccgctgtcgctcggcatcgagaccaagggcggcgtgatgaccaagctcatcgagcgcaacacgaccatccccaccaagcgcaccgaggtcttcaccacggccgacgacaaccagccctcggtcgagatccacgtgctccagggcgagcgcgagatggcggcctacaacaagacgctgggccggttccagctcgtcgggatcccgccagcgccgcgtggtgtgccgcagatcgaggtgaccttcgacatcgacgcgaacggcatcgtccacgtgtcggcgaaggaccgcgccaccggcaaggagcagtcgatcacgatctcgggcacgacgtcgctcggcaaggacgagatcgagcgcatggtgcgcgacgccgaggcccacgaggccgaggaccgtcgccggcgcgaggaggccgaggtccgcaacaacgccgacaccctcgtgtaccagaccgagaagctcctcgcggaacagggcgacaagctctcgggccccgagaaggatcgggtcaccgaggccttggggcagctgaagctcgcgctcgacggcacggacatcgccgcgatccgcagcgccaccgacgcggtggtctcggcgtcccagagcttcacccagcggctctacgaggaggcctcgcgcagcgcccagagcgccgatgccagcggccagtcgagcacctcgtcggaggatgaggtggtcgatgccgagatcgtcgacgagtctggagagcagaggtcctgagccatgggcaagccgtacggagacgacgccgacgagccggtgacgccgtccgaggacgccacgcccgtcggggggtccccccccgacgggacgaccggcgacgacgagccgaccgcggaggtgcagccgagccccgacgacgaggggcgagagagcgatccggtcctcgcggcgatcatggaggacctcgcagccgtcacacgggagcgcgacgagttcctcgagaccgcacagcggctccaggcggagttcaagaactaccgcgagcgtgtcgcgcgccaacaggccgaggccggtcaagctgcggtcgcgagcttcgtgacgaagctcctgccggcgctcgacaccttgaacctcgccctcgcccacgcccgtgcggagggctccgaggagacgacgagtgcgctcgcccaggtgcacggcgtcttccacgaggtgctgaccaaggaagggctcgaggtcgtcgagcccatcggcaagcgcttcgacccgaccgaggccgatgcggtggcccacgaggagggcgagggcgagcccacggtcacggaggtgttccgggcggggtaccgctggcgcggacaggtcatccgaccagcgatggtgcgtgtgagcggatcgtgaacgcgacgagcgagacgggctcgtcacgaggggcgagaagggaggtgagctgacgtggccccggcgagagagtggttcgagaaggactactacaagatcctcggcgttcccgagacggcgagcgagaaggacatccagcgtgcgtatcgcaagttggcccgccagtaccaccccgatgcgaaccccgggcacgaggagcgcttcaaggaggtctccgcggcctacgacgtcctcggcgatcccgccaagcgcaaggagtacgacgaggtgcggcgcctcggtccgctcggatccatgggcgcccccaccggcaacggcacccgtggcgccgggacgttccatgctgaggacctcggcgatctgatcggctcgctgttcaatcggggccgtcgcgaggccagcgggcctcgacgcggcgccgaccaagaggccgaggtcaccatctcgttcgaggacgcagctcgtggcgccgaggtgcagatccccgtcaccggtgaggcggcgtgctcggtgtgcaagggtacgggtgcagcccccggcaccgtgccgaagacctgcgcccgctgcaatgggaccgggacggtctcggacaaccaggggttcttctccttctcgcagccctgtcctgcgtgccacggccgcggcctcatcatcgagcagccctgtccctcgtgccacggcaccggcaccgagcaccgaacccgcatcgtgaaggcgaggatccccgcgggtgtcgagcccgactcgaccatccgcctgcgcggccgtggcgcgccggggcgcaacggggctcctgcgggcgacctcttcgtgcgggtgcacgtgctgccgcatccgatgttcggtcgacgcggagcggatctcacgttgcgtcgcacgatcagcttcgccgacgccgccctcggcaccgtcctcaccgtgcccaccctcgacggcacggtctcggtgaaggttccgcctggcacgagcgccggcacggtgctgcgggtccgcggcaaggggctccccaaccccaagcgcaagggagcccgcggcgaccttctggtcacgatcgacatcgacgtgccggacaagctcgatgccaagcagcggcgctacctcgaggacttcgctcgcgtcttcccccacgacgcagcctgaggtgctctgagccacgagaggaggtgagatggctgagcacgaccgatcgcactccccggagcgctcccgcggcctgtacgtgatctccgtcgccgcagagctcacggggctccatccgcagaccctgcgcgtctacgagcgccgtggcctcttggagccgaggcgcaccggcggcggctctcggcgctactccgaggccgacctcgctcgcctgcgccgcatcatcgagctcacggagcagggcctcaacctcgagggcgtgaagcgcgtcatcgagctcgaggaggaggtcgagcggctccgcgccgaactcgacgctgcgcgccagcgcgcccgcgagcgcgagcgcgagctccatcgccactaccggcgcgacctcgtgccgctcagccaggcggtcatcgtctggcagccacaacgccaacgcacgggcgacgcccgctgatccatcgagtccctcctcccccaaccccaacccccaaaccacgaacgaccacgccggcccgaggccggcccggaggcaaccatgagaaccgatcacttcacccacaagctccaagaggcgctgcaggatgcgaagcgcctcgccaccgagcgccagaaccccgaggtcaccccgcagcacctcgcgctcgccctgctcggccaacccgacgggatggcgctcgccgtcctctcgcgagccgggatcgctcccgccagcgtgcgcaaccagctcctcgaggccctcgagcgcctaccacgcgcctacggccaagcggccgaaccggcaggatcggcggcgctcgcacgggtgctcgagcgcgccgagcagctgcgcggtgagtacggcgacgactacctctccgtcgagcacgtcctgctcgccatggcggccgtgctcaaggtcgacgaggcgacgctgcgccaggcgatcgacgccgtgcgtggcggacgccgtgtgacctcggccgaccccgaggacaccctagaagcgctcaccaagtacgggcgcgacctcaccgaggctgcacgcgcaggctccatcgaccccgtgatcggccgtgacgaagagatccgtcgggtcatccagatcctctcgcgtcggcagaagaacaacccggtcctcatcggcgaacccggcgtcggcaagaccgcgatcgtcgaggggctcgcacgccggatcgtcgaaggtgacgtgcccgaaggcctgcgcggcaagcggatcatcgcgctcgatctcggctccatggtcgcaggagcgcagtaccgcggtcagttcgaggaacgcctcaagagcgtgctcgacgccattcgccagagcgaaggcgaggtcatcaccttcatcgacgagctccacaccgtggtcggtgcgggtgcggccgagggatcgctcgacgcctccaacatgctcaagcccatgctcgcgcgcggcgagctgcgcatgatcggcgcgaccaccctcgacgagtatcgcaagcacatcgagtccgacgccgcactcgagcgacgcttcgccaaggtcatggtcgaccagcccagcgtcgaggagacggtcgcgatcctgcgcggcttgaaggagcgctacgaggtgcaccacggcgtgcggatccaagacgccgccctggtcgctgccgcggtcctgtcggatcgctacatcaccgatcgcttcttgcccgacaaggcgatcgacctcgtggacgaggccatggcccgactgcgcatggagatcgactcgcgacccgaggagatcgactccgtcgagcgccgtctgcgccagctcgagatcgagcgcatctcactcgcgaccgagaccgaccgcgcctcacgcgagcgcctcacccgcctcgaccaggacatcgaggccacgaagctcgagctcagtgagctgacccgccagtggcaagccgaacgggaagcgatcgacgtcatccgccagcgcaaggagcacctcgaggagctgcgtgcccagtcggaagcctacgagcgccaaggcatgctggaccgcgccgccgagctgcgctatggcgagatccctcgcctcgagcgcgagatcgaggaggcgaccgaagaactctcgaagcgccagggtggccggcgcatgctcaaggaggaggtcgaccccgaggacatcgccgaggtggtcgcggccgcgaccggcatcccggtgaccaagctcctcgagagcgagaccgagaagctgctccacatcgaagacgcactgcgtgcgcgggtggtgggtcaagacgaggcgatcgacgcggtggcgaacgccatccggcgcagccgtgccggcatcgccgatcggaaccgccccatcggctccttcctcttcctcggcccgacgggcgtcggcaagaccgagaccgccaaggcgctcgcggagtacctcttcgacgacgagcgagccatgatccgcatcgacatgagcgagtaccaggagcgtcacagcgtctcgcgcctcgtcggtgcgccccctggctacgtcggctacgacgagggcggacagctcaccgaggcggtgcggcgccgtccctacgcggtggtcctcttcgacgagatcgagaaggcgcacgccgacgtgttcaacgtgttcctccagatcctcgacgacggccgcctcaccgacggtcaggggcgggtggtgaacttcacgaacaccatcctcatcatgacctcgaacctcgccgacgatccgcggcgcttcttcaagcccgagttcgtgaaccgcatcgacgagatcgtgcgcttccacgagctcacctcggaccagatccgcgccatcgtcgaccgccagatggcccaactcgccggtcggctcgccgagcgctcactcggtctcgaggtcaccgacgccgcggcggccctgctggccgagcgcggctgggatccggccttcggtgctcgacccctgcgtcgagccatccaacgcctcgtcggcgacccgctggccagagcgcttctcgaagggcgctacggcgagggagacacggtcgtggtcgacgcggccgacggcgccatcgtgctgcgctgagcacacggcacgaccgacgacgcacctcgggaagccccggggtgcgtcacgtcgtcgggagcggccacgggagttcgtagagcgcgagggcgttctcgtaggcgacgagcctggcgagtcgaaacgcctctcgttccgcaatccagccctcggcgagcaggggctcgaggtaggcggccatggcgcgccgatggccgagcgcaccgagcgcgtagagctcggggaggccgaacgcgtccgaggagtagcagagcttgccccacggggcgagctcgagcatctcggcgagcaccgccggggctgccgggcccacgaaggactccgcgaggccgagatccacgaagacgtgcggatagtcgtgggcgaggagtgccgcctcgcgatggaagggataggtgtgcagcagcacgaggcgcacgccatggggagcgatggcctcgatgaagggctggagctcaccagggtgaccgcgtgccaggcgaacgtccggatcgccgatgccgacgtggaactggagcggcaggggtgccacctcgagtgcggcccacacgatcgccgcgacgaggtcccggtcgacgacgcgcaccccatgtccacggtcgcgttcgtcgaggatccgtgcgagtgccgtctcgagcgctcgcggcgcgggaggtcgatcgggaagatcgaggccactgcgataggcagccaccgacttgtaggcgaccgcccgccgcgcggcccgggcgacggccgcctcgagcgcagcccggaagtccgccgtcgcaccgaggtcggcgagcacacgttctgcgatcgcctcgagtcggaccacctcgagcgcgggtaccccgctcgccgcctcgagttcggcgggctcgagcacgagttcggaacgaaagccggtgtcgacgagcagcccacggacgccgcccgtggcgagcgagcgtgcaaacaggtcctccggtgcgtacgcggcgcgcgccgtgaggtagtcctcacttcgaaccggggcctcgagcccgagcacgaggccgagcgctgcgcgcacgccgatgccgagcgaggactcgagcggggtggtacgagccgcgaggcgatcgggggcttcggtgaggtggtcgagcaccgtgtcggtatcgggggcttcgcgtacgatcccatgacagtgatggtcgaggagggggacgtctgccaagcgttccgcgagcacactggcgggcgcgagcgggttcctcaccgctccacctcgacgagggctcgggtcagctcctcgtagcgagccagtcgacgacgcgccggctcgccgatgcgctgcaccacggcggcgatgatcgcctcgacgagcgcgagggccggcgtgagcgcatcgaagatcccgggtccgtcgacctgggtggtgagcaccaccgagctgcctggcgcggccgggctgagtccagggtcggtcacgagcacgacggtcgcgcccgcctgactggcggccgtgacgaaccgggcggtctcgagctggtagcggacgaagtcgaaggcgaccaccgtcgtcgaggcatccacgtcgagcagggcattcacacgagcgccggcctcgggcggcacgtggcgcaccgacggtcgcaggacctcgagcgtccaggcgaggtgacgcgcgacgacgtcactcacgcgcccaccggacaccaccaccggacggcggacgtcggcgagcagggtgacgacggtgtcgagcgactggggcgcgagcccgacgaacgagcggcggatctggtcgatgaggtcggcttcggccgagccaacgtcacccggcccggtgacctcgaggcgctcgagcggcgaggcgagccgctcgccgatctcttcgcgcgccgccgaccggaactcctcgaccgagctgaagccgagcttggcgacgaagcgcaggaccgtcgggggcgagacgtcagcgagcgctgcgatgtccgcgagtcgctcgagggcgacgaccgggtactcccgtaacaccgcttcggccacacggcgctgggcggggccgagctcgggtgcgactcgacgcacccgctcggcgagcgacgtcatgaccagctccaacgcatcgccgcgaccagctcctcgggcgtcgcgtcggcaaagcgagcgagctcggcctcacggacagcgccgatggccgtgaggaaggacctgcccaggacatcttggagtagctccgaggagcgcagtgcgccgagggtggcggcgagatcaccaggcagtcgctcgaggcccccgtggtgcgcgggatcgccctcgacgggaggcggcggcgtcctcgggtccgcgagcgcatggcgcgcgatgccgaggagggaggtggcgagcagatacgggttggcaccgagatcggcgcccttgagctcgacgtttgccgcgcggccatcgaccagcgtggccgcaggcacgaggcgtagggccgcctcacgattctcgatcccccagacgcgatacgcacctgcccagtggctgggcacgagccggaggtacgagaccggatggggggctgcgatcgcgaggatcgcggggagctcctcgagcagccacgcgatcaccgactcaccctcgggacgcacgccgccaggcccgtcgccgccggcaaagatcggctcgccgtcacggtagagaccgaggtggatgtgtccgccgttgccgaccccaccgacgtccaccaccggcgcgaacgacgttcgcagcccgtagcgctctccgacggcccggatcacggagcgggcaagcacggaggcatcggcggctcccacgggatcgctcggggcgagcgagagctcgaactgcgccggtgcgtactccggatggagctgtgccaccgcgaggcccgccgtctcgagggcgtcgtacaacgaccggagatagtcggcgagctcgatcacgcgcgacagtccataggccggccccgacgtcgcgggcacgaagtcgtcttgaccggcgaggccgacgacccactcgagttcgatccccatcgtcgcgctggcacccgcatcggcgagcagggcaacctcgcgctggagcgccgagcgagtgcagagctcgtagggagtgccgtcgcggcggaagcggtccaccggcgcaaaggcccatccatcgagcggcgcgagcggcctcaggaaccgggggtcgggacggagccggaggtcgtccatcgggccaccgctcacgctcgaggaggtgatggagtcgtcggtgagaaaggcgtcgaagaccgggctcatgccgacaccggcgtcgcacgccacggcgaagccctcggccggaatcgtcttcacccgtgcgatcccggcaaggtccacgtagaccagcgccacctggcgagcgtcaccgagcgccgaaacgtcgctccccgagcggtcctccagatcgcgctgtgctcgctgctgcgactcgtcgacgaccaccacgcctccttctggccgatgcggctccgaacgtagcgcacacaggtcgcccgggccagcgctgtgacacaatcgtaacaacaatcccttgcgctgaaacttcagtaacagctaccatacgtgcaccgtcgagagggggacgtatggccggtggttccaccaagctcaggggcaatctgtcgctctggcaggtcgtcggggtctccgttgcgctcatggctccgtcgatggccgccaatatcaatcctcaaggtgcgatcggaacggtgggacgcgcgatcccactcaccttcgtcctggcgttcgttgcggtgctcttcatcgcctatgtcttcgcccgactcacccagcgcttcaaccacgcagggagtgtgtacggcttcgtcggcgcgaccctcgggccacgctggggcgtggtggccggctggtcgctgatcggtacgtatgtgtcctacggtctgctcacgatcatggcgtcaggcatcttcctgacagccctcctccaggcgctgtcgatctggcactctcctcctgcctgggccccgttcctgctctcggggatcgaggtcgtcggcgtcgccatcctcgcagcacgaccagctcgcaacgcgacgcacgtgctgctcgtcacggagctcacgaccgtggcgctcatcatcgtgatctcggtggcgaccctgatcgaactcgcggtgggacatggcccgagcgggcagcacttcacctggagcgtcttcagcgttccccatggcatcagcgtctcggcactgttcctcggggtcgtcttcgggttcttgtcgttcgcaggcttcgaggcatcggcaacgctcggcgaggagtcgaagcgaccacggcgtgacatcccacgggccatcgtgggaacagcggtcttcggcggcgtgtacttcatcgtcgtgaccgcggccgaggtgatgggatttggcaccaccccacacgacctcgcccgcttcgccgcgacgggatcgctgctcggcgcgctcgggacgacgtatctcgcggcctggctcggcaacgtcgtgacgctcggcaccgtgatctcggcctttggctgctcgctcgcctcgacggtcggggccagccggctcaccttctccctctggcgcgacgctcgcggtgcgagtgggctcggggtggcctcggagcgctccggtgcgcccgttcgtgcaaccctggccgtcgtcgtcgcgatgctcggcatcacctggctgagcgcgatcgcgttcggcgcgaccgccttcgatgtcttcgcctggttcggcaccatcggcaccctcatcatcctcgtcgtctacctcctcgccaccgtcggtgcgatccggttgctgttcttcaaggagcacaccgtggcggcgtgggagatcgtcgtcccggtactcgcgggcgtcgtcatcgcctacacgctctatcgcaacatcctgcccttgccgacaggtgccgcgctttggttcccgatcgtggcagccgcctggatcgtggtcggtgcgatcggcgtcatcaccgcacggcgaagcgcggagcgcatcggagcggccatcgcgcgcgacgaaggcctcaccctcccgagcgcgccgacgcccagcagccaggggcagccggcgccggccgactaggcatctctcgaccaccatccagatggggccgttccccacggccccatcccccacgtcacgtcgtctgaacctgccaccacgaaggagttctctgtgtccacgtcctccgagcaccgcctctccgccaacgccatcggacggcgcgaggtcctcttccagagcgtcaccgcgatggcacccggcgccgccatcgcggcttcgatcccggccggtgcaggcttcgctgggggagcgcttgccctcgcggtcgtcgtggcgctgatcggaagcctgctcactgccctctcgatcggtgagctcgcctctcggttcccgtcagctgggtcgttcgccacctacgcatcgaaggcactccaccccatcgtcggcttcttcgttggctggtcctacgtgttcgtctacgccctggtgcccgcactcctgtttctgcagctcggcttcacggtcgcggggaccctccacagcgagttcggctacccggcatcgctctggtggccatggtcgctcgcgggtatcgcgctcgtgggaaccttggcgttgctcggtatctcgacatcggccaaggccgggaccatcctcggcgcgatcgagatctccgtgttcgtcgtcgcagcgatcctgttcatcatccacgccggctcgcacaactcgttgacgccgttcacgacccgagacaccccccatgcgttccccggcctgaccggcgtgttcgccggctccgtctacagcctcctcgccttcgcgggcttcgaggcagccgctccgctcgccgaggaggcgcgcgatccgaagcgcaccgtccgcttcgccattctcggctcgacccttatcatcggcctcatctacgtcttcaccacctacgccgccgaggtcgccgccggacccagccacttcgcgtcctttgccggggctggcgccgagtcgtggattggtctctcgaggagcttcttcggtatcttctgggtgctcgtgttcctcgccatcttgaactcgacgatcggcaacgccaatgcgggtacgtcggtgtcgacgaggatggcctttgcgctcggacgcattggggtgttccccaccctgctcggacgggttcacgagaagacgaaggttccccacgtcgccgtctactcccaaatcatcgtctccgccgtcgcaacactcatcctggggctcgccttcggaccggagaacggcttcgctctcgacggcacgatcatcaccatcgtcgtcgtcgcggtctacatcgtcatgaacctcgctgcactcgtctacttcgcacgtcgcgcaaatggagagcgcttcaacccactcctccacggcctcgcgccgatcgtcgccatcgccttcctcctccccgcgctcctcgccggggccggcatcgctgtcttctcgttcatctcaccgctgaccccaccggcgtcctacgctggtcccatcgtcgccgtgtggctggtcgtggggatcgtcgtgttcttgaacctgcgtgcacgtgcgccacaggccgtcggacggattgccgaggtctacctcgacgacgtcctcgatgtcgaggaggcatgagatggcagtaccggtcgtttccttcacgccaacccctgaccagctgtgttggaccttcgggggagcagaccccgtcgcagagatcgaacccggcaccattctcgaagtgttcaccgaggactgctttgctggacgggtacgccgcacgacggacctcgtctcggaggtctgcgagttccccttcctcaatccccagaccggcccgttcgcgatcaagggcgccgagcccggcgacaccctcatcgtgcacttcatctcgatcgagccggcacgagactgggcggtctcgacgaccgtgccgctcttcggcgcgctcacctcgacccacctcaccgcaacgttgcagccacctttaccggagatcgtgtggatctgggaactcgatcgcgagcgccgcacgtgccgcttccgagcgtcgaagggcgacaccacgatcgagctccccatggacccgatgcacggaacagtcggggttgctcccgcgaatctcgaagtacgctcggccctcgtgcctgatgcccacggcggcaacatggacacgcccgagatgcgcgcgggcgtgacggcgtactttggcgtgaacgtggagggagcgatgttctccctcggtgacggccacgcgcgccagggcgagggcgagagctgcggggttgccgtcgagtgtgcgatgaacacggtggtctacgtcgatctcctcaagcagaccgcaaccccgtggccgcggctcgagtccgatcagttcctcatgacgaccggctcggctcgaccactcgaagatgccttccgcatcgcccacaaggacatggtggagtgggtagcggatctgtgcgaactcgacatcatggacgcctaccagctcgtctcacaagccgcgacctcaccgctggccaacgtctgcgacacgaactacaccgcggtcgcgaaggtcgatcgaacattggtgccgctccgacacgacccctatgcgagcgcccatcgccgagcgcgcgctgtcgcggcagaccacgcatccagtggatcgctcgactgaaatctcggatcctacgactccggggcctagcacgataggtagctccgctcccgctcgacggcgaggagactctgagggttcgatcgagccaggaccgtacgcaccgctgctggaccctgggcttcccttcgacaagttcacgcgctgggtttggtcctgtcctatcggcgagacgagaacgaccctatgcagcacacttcgaccccacagcacgagcgacggtgcccgatggccacgggcgcctggatcagcgttccatccttcggacgctgctaaggtaccgaccaatgcctagtctcctgcgcttccccgtcggtcaggcggtttttcagcttccagaacggcttaccgaggtcaactcatggcacgggcacatccccttcgccttctggatcgtcgaagcactcgagccgtcggtcttcgtcgagctcggtgtccaccgcggggactcctacttcgccttctgccaggccgtcaagtctctcggacttgacaccaggtgctacggcgtggacacctggaagggcgacgctcacgccgggttctatggggaagagatctacgaagacttctctgcgtacaaccgcgagcactatcaagacttctcaaagccattacgcaccacatttgccgaggctatcgagcagttcgaggacggcagcatcgaccttctccacgtggacggctaccacacctacgaggctgtcaggtcggactttggatgctggctccccaaactgagtgagcgggccgtcgtgctcttccatgacatcgcagtcaccgaccgggggtttggcgtctggcgcttctgggaggagatcgctgcgcagtacccttccttcggcttcatgcattcctttggtctcggagtgctcggcgtcggcaaggagctgccagacagcctagctagcttcttcgaagacgccaaagcgaaccctgagatcctgcactccttctatgaggcgcttggaacgagatgccaactcttcggcgatctccagcgcgctcgagatgagcttgcgaataccactgcagccccagctatttccgaggaagtagccaccttgcgccaacaagtactcgacctcacctaccgctacgaacgagcgctcgagcgtaaggaggcggaggccgaacagttagaagccaaggtggtagacctcgaggcacgccttggccagtcgtcgcactcggccgcagccctcgcagaacaccttgcgtcagtcacggctcaacgcgacgagatcctccaatcggagacctggaaactcaccgctcccgctcgcggcttcctctggtggatgcgtcgagtggcgaactggagacgcttcacacagacgttccgtgtcacactgcagccccttcagggtgttggcgagtcactcttcgagaccgacagcttcgtggctctcggtggcagaatgcgctttgcaatcgaaggcgcacctcggcctcccgggtggtacgagctgacttgcacggtcaccaccacctccgacctctcgaaaatgcgcccctacatcatcaccgagacacaagaccaccaacgctacagccaacagattccaggcaaggtcgacccagagggccagatccgagtcctgttccacgtcaacaagcaagctgctcgccacgagctgctgctcgtgggcctcaacgggatcacctccatttccgcaccacgcgtcaagccagcgctgcaccttggcgagccgatggctcgcatacttgccgccgcgattgttcccacaatcgcgtacgcagacctgccacccatcgcagctcatcaagagctcctcccgcaggaggacgagttctcccgctggatcgaacgcaacgagcggatcaatcaagacgaccgagagcgcgtcgcccgagagctcgccacctgggaacacccaccactgatctccgtactcatgcccgtctacaacacgccaatacggcacctcgtaaccgcgatcgagtcggtacgggcgcagtggtatccccactgggaactgtgcatcgccgacgatgcttcaaccgatccagagattcggccgatccttacccgctatcaggaggcggatccccgcatcaaggtcgccttccgagacgagaatggcggtatctcggcaaactcgaatactgcactcacgctcgcgaacggcaagtttgttgcatatctggatgccgacgacgaaatctccgaagtcgcactcctccactacgctcgagagattcatgagtatcctggagtcgagttgctcttctgcgacgaagacaagatcactgaagatggtgatcgctccgacccctacttcaagccgagcctctcccccgcgctccttctcgggaagaactgcgtcactcacctcggcgtctatcggaccgacaccgtccgccgcctcggcggaatgcgctcagagtttgacggatcccaggactgggacctagcactacgctttcttccgatcgtcggtatagacttcacgcgcgcacgtcgcatcccgcggctgctctatcattggcggcggatccatggctcgacggcaaccacactccgatcgaagagctgggccgttctggcggggcggcatgccgtgcaagactacttggatacagcagtgccaggtgcgaaggctgagcccattccgcgcgcctccaatctcaaccgactcgttctcccgactccggatccagctccattagtttcgattcttctgcctaccgcgggaaactatcagctacttcgcggctgcctcagctcgctcctcgaacgcaccgactacccccgcttcgaagtgcttatcacgatcgactccgacaaccccgacgcggactcgctcgcataccttgacacccttgagcacaccggaaaggtccgggtgatccggcgtcggcgcccgcctggcgaaacctttaactactcccggatagtcaacaacctcgctcgctacgcagcagctgacctcctcctgctcctcaacgacgacaccgaggtcatcaacgctggttggctcaccgagatggtcgcggtactatcgctgcccgacgtgggcgtcgttggcgcgcacctctactacgccgacggcagtatccagcacgcgggggtgatgactggacaccacagggcgctacatctttacagcgggctgccgggcgcaagctggggatactatgcagacttactactcgcgcgcaacgtgagtgcggtcactggtgcttgtctcctgacctcgcgtcgagtctgggacgaggtcggtgggttggacgagcagcttgcggtcagtttcaacgacgtcgcctactgccgcgcagcgggcgcactgggatatcagatcatcgtcaccccgcatgccaggctcaagcatttcgagtcagtgacccgaggcttcgacgacttgacgttgccccgcaggtcacggctcgcatcagaatttcagcgactcgccacactgttccccgacattgccgcagctgacccgttctacaaccccaacctcgtccccgaagggcaatttcggcttcagtatgaatcgccgataccggtggtctaaactccttcccccgcttgttgtctctgccgactaagcaacgtggcacccaaagacgcaatcaatgtcacaaccatggtacctctaagctggaagcacggctgctttccgagaacaccacgaagcccaatgaagatatcccagccgagaccatccggtcagcgctaacttattgagcccgacattgaatgacacgccctcttgtgaaggataagcacactcttgttcgcttgatagtgtggatacaggccctgagcgtctctgaacagcaatagcatgcgggcttcgccgacattggagatgcgagagcaagcgccacaatcgcgcttcaccctcgccacgaaggctgggcttcgccgatttgcttggcagtcggattgaggccaacaccacctcctgaccggcccaagagagctcgtactcgccggccgttaatatccaagcgtcgagtggaggcggaccgtcttgtagcggtggatccgcgtagcgtgggcttccccccatgtgcttgacagtctgaattgaggccacggccgcctcctcccgggcccaggagagctcgtactcgatcggcggtcggtacccgaggctcgagtgcagccggaccgtgttgtagcgctgaatccagctagcgatggcagagcgggcctcgtcgaggttcgcgaagcggtagcgagccaccagctcccgctcgcaagctcccgaagaaggcctcggccacggcgttgtcgtagcaggttgcgaccccgcccaccgactggcgaagcccgagcgtcgcgcagagctggcaaaccttccgggagaggtactggttggcgcgatcgctgtgaaagatcgccccagcgaggctgccccgggtccgaagagctccgcagatcgcctcgaccaccaggtcatcgggaatgcgacgctggagcgaccagcccacgatccgcctcgagccacgatctgccaccgtggcgaggtagcagaacccttcgtcgtttcggccgtcggtgatgtcgctcgcgtagtgactcctggctcgccaggggcggagtcctggcagacgagatccgggaggggtgcgtcttctccccgcctcgtcgtgactacgaagcgccagcgtgggcagctgccatctcgagctcgcgcattaggcgttccactcgcttgtggttcacgcagtaacccacgtcgtcgcagctcgtgggtaactcaggggctcgacgtaggtgccgtcgttcgcctcccagacggcccggacttcgctgacgagccaggtgtgctggggtcctcggctcggtcccgacggtgtcgccaggcgtagtaggcctggcgggagaccctggctgctcggcatggcaccgctaccgggacgccattggcctcctggttggcaaccggagtggtagcgggtcactggttgccccccgcaggatccgcaaagaccaggcaacgtttcgccaggtctcgttccatagtgagctgcttgacctggcggcgcaggcgggtcatctcctcgcgctccgcgctggtcagcccctctcgcttacctcgatcgatgcgttcctggcgcacccagttgccaagggtctgctcgttgatgccgagctcacgggcgacgtcggcgatggtgcggtgctggtcgaggacgagagcggctgcgtccttgcggaactggctggggtaacggccgcgtcgtcgtcgagcggggccgtcgcccggtggtggtggcggtgtctggtgcatcccttcctcctgtagcaggtgtcaacctggaggggtaaggccaggggtgttgcaagaccgattgaaccgaaccaccaatcgtttggacgtgaccgctcgctggacctgtcgtggcgggtctggccgccccgagggggcactagcgtgtcgacctcggatccaccgtgaagttggtcccggctctgaggtctgctcagaccgaccttggctccccactcaacccgaggtgctcgtgtttcgaccaaatgcatggatgcgccgcagtcacctcatccttgaaacgaccaagacccgctctcgcacgagttggctcccgaccgttcacctcactctcacgctctccgccgccgaggtctcggggccactcgtcctgaagaacccctcccgctccgtgcttgccctccgcgccgttgcgcagagcgctggccagacccttcgcgtgagcgcgacgggccccgagagcgcaagccttccggagcccgatggccgttcgctgctgctcgttggcccaggcaagaccacgctcaccatcgaagacccgctcgacgccccagcgaccctcttgatagcaccatcccgggaactcggcgagtctgcgcgcgatcttctcgacgaccgatgcgccgcagcagagcgagctcgcaccctcgcgcggcgattgctcgccctcaacggtgagagcgagcgactccaggcagcccagcgacacacgaacgacccgtcgtccaccctgccagatccacttcgacccctccgcgaggtacgactcgacggccggcccctcagaccgaccgagctgcacaccttgcttgcacgggcgacagtcgaaccctctcctccgtacacgtcgatcgccgtcgttaccctcggtcaggcgcaaactgcagcagccacggtcgactcgctgcgcgtcaccgaccccggcccatggcgcctgctcgcgtcagaacacgaacccaccctcgtcgcaaccgataccggagtcccctcgcgtatgctcgcggacaccgcagccgacgacgccctctccgacatcgatcacgttctcttcctgcccgctggggcaacactcctgcctggatggcgagaagagctcgccagagcgagcgccgacctcacgcttctgggtgggatcgaggtgcgtcaggacgtgggagacgttgtcctgtacggagagctcgatcccgtcctcctattctcgacgccagcgttcggcctcggcgtcgctgtgagacgcgatgcactgcctgcagaggtaccgctgccacatggcatcgaggggatctgggggcttgttgccgagctcgtccagcagggctgcaccgctgcaggcaccgacgcactcgtgctcgtcacgccgccttggcccaggaatgcggacgaggcgactgcgctgcccgaccgcctcgctggactggtgaacgcagagctcgtcggcacctcgcagactgagcacagccagtggcccccgattgtgctccaccaccgccttcggccgccctcgtgggcgagtgtctccgtgatcatcccgacgcacgacgcgccccagcaccttgaagcggccctgcgatccgtacgcgaggcggactaccctggcccggtcgagctcattctggtcgcccatcgggttcgcaacccagacgtagagcatctcctcgccgacgcgatgacctggggggcgagcgtcgtccgcgacgacggagccttcaatttctcccgcctgatcaacaggggtgctgagcatgcgaccggagaactcctgttgttcatgaacgacgacatcgcgccgacgggcaccgactggctgcgcgagctcgtgagcgcccacgttgcccacggtgcacgcgtcacgggggcacgcctgctcagcgccgacggtacgcgcatccagcacctcggccaggttcgctctgcactgggcacgctccagcacctgcacgtgggtcgacctgcggaggatctcggctactgcggccgcggtgctgcgaccgcctccgtcacctcggtgaccggcgccctgatgctggtggacgcggctcgattccgcgccgtcggtggcttcgacgagcgctacgacgtcgccttcggcgacaccgatctcgtcctccgactgcgtgcaaacgggggcagagcgatcgtctgcaccagcgcgacggctctccatccagagctcacgacgcgcggctcggacgcacggccagcacggcacctcgggttcgcctccgagtcgatggcgtttcgccgcgagcacgggtggcagctcgccaccgatcgatgcctcgccccgcgtctccgagcacgcgacgacacccttgaggtcgtgcccgcaacggggcgccacgagtgcaatctcgtcgccgtgcagctcggcccagaggacgctgggggtggtttcgacgtcgtcctgctcgactccgagaccgcgcagatcaccctcgagatgccgagcgacctaccgaccaccgagatcgtcgggatcgaactgcgcctcacgctcctcgggggtgacccgcaggcactgaccgccacgctcgacgggaccccactctcgtggcacccaagggccggtcatctcgccgacctccggtgcgacgagggcgtaccaacggccggtcgacaggtccaccacctcgacctcgtccccggggcagagctcgcgagcctgcgcgtcgtacccgcgccgacggcccaggtgaccgctccaacgacccgaggactcgagctcgcctgcgccgcgaccgcctgggtacgcctgcctcgccaacaggtcccgatgagccagccgcacgtctgagccactacctgggctcgtcatgcgtggggcgccgaggagtacacagcactcaacggactcctcgcccactgggcggcagcgtcgccgcctcgcgccgcaagtccgacgatcgccgacccgagaacgtcgctcgctccccaggtcggtggagacctcggtcaaccttggcgcactccgatgcgactcgcaccagagcgaccgaacgtctgtgcaccctcgcgaggagccacggccttccggcagcccatagacgctcaacccggacgatgcccccgagtcgctccacgaacgcaacacgatgtctggcgcaagagcgggagggtctgatgcgaacgccgggccctcagggctccccgcagccgcgacaagacgggcatggcacagctcacgaggagccgaccgatgccctggccgccagtcgctcgtaggtcgcaagcagggtactccaccgcgcacgcacggcgtcgtagcgctcgtggacttgggaagcatcactcgccgcatgaggggcgtcgccgacgtcgcggggtgtgcggatggctgcgcacagcgcatcgacgagttcgccaacgagcaggggctgatcgctccggacgacgacacaacgacgatcgaggtctgcgtcgtcaacgaactcgacggtcggcccctcatcgtcgacgaccaccacgcacagcgatcgctgcgcaagctctctgaggacgcgggcatcgggcaggggccgcacccacaccctgcgaccagcgagggtcgtgacagcgcccggtgcccgaccacctcccaccagtcggagaaccccgtcgatgtccgtacacgcctgcgcggcaaggcgcgccacgagcgggccgcggtcagggcgagggttgggctcaacgagcaccacgagccgatcgagacgaggcgccggaccatcatcgaggtagagccacgccggatacggctcgctcaccacctcctgatcgcgaaggacggcccccgatgcagcgacccacctcgcaagagcaccatcgtgcacgagcacgtcgtcactcccagcgacgaccgtgagcagatccgtcgtcaggggcctcaagcgtgtcccgagccggagcacggcatcctggtccactggcccagcaacggcagccgccacctcggcgagtaaccgcgcgacgtcgacgtcctgagcgtggagctcgacgacccgtcggcctgaactcgtgagcaccgccgggacctcaccgtgcaaggcatcgggtgcgagcaccagctcgtggagcgtacagacaggatcggggtgacctgctcccagttcagtccgcagcagcgtcccgacgatgccgtccgactcccagcctggcgcctggagctcgaggtcaaagcgagcatccagcacgcacgcgagctcgccgaggtacgaccgcaacccatgggctcgatcggcaccccagcgtccgtcgggctcgagtcggggcaagcgcagtgccagcgtcggtcgtccggactcggtcacgctcggcgtcccgagcgccgcaccgatcgcgtccgcgctgcgtcgccccacctggtcccacgactgacgctgcacgtgctggcgctggcgctcgaagagctgctcgcgccaccccgacactgcggtcaattgtcgcagcagaccgaccaggtctccgacgtcacctggccgaaagagcgcctcgggagttcccagcgcctccgggagtccaccgacgtcgctcgcgagcaccggcgcaccacacatgacggattcaaccgccgggagcccatacccctcgtcgagcgaggggatgacggtgcaccaggcagacgcataggcgcgcaccagctcctggtcgctcaacccatgctcgacccgcaagcgatccgacgggatccccgccctttcgccataccggcggatgcgcggtgcttcctcctcgttggtcacaaggtgcactcggagccggtcgtcctcgcgcatcgcgatggcggcggcgtccaccaggacctcgggccgcttgcggtagtcctgatggtagacgtagagcagcgtcctcgacgcatcgtcaggggctcggtctccacgcacctcacccgtctcaacgccgccgaacggcgccgagccgacgacgtgcacgcgttcgggctccacaccgaggagggtcgtgacgtcgagcgccacggcgtgggagatgcacagcagggcgtcgctcgcccgcaggacgtcgagctggcgccgataccaggcatagaaagcagggtgcggcgcgagatacagcgccgggtgacgaagcgggatcaggtcgtagacgacgctgaccagcctgcgtgcccagtgaggacgctcgctcggggccatcgtcatcgaggtctggaagccctcgaacggactcgcgaccaccagcacatccacctcgccgggcgaggtacgcgtccacccgctcgcgtcgatcggcatcccctcgtggccacggcgcggctcgtgcgaaatcggcgtccaccgctgacgagctgcgcctgcttcctcgacgcttgcgcgcaacgaaagtggcaccggcacgttggggctcaccagccacacccactcggtgtcggggtcgaacgaacgaacgagcgctcgcgtgaactcacgcacccagcgtccaatccctcgattggcactccccccttgcgcgccctgaaggtcgacggcgacgcgcacgtcagcccctctctcgaagctcgggagccagggtacgacgttctggtgcctcgacggctccgagccgatgcttgacatcggcgacctcacgcacgagctgctcagacagcgcttcgagcgaggccaatgcctcgaggcgcccgtaggtgtcctcaagaagacgtccctgggccttcgtgctctccctcaccgcagactccaggtcgccgaggaggcgctcaagcctgtcgacgcgctgggcgacctcgaacacggctcgccgcgtcgcgggggcccgcacctgcgccgcaacggcccgagcaagggaaccggtgagtccgccccgcacgaggaccctcgcccgtgccacaagctgggtcacgagtgggggtgtgacatggcgagcggggccggggtggccatctgctcccggagcggtccgctcacgccacctcgcgcggatcgccgcgtccatcggcagtgcatcgaggatctccaggagctcacgcgcaccgtcatgccacgtgcgatcgacgatgagcgggtgtgtcggcggattggtgatcccgacctcctggatctctccgaggagcgcagcgagcgcggaggcgtcgcccggcccgacgaatctggcatagccgtcgaagagttcgcgatggaccggaatatcgctcaagatcagcggtacgccattgaccgccgcctccacgctcgggagatcgaaaccttcctcgaccgagagcgagaggagggcgcggcttcccatgatggtacgccacaacttctcgtcagaggcgtctgcaagccaggtcaacggccgcccggcctggacgagctcctcgatgcgagcgccgatatggttcgcacgccatcccaaccgaccgacgatgaccagggggaccgatccacctgcctgccagtgagcctcgaagccgtcgaggacggtcgtgtagttcttccggggctcaagggtcccgaccgcgacgaccggaccgctctgtacgtcgacgatccgctgtgcagagggctgccgagcatgcatgcccgagagccagcagacgcgcacacgctcagcggccagctcacgccacggcaccgtccgcgccagcatcgctctcgtcgcctctgccgtcgatcgcgagaccgcgacgaccccgtctgcgaacgtccctacctcgagcatccacagaccgaactggcgcacgagaccttcgtcggcggtccaggagtgggtgagagggacgacgtcgtgctgcaggaccgcgagtcgcatcccctcgagccaccacggggccaagcgatagctcaggcccaggtgccagctgctgtcggcgacgaagacgaggtcgtcacggctcagctcgagcggccgcctgggcacgccgagcggcttgtcctgcgggcgagggatgcgggcaagctcccagaccgtcgggccaacggcctcgccccccaagctgcccaccaccacgtctcggccacgacgacgaccctcgacgacgagcgcctctccgagttcgcggacgaccctctggatccctgtcgctcgccacggttcgcgatcgatgtaggagcagtcccagatgatccgacctcgagcttgcgcggacccctgcgacgcgttcgaccggcgagaggggctctgcatgctcccgcatgctagcgctcgcccacccgcgcgactagccagcctccgagagacgccgacacctgcggagacgagcagcgcgagggccgaagccagtgcgccagagggcgaggcccgacgacccagcgcgacgaccgacgacgacccaccggccccgggaagccgacaacgggcacggggacggcatctgcgccaccagagacgagcaacggggcgggggcaatccgtgcccccgccccgtcctgatgcctcatcgcatcgtgcgcacatgcaccgacctatgcgctgatcgaacccccggctgtgaacgggcccgtgtcgccaaacgccggacccgatcccatgtactcggcattaccgaaggcgaacacgccgccgtcagccgcgaggagccagtagcccatgccgtcgggggtgggcacgaggccgatcaccggttgggcgagcgggtgagctccgtgcaagccggtgagcccgtccgtgtaggtgttccccatgtagtgcgcatcaccgaaggcgaacacgccgccgtcagcgcccaccagccagtagcccatgccgtcgggggtggaggcgatgccgacgatgggggcggcgagcgggtgagctccaccgagccccgtcaggccgtccgtgtaggtgttccccatgtactcggcatcaccgaaggcgaacacgccgccgtcagcgcccaccagccagtagcccatgccgtcgggggtggaggcgatgccgacgatgggggcggcgagcgggtgagctccaccgagccccgtcaggccgtccgtgtaggtgttccccatgtagtgcgcatcaccgaaggcgaacacgccgccgtcagcgcccaccagccagtagcccatgccgtcgggggtggaggcgatgccgacgatgggggcggcgagatgcgtcacgccagccgtttgcaccgatccgtagctgggcgcgccacccaccgacatcaccatgccgctcgccgtaacctcccagcccgcaccggccatggcggggtcaggcgcatagcccacgacaccgctcgcgggtgccgccggctggccagtacccagcggaccgaagctcgacacgtgcccattgccccgcacgaacgcgtacgaaccgtacgcggtgttcggcgccatcagggcgttcagcgtcgaggagttcgagtcgtcgtagtagacctgcagctgacccatcgcgttcgtcgcggtggcgaggccgaagaggccgccggcagcgccggtgtcgagcactcgggtcgcgacgaccatcccgttcatcgggttgatctcgagcaggtcgttgttcgtcgcaccgttcacgacgagaagatcgccgttctgcggattgatcgcgatgttctgcggcgactgcaggagtgggctctgcgacacgaccatgggggtctgcggcgtcgtcgcggtcagcgcgttcggaatcgcatagatggtgttgttcacgtcgtcggcgacgtagagcatcccgttcgccgggtcatacaccatgccctgaggcccaccggcattggacgcggtttcaccaccggagacgttggagttggtcgggagccctgtcgcgagcgccgtgtaggtggcgttcagcggctggccgttggacgtgccggtcgggttggggttgagccgccacacctgtccgtcagcgccggtgttcgacacggcgacgttcgaccagaagaaggcacccggtgcgaccgcggccccccaaacgcccgcgaaggtcgagtttgtgctcgtgtagttcgcaatcagcgtgcccgaggagttgatcaccgcatacccagaacctgaaccgttcgctgtgctcccccagtagccgacccagacgatgtcgttcgaggggttgatggcgatccccaccggtccggtgatgtcggcgttctggtagaaggtggtcgattgaccggtcgtggggttgacctcgacgatgctcgtcccagcaccgaacgtgccggccgacgagttgaaatctgccacgagcacgtcgcctgcgacgagattgcccatcgtcttcggtacgacggcgacgccgtagggattcgtatcgttgttcgacgctgtcgcggacccgaccttcacgttggcgagctgggggaacagattgcccatcggactcgtctgcgcaacgagcgctgaactcgagacgcccgcgagggcgagcagcgcagaagcggcgaccacgccgccactcgcaacgccccagcggcgcttccacggactccttggcatgagggacctccttggcaccactcgtcagcggccgccagcagcacacgccccatggggtgtgtggtctgcggccacggcacgcttctacgtgccgagaggaggtacgtacgaggaccccagaacgttcacggatccacgccgacgggcctcatcaacccttcagcattggccttcagcattggaacgtgccggggcctcgtcgcgccggagtggctcacgccgccttgacggccgcgacgagggcggcgagcgacgccttcgcgtcgccgaagagcatcaccgtcttcgggttgtagaacaagggattgtcgaccccagcgaagccaggccgcatggagcgcttcaagaacaccaccgtcttcgcctcgtcgacgttgaggatcggcataccgtagatcggactcgacgactgcgtcctcgcggcagggttgacgacgtcgttcgcgcccacgacgaggaccacgtcggtggtccggaactcgtcgttcgcctgctcgagatcgtggagctgctcataggggatgtccgcctccgcgagcagcacgttcatgtgacctggcatgcggcccgccacgggatggatcccgaagctcacctcgaccccgcgcccctcgagagcgcgcacgagatctcgcaccgtgtgctgcgcctgggccaccgcgagaccgtagcccggaacgatgacgaccttcgacgcataggccagcatggttccgatgtcgtcggcggtccccgatcgaacggtcgcaccctcggggatgccctcggcgccgcccgcgcccttaggcgccgagcccaccgccgcgaagaggacgttggcgagggagcgacccatcgcgtccgacatgagcttcgtgagcagtgtcccggacgcaccgacgagggtgccgccgatgatcacgacggtcgagtggacgacgaaaccggtcgcggcgacggcgagaccggtgaaggcgttcaggagcgagatcacgaccggcatgtccgcgccaccgatcggcagcacgaacgccacgccgaggacgacggctgcggcgaccagcacaccaagggccacccgatcggtgggccccaccgcgaccgcgaccatccctccgatcaccgcgagcagcaagagcgcgttcacgacctgctgggcggtgtaggtgatggggcgcccggtcatgagttcttggagcttggcgaaggcgatcgccgaccccgcgaacgagatcgcgccgatcgcgaccgagagcaccgaggccaccgacgcgagcgtcgcacccccacctcgcgtggcgagcacgctcacgatcgcgacggtggaggccgcgccgccacccacgccgttgaacgccgccaccatctggggcatcgccgtcatgcgcacgcgacgcgccgagaccgcgccgatcaccgcacccacgacgacggccgcgaccgcgagctcgacgaccccggccgagggatgctcaccgacgaggctcgcggcgatggcgatcaccatgccgaccgcggccgtgaggttgccgcgtcgagcggagcggggtgaggcgaggccccgcagaccgaggatgaagagcgacgctgcgacgaggtaggcgatgtcgacggcgacctggcgagcggcgagggccgcgaggatcactgctggctccttcgccccttgaacatctcgagcatgcggtcggtgacgacgaagcccccgaccacgttgatggtggcgagcaccaccgcgaggacaccgagtgtgacctcgagcgccccgtgcgcaccgaagagaatgccgagcgctccggccaggatgatgccgtggatcgcgttcgatcccgacatcagcggggtgtgcaggatcgtcggcacgcgcgagatgacctcgaacccgatgaaggcaccgagcacgagcaccgtcaggtcgttcagctcaccagcggtcatcaaccccccgatcgtcgatcccactcagcctaggcggggcgcgaccagcggatctcgccgccgtcgacgaccagcgtcgcgcgaaccagctcgtcgtcgaggtggagctcgccgtccgtcaccatgagctcgacgaggttcgcgaggttgcgggcaaaggtctggctcgcgtgcgtcgggagctcggcggcgaggttcgacgcgccgacgatgcgtaccccgttcgtctcgacgatctcgccgggacgcgacccctcgacgttgccaccggtgtcggcggcgagatccacgacgaccgcgccgggccgcatcgcctcgaccatcgcgccgctcacgagcctcggcgcctggcggaacgggatctgggcggtcgtcacgacgaggtcggcctcggcgacgcgctcggcgagcagcgcccgctgtcgctcgaggtactcctcgctctgggcggctgcgtacccgccttcgccctcggccgcatcgagcggcacctcgaggaagcgagcgccgaggctctccacctcctctctcgccgcccgacggacgtcgaaggcctcgacgcgcgcaccgagccgccgcgccgtggcgatggcctgcagaccggccaccccggcgccgagcacgagcacctgcgcgggcgtgagcgtgcctgcggcggtcatctggagcggcatgatgcgcccgaggaggttcgcacccaccagcaccgccttgtaacccgcgagcgaggcctgcgaggagagcacgtccatcgactgcgcgcgactcgtgcgtgggaggagctcgagcgcgatggcgccgagtccgcgcttggcgacggcctcgaggatcgcatcgtctgtcgcgagcccgagcagtccgacgacgagacccccggggcgtacggtgtcgagcacctcgccgggcggcggcccgatggcgagcagcaggtcgggtgcgagcgccgcaaggtcggtgagcgtggccccctgttcggcataggccgcatcggaaaagcctgccgcagcgccggcaccgtgctcgagcactacctcgacaccgagccggctgaggcgtcccaccgtgtccggcacgatcgccaccctgcgctcgtcgtgcttgcgctctctcgccgctgcgatgcgcatcgccagccccctgcctccacccgtcccacgaccaaccccagtcccaccaggctaggggccacccgagccaaccgcgccgcgccccttggtgaagtactcgaggctgcgcgcgatcagaccgagttccatcgcgcgcagcaccgcagacgtgcgattggtcgcaccgaccttgtcgaagacgtgggcaaggtgcgtcttgaccgtcgcttccgagatggcgagcgcctctgcgatctcgacgttcgtgcggcctcgtgccacgagctcgagcacttgacgttcgcgatcggagagcacgacgtccgaaccgaggacgcccgccacatccccgacgccgacgaaggcgatgcctcctcgcgccacccggcgcaccgcgtcgtgcaggacggcctcggtggcgtccttgagcacgtagccacgcgctcccgcctcgaccgccgatcgcacgaggtacggatcctcgtaggcggtcacgaccagcggcgcgcccgtcccccgcaccgagagccacgcgatgagccgcaccccgtcaccgtcggcgagacgcaggtcgcacagcaccacgtcgggtgcgacccgatcgatgacggcgcgtgcctcgctcacgctcgctgcctccccgacgaccgcaacgtcaccggcacgctcgagggatgcggtgaggccacggcgcacgatcgggtggtcgtcgaccagcacgacccggatcacgcggtccacgcaggctcctcgatggctcgggccatccgatacggcagacgggcggcgagctcgaaaccaccgtgctctctcgggtgggcctcgaacagacccccgagacgctcgacacgttcggcgagcagcgcgaggccgaggtgcccctcgagctggcgcgggtcggccggagctgcgccgtcgtcgaccaccccgagcacgagctgcgctccctcgagtcgggcctcgaggcggacgcgggtcgcaccgatcgcgtggcgaaggacgttggtcgagccctccgcgagcaaccgtgcggcgaggtccagtaccatcggcggcaactcgagcccctcgaggtcccccaccacctcgacctcgagacccgccgcgcgaaggcgcgccgcctccaccaagaccacgtcggcaagcgcttcgggcgactcctcgcgccgtcgcagctcgcggatcaacgatcgagtcgcctcgagacccgcgagcgaggcctcctcgatgagccgtgccccttcggtgggcgcctcaccacgcaccaagaggaggatgcccacgaggtgttgggccacggtctcgtggatgcgcgcggcgagtcgctcgcgttcgtgcagctctcccatgcgataggcgagctcgcgcatggtggtctgggcagcgcgcagctcgtcgatggtgtggcgcaggagttcctcgtggcgcctcgtgcgctcgaggaacaccgcgagcatggtgcccgcggcgatgtcggggacgtaccaggacacgatggtggcccagggaacaggggggcgagggagcaggtgcgtctcgaggccgacgagagcggcgacccccatgacgaccgggaccgacaccgaggccgccagcagcacgtaggcgaggaagctccaagcgagcaagaggtaggccgcgttcgcatcgagggccaccgccaccagcagcaaggtgccctcgagtcccacgagcagccagcgggcgagcccaggccgctcgaagccgaccctgccgagcgcgagccacaccgccaccatgagtgcgaggacgaagccgaccgacacggcacgcacggccgagccgatcggatcgagcacgatcacgaagagcgttcccgccatcgtgacggtgccgagcgcctcccacccgagtcgcaccctgcgtccggtgcctccggcacggccgcccagctcgctggccatggacgcatcgtagcatccgacggcgaccccgatcgggatgcgatcggccgtggtatcgaccctcgacgacgatttgcgtcgcatccttgtcaacaggcgatgtaatccttagactcagagccagaacacacacgaatccgatccaacggaaggatcccctatgacactcgtcgaccgtgatcgtctcggcgcgctcctcgccgacgaggccgagcgcttccgtgccagtcaccccgtgagcgcccagctcgccagccgacggggcgagcatctcgtcggcggtgtgcccatgacctggatgcgccggtgggctacgccgttcgcgatcaccgtcgagcgcgccaagggctcagaactcgtcgacgtcgacggccaccgctacctcgacgtgtgcctcggcgacaccggtgccatggcgggccacagccctgagccaaccgcgcgagccatccgtgctcgcctggagtcgggtggtctcaccacgatgctcccgaccgacgacgccgaggtggtcgcggacgaactcacgcgacgcttcggagtcgagcgctggcagttcaccctctcggcgaccgacgccaaccgcttcatgctccgcacggcgcgccagctcaccaagcggccgctggttgtcgtcatggactggtgctaccacggcacggtggatgagtccttcgtcgtgctcgacggtgcgctgacccgctcgcgcccggggaacgtcggccccgccgtcgatccagcgacgacgacccgtgccgtgcccttcaacgacctcggggccctcgaggccgcgctcgccgaccgccaagtcgccgccgtcctcaccgaacccgcgctcaccaacatcgggatcgtcctccccgatgagggctacctcgaaggcctcgtcgagctcgcgcaccactacggctcgctcgtcgtgctcgacgagacccacacgatctcggctggcccgggaggcctcaccggcaagctcgggctccgtccggacggcgtcaccatcggcaaggcgatcggtggcggcgtcccgatcggtgcctggggacttcgtgccgaactcgccgacgccatcgtcgccgaccgagacgccgacctcgaggacaccggcggcatcggcggcacgctcgcgggcaacgcgctctccctcgcggccgcgcgcgcgaccctcaccgaggtgctcaccgaacgcgccttcgacgagatgggtgcggtctcccacgaactcgtgcgacgcgagcgagcgctgctggccgaccatgggttcgactggagcgtcgtcgagctcggtgcccggagcgaggtgcgcttcgtgtccccgcctccacgcaccggggccgactcggctcgcgcggccgacgtcgacctcgaccgctacctccatctcgcgctcgccaatcgcgaggtgctgctcacgcccttccacgcgatgacgctcgtggcgccgacgacgacgctcgcccacgtcgagacctacctcgacgcgctcgccgatgcgctcgcgccgctggcgcgctgacctactggccctggcccatcgagaagccgggtacgccgtcgaaggtgaagagcccttcgaccttgacgaacgcgaggccggcttcggcgagcgcgccgaggagcgcgacgccctcggcgggcgccatcgcaccggcgtcggtcacgaaccggcaccgccaatggtcgacgcagaaggtctccggcaacccgtcgggccagaccttctggccgcggttcgtgatcatgtcgaggcgaatcccgaccggcgcggccgccgacaaccgctcggcgagctcgtcgacggtgccggtccactccacgaagacatcgagaccgacctgcaccttcaccgacgcatgccgtgggctgggttcgacgcggatggcctcggcgctcgcggggtagtgcaccacgggcagcgtcgcaggcgaggccccgagccgctcgatgaccgccgccgcgaacccctccgtcgagaccttggcccgagagcgctcggggtggtagacgtcggcggtgtggatgccgtcctcgatggtggcgagccatgcgttgtggacgcgctcggcgacgtccccctgaccgacgtgcacgagcatgagcaccgcagccaacaggagtcccgaggggttggcgatcccccggccggcgatctcgggcgccgagccgtggatggcttcgaacatggcgacctcggcaccgacgttggcgctcgcaccgagccccacggagcccgcgacctcggcgacgacgtcggagacgatgtcgccgtagaggttcggcgtgacgacgacgtcgaagtcctcggggcgtgccgcgaggcgggcggtgccgatgtcgacgatcaaggtctccgtctcgaggttcggatactccctcgccacctcctcgaacacctgacggaacaggccgtcggtgagcttcatgatgttgtccttgacgaggcaggtcaccttgtgacgaccgtggcgctcggcataggcgaaggcgtagcgcacgagtcgctcggtacccggtcggctgatgagcttcaggcactgcaccacgtcctcggtctggcgatgctcgatgccgccgtagagatcttcctcgttctcgcggatgacgaccacatccatgcccgggtgcgcagtctggatgaacggggcgtacgtcgggcaggggcggacgttggcgaacaggccgagtgccttgcgaatcgtgacgttcaggctcttcatgccgccgccgcgcggggtggtgatcggggccttcaggaacaccttggtacgccgcagcgactcccaggccgacggctcgatccccgacgtgatcccccgacgccagagcgcctcgccgacctcgatggtctcgatcgcgagccgggcgccggccttctcgagcacctccagcaccgcgctcatgatctcaggtccgataccgtcgccgtaggcgacggtgatgggggtcggctggtcgcttcctcgtgccatcggcgacggcctccttcgcggttcgcacgcgctggccgaccacggccccccacgccgatgaccggccaggcgttctcatcgtgagggcgctcccccagcgcgcctcggccctcacgctagcggcacatcctcgccggctccaatcgacactcacgccgatcacgcccgcgttcccccgaccggtggcgagcacccgcgcacgagctcacctgactaggatcgccgccgtggtcgccgaggatgccgagcacgccgctctcgacacgggcatcgagtcgcgcacgtcccggcagccctccgcacccacctggaccttcctgacgaaccacggtcatgtgctcgtgtgcatcgcgcgcgatcccggcatcagaatccgcgacatcgccgagcgggtcggcatcaccgaacgagcagcccagggcatcgtcgcggacctcattcgagcgggctacgtcgttcgcacccgcatcggccgtcgcaaccactacgagatcgaccccacgcgcccggtgaggcacccggtcgagcagccgcacctggtcggtgacctcctcggcgccctcgctgcgctcagcgaccacgacaccctgggcagccgccccggcaccgagaccctcacggggtcgtcgacgtctggacgctgaaggtggtcccgcccgacgacgaaccgagcgggctcgtgatgtcgccctgggtagcgatcgagctcgccgtggggaactgacagaccgggttgatcgacgacgccgtcgagtcgctgaaggcgagtggcgcgagcgtgaaggtggtcccgggggttgcgaccgcgagcggatcgaggaacgacgtcaccgacggctccgccggcaactcacacgtccccgtcgacgtggcgaccgtcggggcctcggcgatccactccgccgagttcgcgggccccccgtagctgatcggcgtcgcggcaccgatcgtgacctgctgcgccgtcgtgagatcggcgatcgtgatcgtccactgatcggccccgacctcggtgatcgtcacctccatggtgtcgccgggactcaccgacagggccgagggcgagatgggcacggccggttgttcgttcgacggcgtgatctcctcccaccacgcacactccgccgcggccccagagccacagaatccctcgcccgcgaacgcctggttcccgacggcgacgcccgcttggagcaggtacgaattcgtcgcaccgtccaccccgatccacacactggtatcacagggcacgctgctctcgcaggtcgtcgacgttgtctgcggcgtcggcacgacgaagcgcgtcgacacgctcgtcaccgaaccccgggccgcgccctcgagcgcataccccgaccaattctgcgagacctgctgcgacgtctgcgagccgatcgccacggtccaggcctgactgagggtcgcggtctcgcccgccgagtccgtgacgctgaaggtggccgtcccggaccctgcagcgaggggcacaccgacaagctcgccagcgctcgtcagcgagagcccagctggcaaaccgctcgccgaccaccggtagccgggcacaccaccggtcggactgagggtcgccgagacggcgctcgcgacggcgagctgcgagagtgcctggctcgcactctgggcatcgatcgcgagcggtggcggtggcgcgagatcggggacgatcccgaccacgggggcggcgagggggcgggagccggacaggcccgtcagtcccagggtgtaggtgttgccgtagaagccggcgtcaccgaaactgaacaccccaccgtcggctgccaccagccagtagcccttgccgtcgggggtcggggccatggcgacgatcggggcggcgagggggcgcgatcctccaaggcctgtgagtcccagggtgtaggtgttgccgtagaagccggcgtcaccgaagctgaacaccccaccatcggccgccaccagccagtagccgttgccgtcgggggtcggggccatggcgacgatcggggcggcgagggggcgggagccggacaggcccgtgagtcccagggtgtaggtgttgccgtagaagccggcgtcaccgaaactgaacaccccaccgtcggctgccaccagccagtagcccttgccgtcgggggtcggggccatggcgacgatcggggcggcgagggggcgcgatcctccaaggcctgtgagtcccagggtgtaggtgttgccgtagaagccggcgtcaccgaaactgaacaccccaccatcggccgccaccaagtcatacccggggctgatcgtcgccgaggcgagcgcgctccggcccggggccaacgcgtcggaggacgacgagcccgggcgaagggtaatgaaggcgcttgcgaaggcggcagcgagcacgacgaggagcagcgtccgcagcagcggacgagccccccatgccagcgtgcgaccgcccacaccgcctcccgtcatcagggtatcgactcgatctcggaccggctcaagccagaaccgaccataccgaggcaggaaggctcagctcactgtcaacttagacggcgagcgcgcgcgtcgagggctcgatcggccgtggcaagtcgcttgcgcccatcagccacgcatcgacgtcgtgcgcgaccgaacgtccctcggcgatggcccacaccacgagcgactgcccgcgcctcgcatcgccagctgcgaacacccccggaatcgaggtcgcgaagcggtcgtcggtcgcgatggtcccctgaggcgtccgagcgagcgcgcgctcggggtcgatgcggtcgagttccggaccgacgaagcccatggcgagcagcacgaggtcggcctcgatgagctcgtcggtcccggggaccgccaccaggttgccgtcgacgagctggacggcttcggtcgtgagcccgaggactcgtccgtcctcgccgcgctcgatgcgcaccgtgcgacgcgcccagcggcgatcgccgccctcctcgtgcgcgctcgaggtccgcagcagcaccgggtacgtcggccaggggtgtcgagacgaacgctctcgcggcggcgctggcaggatctcgagctgcaggacgtgcgctgccccttggcggtgcgccgtgcccaaacaatccgccccggtatcgccgccgccgacgatcaccacacgcgcgtcacgcgcgctcggtgcgccgacgatcggggtcccgagcgcctcgaggttggccgcgcgcaggtagtccatcgcgaagtgcaccccggctcccgcgcgtccctcgaccacgagatcgcgaggacgggtggagccgagcgcgagcacgacagcgtcggcctcggcgacgagctcgctcaaggtgacgtcggtaccgacgcccacgccggtgcgtaccgtgacgccttcggtgacgagctgctcgagacgccgatcgacgaggtgcttctcgagcttgaactctgggatgccatagcgcagcagaccgcctgcacgatcgtggcgctcgagcagctcgacctcgtgcccggcgcgcgcgagctgctgcgcggctgcgagaccagcagggcccgaacccaccacgaccacccgacgaccgctgcgacgctgggccacgatcggtcgatcgacgccgcgctctgcggcctcgtcggccagggttcgctcgatggcctcgatcgagaccggatcccgattgatcccgagcacacacgccgcctcgcacggcgccgggcagagccgaccagtgaactcggggaagttgttcgtcgcgagcagtcgctctgccgcgcgctcgagctgcccgcggccggcgagctcgttgaactcggggatcacgttcccgagtgggcacccatggtgacagaacgggatgccacagtccatgcatcggcgcgcctggcgctcgagggttgcggggtcgaaccggtcggtcacctcgtgccagtcgcggatccgaagcgctacgggtcgcttgggcggaccctctcgctcgaaggtgagaaatccctgcggatcagcggccatggcgtcgcctccttggctggctcgcgcctcgtcgggtcgtggtgcgcctcgtcatgcgggcatcctcatgacgcggtcggggtgcgctgacgcagggcggcgcgtcccatctcgctccgaacgcgcttgaagtcgcgcgggtagacgcagaggaagcgatcgagagcacccggaccctcggccacgatctggcgcgctcggtgcgatccggtcagctctgcgtgccgagcgacgaggttccagagtcgatcacgctcctcatcgggaacgggatcgaggtcgacgagactctggttcacgcgcgccagcaaccgctcgtcgggatcccacaagaacgcgagcccgcccgacatgcccgccgcaaagttgcgtccgaaccgccccagcaccaccacgagaccaccggtcatgtactcgcacccgtgatcaccgacgccctcgaccaccgcgacggcgcccgagttgcgaacggcaaagcgctccccagccacaccgcgaacgaagcactccccgctcgtcgcgccgaagagggcgacgttgccgacgatgatggtgtcgtccgtcgaccaggcggcctgggccggaggacgaacgatgagccgcccaccggagagccccttgccgacgtagtcgttggcctcgccgacgagctccaccgtgaccccgcgcggcacgaacgccccgagcgattggccggcggctccgctgaggcgcagcacgatggtgtcgtcggcgagccccgcctccccccaccgtcgggtgagttcgtagccgagggtggtcccgaccgcccgatcggtgttggtgacctcggcggcgatggtcaccccctcgccgcgctcgagcgccgcctcggcttgggcgatgatgtcctcgtcgagccgcccggccagcacgtcgggttgggagcgaacccgccggcgcgcctgccccggccacggctccggcgcccacgtcagccgttcgagtccgagctggcgtgcctccggtgcatccacgacctcgagcaggtccgcacgaccgatgatctcgtccaacgaccgggcgccgagcttggccagccacgcgcgcacctcgtcggcgaggaaccagaagaactgctcgacgaactccggccgaccgctgtagcgctcgcgaaggaccggattctgcgtggcgatcccgaccgggcaggtgtcctggtggcacacccgcatcatgatgcaccccgacaccacgagcgcggtggtcgcaaaaccgaactcctcggcaccgaggagcgcggcgacgatcacgtcgcgtgcggtcttgagctggccgtccacctggagggtcacccgatcgcgcagcccgttggcgagcagagtctggtgcgcctcggcgaggccgagctcccagggactccctgcgtgggcgagcgacgtgagtggagccgctcccgtcccgccgtcgccaccggagatcaagatcacatcggcgtgcgccttggcgaccccagcggccaccgtgccgacgccggcctcggcgaccagcttgacgtgcacccgtgcccgcggattggccgccttgaggtcgtagatcagctgggcgaggtcttcgatggagtagatgtcatggtgggggggcggggagatgagccccacaccgggggtcgccatgcgcgtcttcgcgatccaggggtagaccttctggcccgggagctggccaccctcgcctggcttggcgccttgggcgatcttgatctggagatcgtccgccgatgcgaggtagaaactcgtcacgccgaagcggccggaggcgacctgcttgatccgcgatcgacgatcgagaccatccgcgtcagggaacgcacgttcggcgtcctcgccaccctcgcccgagttcgagcgcgctccgatccggttcatcgcgatcgcgagggtctcgtgcgcctccttcgagatcgagccatacgacatcgcaccggtagcaaagcgcgtgacgatggcctcggcgggctcgacctcctcgatcgggaggggatcggccgcctcgcggatcgcgagcaggccccgcagcgtcgcgaaccgccgagcaccctcgtcgacgagctgctcgtagcgacggaacacctcgatgcgcccctcacgcgtggcgtgctgcagcaagaacaccgtctcggggttgaacaggtggtattccccctcacgacgccactggtagaggccgccgacctcgagctcgcgatgggcctctgcctcgggtcgcacctcgaaggcacgccgatggtggtaggcgaccgtctcgtggatctctcggaggccgatgccctcgatcggcgccggtgtcccggggaagtactcgtcgacgaggtctcgcgccagtccgatcgcctcgaagacctgtgcgccggtgtaggaggcgatggtggagatgcccatcttcgacatcaccttcacgacgcccttcgtcgcggccttgacgtagttgcgcatcgcctggcggggcgtcggtccgacgatgagaccggcccgcatgcggtcgacgatggtgtcgaacacgaggtagggattgaccgccgccgcgccgaaaccgatgagggcggcgaagtggtgcacctcgcgcgcgtcaccgcactcgacgacgagccccgcacgggtccgcaagcggtgccgcacgaggtggtggtggaccgccgaggtcgcgagcagggacgggatcggcgcgagctccgcactcgcgtgccgatcggagagcacgatgaccgcggctccgcgctcgatggcctgcaccgcttcgtcccggatccggccgatcgccgcctcgagcccactcggcccctccgccaccgggtagagcatgtcgatggcgtgcgcccgaaggtcggcgtgctcaccgtcctcgtcgatgtagagcagcttggcgagttcgtcgttgtcgaggaccgggtgcgggagaaagatctgtcgcgccgccgtcggctcgggcacgagcaggttctgctcggggccgatggtgcctgcggcgctcgtgacgagctcctcacggatcgcgtcgaggggagggttcgtcacctgtgcgaactgctcgacgaagaagtcccacagtggccgatgggcctccgagcgcaccgccggcgggatgtcggcccccatggatccgatgggctcctccccgcgctcagccatgggggtgacgatgcgacgcacctcttcctcggtgtagccgaagagctgctggcgcgtcacgatcgatccgtgctgtgggatgagcatggtacgtggcgcgaggtcgtccaacgtgacgaggttcgcggcgagccaggctccccacggggccgcgccggccagttcgcgcttcacggcaaggtcgtcgagcacctcgccgcgctcggtgtcgacgaggaacacgcgaccgggctcgagtcgacccttcgcgacgatatggtcgggcgccacgtcgacgatccccgcctcggagccgagcaccaccaggccgtcgtcggtgcgccaccacctggccgggcgcaaaccgttgcggtcgagcaccgcgccgacctcacgaccgttcgtgaaaaccacggcagcagggccgtcccacggctccatgagcgaggaatggaagcggtagaagtcgcgcacgcgcggctccatctcctcgttgtgctcccacgcctcggggatcatcatcaagatggcgtgcgcgaggctcctcccgccccgcacgaggagttcgaagaccgcgtcgaaggaggccgaatcactctcgtccgtgcgcgtgatcggcagcgcctcggcgagccgaggaccgagttccgggtgagcgagcagcgactcgcgagctcgcatccaggcgcggttgccacggatcgtattgatctcaccgttgtgggccaccatccggaagggatgcgcgagacgccacgacggcatggtgttcgtcgagaatcgcgagtgcacgagcgcgagcgcgctggtgagctcctcggcctcgaggtcgcggtagtaggcggccacctgcggcgccgagagcatccccttccagaccatggtccggcccgacagcgatgggaagtacagccacggatgggcatgctcgagccgtcggcgagccaaccacgcatcgatctcgagcgcctcgtcgcgccgtccctgcgtcgacgcgaggaacacctggaccatggtgggctcgctgcgccgcgcggtcgctcccagcacgctcgagtcacgcggcaccgcacgctcggcgatgaggcggagctccggaccgagcccgctcgcgagcgcgtcacgcagctcctcgacgctgcgctcggcgaacgcgatgcccgtcacgtaggcaccctcgtcgggtaggtcgatcccgagggatcgccagtaggcatccgggttctgggtcaagatgccggcgccgtcgccggtgtcgggctcggcgcccttcgccccgcggtgctcgaggttgacgagcgcgccgagggcttgctcgacgagcgcatgcgatcggacgccgtcgagccgagcgagggctgcgataccgcaggcgtcgtgctcggcatcgggtcgatacagcggcggtagcgagcggcctagccggtcgtccatggcgtgggctcctcgtacgtaacgagtcgatgacgatgggacgacgttggcccgtgggcccacgatgctagtggctagccggcgagccacacccccatcacgagagccgcaattgccgagagcgaactcagcgcaccccagagcgcgaggccagctcgcgagctggctcgctggtggagccaggccgcgatgcccgagaacaccgcgacggcgatcttggccaccagcacggcggcgtacgcgccccttggtgcacccaccgcgacgacgttccagaccccggtcgcgagcaacaccacatacgctggccaggcaaggcgaccgaatgccctcgccaccgcgggaatcgcgcccggcgactccttgcgcacggtcgggacgagaccccccagcacgagctgtccaccgacccagatgctcgccgagaggacgtgcagcgagagccgaaccacggtcgaagcactcgcaagcgtgggcgtggcgtgcatacagtctccttcgggcacgtgctgacccaacgttaaccgaggcgccgaggctgcggcatcgtcccctggctgagtccgcgctgtggcactctgccgaggtgacgatcccactcctacactgaactcgtgccccctggtcgcaccaggccacgactggctcaggttcgagcggtggccatccgatgatcgcgagcgtgctcgggttcaacctcgtcgacctcgtgatcttggtcgtggtggggttctcggccgtgcgtgggctccgggtgggtgcaaccatccagctctcctcgtacatcggtttctggctcgggctgctcgcaggcgctgcgatcgcaccgtacctggccgatctcgccccacagggagtcctgcggacgttcatcgccctcgtggcgctcttcggcgtcgcatccatcacctcggcggccgctcgcgccctcggaacgcgcatcgtcggacacgtgcgtcgagcccatctcgccagggtggacgctggagccggatcgatcgtctcggtgatcgcgaccttgctcatcatctgggtcgtggccgcactcgccttgaacgcgccgatcccggcgctcgcctccgaagtctcgagctccgagatcgtgcgcgccctcgacgccacgctccctcctgcgcccagcgtcttcgctcgggtggacgccctcttctccaccgagggcttcccgaccgtcttcgcgtcgatcccgccagcgctcgcgggcccggtcagcctcccgagccaggccgaggtcaaccacgtcgaagcagaggtcgctccgtcgatggtcaaggtggagggactcgcctgcggtgagatccaagagggcagcgccttctcggtgggtccgggctacttcgtcaccaacgcccacgtcgtcgccggcgagcagagcacgttcctcgtgctgccctctggatcacagatcgcggccaccgtcatcctctacgatcctcacctcgacatcgccgtcttgaagacgaccggctacgacgtgcccgccctccacttcgacacgcaggtccaagcgcgcggtacccagggcgtcgtgctcggctaccccgagggcggaccgctgacctacggatccgccggggtgatggcgagcttcaacgcagtcgggcgggacatctacaaccagggactcacgagccgcctcgtgtacgaactcgatgcgatcgtacggccaggcaactccggaggaccactggtgggcctgaacggacaggtcctcggcgtggtcttctcccgatcgaccacgaacccctacgtcggcttcgcactggctgctccggccgtcgcggcagaggtgcacagcgccctctcgggcccgcagaacccggtgtccaccgagggctgcgtcccctagcgcagacggagcccacgacgggggatgtccagcgccgtggtgagcgacgacgaagcccgcgccatcgtcgagccgcggggctcgatacactcgggctatggcaaccccacttgcgccaggcctgctcgagatcgatacccgcctcgggggctggacgcacatcaccgctgggttcgtcgtcgaaggcgcgagccccgtcctcatcgagaccggttcgcagtcgagcgcgcccacgctcatcgccgagctcgccgaactcggcatcagtccaagcgagctcgccgcgatcgtcgtgacccacatccacctcgaccacgccggcggtgtcggcgatctcgcacgagccttcccgaacgccacggtctacgtccatcctgcgggcgcacggcacctcgccgacccgactcggctcgtcgcctcggcccagcaggtctacgggccgctcctcgacgagctctacggccgactggatccgaccccggccgagcggatcgtggcgctcgacgacggccagcgcatcacggtcacggagggactcgagctcgaggtcctccagacgccgggccacgccaagcaccacgtctcgatcttccacgaacccagcggcaccatgttctgcggggacgccgtcggcgtacgcctcccggaggtcggggtgctctggccagccacgcctccgcccgacttcgacctcgacaaggcgctcgcgagcctggaggccatgcgctcgcgacgaccgtcgcacctcgcctttgcgcactatggccgcttcgagcacgctgacgacctgctcaccgaggcggccgaccagctccgagcctggtgcgacgtgggcgagcgcgcacttcgagaggggcgcgacctcgagcaggccctcgccgacgctttcctgccctcgctcgaggtcgtggcacccgaggctcgcgaccgactcctcaccctgagcggtatccacgccaacgcgacggggatcgagcgctggctccgactccgcgacgagggccgcgccggcgacgaggtgcgtcgatgagcgtgcccgagggcctcgtcgaggaggctcgccagctcgcaccggaggtcatcgccctccgacgcgagctccacgccgagcccgaggtcgggctcgccctccccgacacccaggcacgcctcgtcacacggctgcgcgcgctcgggctcgagccggagctcggggcgagcctcggatcgatcgtggcgcgcatcgacggcgcgcggccggggccggtgcggctgctgcgcgccgacatggacgcgctcccgatgacggaggagaccgacctgcccttcgcttcgcgtcggcccggcgcgatgcacgcctgcggccacgatgcgcacatggcgatggcgctcggtgctgccgagctcatcgtgcgccaccgcgacgatctcgccggcgccgtggtgctcatgttccagcccggcgaggagggccacgacggcgcgcgtcggatgctcgccgaggggttcctcgagcgccacggcgtcgacgctgccttcgccatccatatcttctcgaacctcccctcaggcgtgatcgcgacgcgcgggggcgccctgatggcgagcgccgacgagttcgagatccgtctcgtcggcaagggcggtcacgcctccgcgccacaccaggcacgcgacccgatcccagcggccgcagagctcgtgctcgcgctccagagcgcgctcggccgccggatcgatccggtcgagccggcggtgctcacggtcggtcacctggcggctgggaccaccttcaacgtcatcccggaacacgccctcgtgcgcgggacctggcgtgcggtcaccgacgagacgcgcagcgcgatccgatcgctcatcgagcgcgtcgccagcggtgtcgccacggcccacggcctcgaggtcgagctcagctggcccatgaacggctacccggtgacgcgcaacgacccgcgcgaagcagcgcacgtcctcgagctcacccgctcggtcctcggcgccgatcacgcgctcgagctcgagaacccgatcctcggtgccgaggacttctcctacgtgctccagcgcgtgcccggcgccatggcgttcctgggagcagccccacccggggtcgccgagccccatgcgaaccactccaaccgcatggtgctcgacgaggacgccttcgcgatcggcgtagcgatcgaggcagcctgggcgctcgacgaccgatgatcgctgtcctcgccttctgcgtggggctcctcctcggcgcactcaccacggcactcgtgctgcttcgtcgcctcggtgaccaacgagccgcagccgcggatgcgacccgaaccctcgagacccagctcgtcgaagcgaggacgaagctcgcgcagctcgagccgcaacgccttgccgagcagacgaacctcggtccgctcctcgaccaggcccagcgaagcgtcgaggagacggtcaagcgcgtcgtcgccgagcacctcgaccacggctccgagcaagcgatccagaaggccacggcgctcctcgacaaggagttccagccgcggctcgcgtcgctcgaggacggccgcaagctgctcctcgagagcgccgatacgctccgcaagctcgtcgacgagcagcttcgctccgctcgcgagcagatcaccacgacgctgcgtgccagcgggagcgaagccgcgacccagctcagcacgaccctcacggagcggatggaccagctcaagcagctcgcagcctcgatcagcgagcagctcgccaacgaccagcgcctcaccgggaccgtcgaggagagcctgcgcagcttcgtcgccgagaaccaggagctgcgcacgcgggtccacgagctcacccaagccctccagcgaagccccaagcagcgcggcaactggggtgagctcgtgctcgagaacctcctggtcggcgccggcctcacccagcatcgcgacttcgacctccaggtcgcctttcgtgacgacgacgggcgcacggtgatcgccgacgccatcatcaacctgcccggcgaacgccatctcgtcatcgacgccaaggtccagctcgtcgactacctccgcgcggtcgaggacccggcgaacgacaccgccgcacgcgcacacgccgaggcgctgcgccgtcagatcaacgagctcgccgaccatcgctacgaccgcctcgtcgacggcgccctggacgggaccttcctcttcgtgccgatcgagtcggcgctcgcactcgcactcgagaccgacccggcgctcatggagctggccatcggcaaggggatcttcctcgcgaccccgaccaccctcatcccagtcctgaagctggtcggattcctctggcgcggcgccgagcgcgacagccgtgccgaggaggccgagcgcctcgcgagacgcctcgccgacaagatcgcgagcttcgccgagagcttcctccagatcgacaaggggctccaggtcgcacggaacgcctacgaacgggccgagggtcaactgcggagcggccgaggcaacgcgatggcgctcgctcgtcgcctcggcgaagtctccggtcgtagcggcaaggcgctcccggcccccctcgaaccgttcgacgacgctggcgacgacgccagtgacgacgatctcgcgagctctctcgaagagggaggctcgtgagccgcgatcccatcctcgccccgacggacctcagcgccgagctgcagatcctcgacgtgcgctggcgtctcgggaccccggtgagcgagcatcgagcgcgctacgacgcgggacacgtgccaggcgcgatcttcgtcgacctcgaggccgtcggcaccggagcgcatcgccccggagccggccgacacccgctgcccgaacctggccaggtggctcgcgatctcgccgccctcggcgtcgacctcggcgcgccctgcgtggtcgtcgacgacgcccgcggcgcttcggcagcccgtctgtggtggctcctcgacgccctcggagtggaggcctacctcctcgatggcgggctggaggcgctcgagggtccgaggtgccaggatccctgcgatcgccgtgccgccgccaccccacgcgcggtccctgcgacgtggcccggcgagctggtcctcgacgtcgacacactcgcagatcagctcaacgatccgtcgctgtgcgtgctggatgcacgagcgcgcgagcgctacctcggccagagcgagcccatcgacccccgagccggccacatccctggagctcgctcgctcccgatcgacgaggtgctcgcgaccggtcgcttcccagatcccgcgacggcacgccggatcctcggccccgtgggcgatcgcgagatcgtcgcctcctgtggatcgggcatcacggcgtgcgtcctcatcgcactcgcgcgacgcgcgggacgtgacgcccggctgctcgagggttcgtggtcagggtggtgcgaggatcccgcacgcccggtctgccgctcggtctgcggcgatgagctcacgcggggctcgacgcgcacgaactcctgacggactccgccacgatccgtctcgctcgaacgctcctccgtgctcacagtaccggcaatgtccggtcccatcagcgccgcaatgacgtgaaagcatcactcacatgtacggacaagtcacgcagaggtacggacaactctcccacgccaaagccactccctgaggctcacgagtgcgcaaggaactcttccacagcacgccattccctgacgactccttcagcacacgcggccctctcgatcgccttgtcgcgagtttgtaacaatcatcattgcagaacgaccgatgcagctcataccatgtcgcgcatcctttgggctttggaagggggagtgagtgatagcagcgttacttccgtacgcgagttggctgcatcccggcgataattcttggcagttgactgcggccactcttgttgggctgatgtccattcctgggctcgcagtactctatgcgggtcttgcgccgaagaagtgggctgtcaatatcatgaccatggcgttcgtcggtttctctgcagtactcgttgtgtgggtgctctggggattcgacatggccttcgggtctcccattcaccttggcagcggtctctggggttccttcctcggacatcccggcctctcgacgagtgcacacgccgagcagagtcaggcatcgataccactcgtcgacggactcatgccgagctttcggttcccacaatcggccttggtctatttccagttcgtcttcgcagcgatcacaccgctcctctttctcggttcggtctggggccgcatgaacctgaaagcctggctgatcttcgtgccgctgtggtcgaccgtggtctacagcctcgacgccttcctgctctggggcggtgggttctgggctcagaagggagcggtcgacttctctggcggatacgtcatccacctctctgctggcatctcgggctttgtcgccgcggcggtcatcggacctcggctgcaccgtgaccgcgagcatgagcggccccacaaccttgtctatatggccatcggtgccggcatcttgtggcttggttggaatggcttcaacggcggtgatccttactttgctggggctgatgccgcgactgcagttttgaacacgaacatcgccacggcagcggcactattgacgtggctcttcatggatatgtcgtccaagcgcctcaatcgcaagccaacattcggcggagcgatcaatgggatgatcgtcggacttgtggcgattacccctgccgcaggatacgtgaacgggctcggggcgctcgcgcttggcatcatcgcctcattcatcgtgtggtggtcgttcaacgtttggtcgcaaaagggtttgttcaggaaggtagacgatgcattcggcgtcattcacacacatggggtggccgggctcgccggcggtctgctgaccggcatcctcgcagatccacacgtcatcgagtacgtcggcaccggtaagacatcgtcgtcttccgtgaccggcttgctctacggacacccgggccagttgctcttgcagctcggtgctggcctcacggtgatagccatatctgccgtcgggacgttcgtcatcttgaagctcgtgggtctggtggtgccactgcgctacccggatgaggtgctcgctgtcggagacctcgctatccacggcgaggtcgtcaaccctgaggatgctggtgtcgaggtgctcgatgagccaacactcatcgatccagcactccgcgaccatgatccccacggcgagagcgaggagctgcgggacctcgagttggagtagaccagcggactgtcatggcgacagggccggtgagacagtgtggtctcaccggcccatctcctgttcgacgttcaatcgacggcggcttgtccctgcctcctgggcgtcctcacagagtgtcctcggtgagccgatgacggttctcgtcgatgcgtgggcctccgaagccaccgacatcggccgaagtccttgccgcacgagctccgcatgtcccgaggatgcactggtctcggatcgaaccattgtgtggtttgccgtccgtaccgcgcttccaagcttggtcgacaccacatccccgacccgcatgcggtggttggtgccctcgccaccttcggcgttgcccccagcgcgaccgtgcgggcaacaatccccgaccggctcggcagcttgccggtggcgacccctcgacgcacgagcgctacctcggccagagcgagcccatcgacccccgagccggccacatccctggagctcgctcgctcccgatcgacgaggtggccgcgaccggtcgcttcccagatcccgcgacggcacgcaggatcctcggccccgtgggcgatcgcgagatcgtcgcctcctgtggatcgggcatcacggcgtgcgtcctcatcgcactcgcacgacgcgcgggacgtgacgcccggctgctcgagggttcgtggtcagggtggtgcgaggatcccgcacgcccggtctgccgctcggtctgcggcgatgagctcacatcgagccagaggcgcacgacactgagacagcgcggctcgagacaccggaccggtcgctcacggcaccgatcgacgcctggcccgaaggtggcatcgcaatcggcgcatcgagatcgccggccgccacctgcgggggcaaccccgtgagcagtgcctgcacgctgacgtccagccgtaccggcggagcgagtcgtgacgaaggcaggcgagcgccggccgtggcgagcccagcgccatagaccatggtgaggagagcggctgcgaggccgacacccagcgtgcgtcggtgcgcgatcacgacagcacctctcacgccaccacaactcggtccgtgtcgccgctgtcgccgagggcctgctccacgttcgtgggtctagcaccgtggcacgagcaccgcacgagccgtcgctcacgaggtcctcagacgacgaacgacccggtcgtcgcatccccgccttcgccaaccgcacgctcgcagcgccagcgggaggttccggggatcggccggctcgagttcaccgatacgacggccacgagccgacgaccacctggcagggtgtgcgcgaccgggcggctggccgagaacgggggctctgaggcgtggcatcgcgctctgcgaacctctgatgacctcggtatcgtaccgggacgaatccctcgtcgctgggcccaacgggccgagtcacacggtcgacggtccgccctgcaggtgaggtcctgccggactcgtccgcgatcacctcgtacactgcgagggggatggagcgactcacccggctcatgcgccgcctcgaccacctccaacagcgccacaagctcctcgcgatcgcgtttgcgatcgtgcgcaagttcggcgaggacaacgcctccacctgggcgcttctcgtggcctactacggctttgcctcgctggtccccctcctgctcgtggcggtgacggttgcgagcatcgtcttcgcccaccatccgaacctcgtccacgacgtcgcccacagtgccatcgcgtcgattccggtgctcggcgcgcagttcgcaagccgagttcgcgtgcatgcgctcgcgtcgcactcgatcatcggcctcgtcgtcgggatcgccggcctcatctggggagcccagggcgttgcgtccgccgcccagaacgccatggccaacgtgtggaacgttccgctcgtcgatcggcctggctttcttccgaggacgctgcgcaacctcggcatcctcgccgtgctcggcctcggggcgctcgcaacctcggtgatcgccgccctcgcaaccggtctcggccacaccgctgtcatcaccgtcgtcatcgtcgtggccacggtcgctgccaatgctgggctctacgtgctcgggttccgcctgctcacaccggcggcgatcgcgactggcgacctcgtcacgggcgccatcgtggcgagcgtcgtctggagcatcctccaacagatcggcggggtcctcgtcacccacgacctcgcacacgcatcggcgacctacggcgtcttcggcatcgtcctcgggctcatcgcatggttctcgatcgcgaccgaggcgacgctctacgcggccgaactgaacgtggtcctcgtgcgtcgcctctggccgcgctcactggctcctcccccgctcacgacggccgaccagagcgcccttgccgccctcgtccaccagcagcgtgcgcgtcgcgaggagcgcgtcgaggttcacttcgtcgcgggcaacgacgccgtcatcgactcgcaacacgcgccgagcgctgcgcccagcacggccgacgagactggtaccaccgcgacggataccccctgacgcgatgcggggcgccaccacggcgccccgctctccctcatcgagccttgcccgacccatcggcccgagtgctcggatcgatcgacagaagcccggaggcgagggccgcgccattccggcgggtgagggcgagctaccatgaccacgtggcgggtggggcccatcgacgatgaggactcgtcgaccgagcgcaacacgcgtccttagcacgggggcaaggacacgactcctcgccgtggcgaccgcatgcgtgagccttgctcgctgtgcgtcgacggccgatgcccaccacgcgagcgacgccggtcctccgaccgttgcggtgagctcggtcgcgagtccgacccgctcgcgttcgcagcgctcgccagcgcccacagcacctgtccgcctcaccgcctccgataccacgtggctccaagagcccggctcgggcatcggtccctggatgcaagccatcgacggtgctcgccacgtcatcgagttgaacgagtacctgctgacgagccccgaggtgctgggcgcactccgcgacgccgctgctcgaggcgtggccgtctacgtgatcatcgacggtcatccctacgacgacgcagcagcaccgaggatcgccaccaccgccctcgctggcagcggtgtgctcgtgcgcgaggcgcctcgacgcttcgagggcgcctacgcgttcgaccacgccaagtacctcgtcgtcgacccaggcagcgcgcgcgagcgcgcgatcctcggctctcagaacgccaccaccgcagctttcggcaacgaccaggccgaggatgcgatcgagacctcgagcccgagcatcgtcacggccctcgcagcgatctttcgcgccgactggcgtggcgtacccgtcgggcccggtccgcgggcggtgctcgtggtctcgccaggatcgcagccggcgatcgcgtcgttgctctccacaccgggcccatcgccgtcaccgcagaagagctcggcgacgctcctgtgctctctggcgccctcgaacgtgacggccccgaggcacgtctcctcgtcgcgggtcccctcggcgcggcggccgcacggcgagcggccgcgctcgcggcttccggcgtccaagtgcgcacgctcacgcatccctacgtccacgccaagctcatcgtgaccgccgacgcgaccttcgtcggatcgcagaacttctccgtcgtgtcgatgaacgacaaccgcgaggtcggcgtcatcaccgccaacccgacggtgcatgcgctggcgctcgcgtggttcgacgacctctggagccacgcgagcgtggtcgcccccacgtcgactccggcagcccgatctgctccgtcccagtcggctccacccccgcctgctgcgaccacacccgcgccgtcgacaccggccgcaacgagccaagctcccgcacctacgagcgatggcggcgacgctccctggatcccctacggcgcgaccgagtcgcaggtcgaggcgctgtggggcgccccgggctccatcacgaccacggtcgacgacggtgagccagaggtggtgtggaactacgcggccggttcggtcgacttcgagaacggcacggtggttgacgtcgaccgagcgcccgacgacgactgaggcgacgacgtcgtccgcgcccacgatcggacggcggccatcgactgctcgggacaggtggtcggcacctgtcgacgtcgaaagacgagcgggctgtccgcgaccgtcaccgcgagcatccggccccgttccagcgccgctgtcagcgcgagcggctccgaccccgcctcgacacgctgagtcgatcgtatggctcccaccgtcacggcaagcatcccggtccccgtcacacgcccgggtcgcacgctcggcgagcccggacccgacgacggtgcgcgaggtagcgccgtcatcgctggcgaactccgacaccgcgagcacacgcgcgccccgctacgacccttcgacgagccccaccaccgcatcctcgaggacactgcggatcacgtctgggtcctggtgctcacgcagcgccatccaatgactgccgtgggtgccgtcgtcgcacacggactcgatgcggatggccgccgagcgcccccgcctcgaatgctccagccaggcctcgacagtacccatcgtcgtctcgatcgccacgtggccggcctccttcagctcgacggccgcgcgcccgacgaggtcgacgacccacggctcgacccggacgaccggatcggtcggaacagcagggagcgcctcgagatggacctccgcgagcagggcatcgatgagtgcagcgctccctgcgacgtaggtccaaggcagatcgatctccgatgcgacgaaccacgcccgatcgcggggccacgccaggttggcggtctggtatcggccgaggccacgggtggcactgatcgcctcgacaggacccacgtagcagaggtaatcgcgctcgggaaggtgcaggcgaggtccctcgcgcacggctgccgggatcggatcgggcagcggttctggcaccgcgccgggtgctgcaagcagcatgccgccaaagccgtagccgtcccagaggccgaagcagcagtcctccggcgtcgacgtgtgctcgcgcaggagtctggcgagcgcgtccgcgtcgggacgagcgagcctgcctcgcgctggcccctggctgcgccacggtgccggcgcctcaggacgtacccgtgggaacgcgatggagtggaactgggcgtcgggacggagcgtcgtaccggcccaccgagcgacgtccgaccagcgaaccaaccggccatccgcctctggctcctcgacgggatgaaggatccgggcataggccccaaagccagccgggaccaccgaggtgatcgaaccaccgccgaacggcccgagccgacccgcgatccagtcccagtctccgttcggactgacccatctcgctggtgctgtgagctgcctcgccatgagcacatggtagctcgccccgagctgcggcgacggctcatgggcgccccccgtcgccgcgacggtgcccgcggtacagactgaagctcgccttcgcaccttcccacacgtgtgagggcacccggtctcgtgccgggtgccctcgaggtccgcgctacgactgctcgacgggggtggcagcgccgtccgtctggtcgagctcacggctcgccgtggcggccgcgatagagatgtgcggccgggcgatagcaaagtacaccgccccgatcaccacgatgacgaagacgacgagcagcgtgagccagtcgaagttgaacagtgcgccgcgaggtgagttgagcccggtgggggcgacgatgttcacgatcatcgccacgccgtagatcagccccagcaccgccaccgggacggcccagcggccgagctggaacggaccttctggacgccaccctcgcaaccgtgcgatgaggtaagcgagcaccaccatctggaacgagatgtagatgccggacacaccgaagctcacgagcgcagagagggcgttcacgtgtgctggataggtgatgaagccgatgtggatcggcttcgacggggtgaagtgcacgaggaacgacagcagttccgggatgatggccgcgatcaagatggcgcccaccggggtgcgacggcgtggcgagatgcggcggatgaagtgccaccccgggacggcgtggtctcgggcgtaggagaacgcgagacgagctcctgcgccttgcaccgccgtgccgcacgagaagaacgcgaaggtgatcacgagcaagatgagatcctggaagagcttggacgagatcgccgcactcaagatcgcagggacgccccccgtcgccgcgagcgcgaggcccttcggccctgacgggatcgccaggtcgagtgctgcgacgaggatcatcgacacgagccctccgacgacgagcgcgctcaccatcgcgcgcggcacgcgacgctgcgcgtcgacgacctcttcggcgacgtcgcccgcactctcgaacccatagaagatgtagaccggaccgaggatcgcgatcaacgccgcaccggtccaccagtgcccgatgaagttgaccccgagcggattcgttgcgacgtgcgtcgtcccagcgctcgagaacagatacgagaacgagtggtgcgtcgccacggagaacaagatcaccgcgacgcccagggtaccgagcacttcgaaccacgtgccgatccgcgagatcgaaccgaggaagcgaacgccgaagatgttgaaggcggtctggacgacgaggaacccggtcgagatgagcaggatgtcattcggagccgcgccatcccagtgggtgccgaacacgttgttgacgagcgaggcgaagtacccaggcacgccggtgtccacgctcgctaccgtgatgatgagcgcccagccgtacatccatccgacccaccagccgtagccgttgccgagcaggcgcttcgaccactggaacagtgccccggcaatgggataactcgagccgagctcgccgaagacgagcgcgacgaacagctggccgatcaccacgacggggatgagccacaggtaggcaggccctgccgaccccacgctgagcgcgtacaacgagtagaccccgacgaccggtgagaggtagcagaacgcgaccgagaagttctcgaacagcgtcatcacgcggtcgagctcttggcgataaccaagctctgcgagcctcgcggcgtcaggatcgtggtggtgatggtgggaggcgagttcgtcctcccatggtccttcaggcatgctccccccttggcttcgtagtcatcatccgacggatgcgccgccatctgcgcggcgcggattcaagcgacggcgacctctccgtcgcaactcggtgcgtgggcacgatcgcgcacccggctcctcgacatcgtcctggcaatccccctccttcgctccacgctcaccccctgtctgagcgttggcccgatcctactcctccgttgcacctggtgacacggacgtttcgccgagctccgatccgttgacgaccgttcgggcgaagtggcgatgcatccaggccaggtactcgccccgggccgtcacgatacgggtgaggtcccagcgcgggatggcttgttgggggaccgacggggccatgagtcgcggatcgacctcgaacacgtgctcgaagcgttggacgaccacatcggtgatccgccgtggcgtggggaggtcgaactcgtcgcgagagcgaaagctcacagctggcccccttggaacacgttccccttgcggaaatggtacttgccgggattcaagatgccgtgcggatcgagtgcctcctcgatcgcgtccatgatggccaggcttccctcgagctcctcgggaacgacgtcgacatcgccggcgcggcaggcgccgtggcaggcagagatcgaccccccggcgccgacggcaacccgagcgatggctcgcttggcctcgacccacgcgtcccacatcccgtcgtcgagcacctgctcccagataccgacgtcgatctcgacgaggtagtcgacgccggtatcggcgctggtgtaggcgaacgtaccccagtcgtcgaaggcgtcgtagcgacgtcgcagctcctccacgatcgcatgccattgcctggtgacggagacaatctccgggtgattgagggcagcgtcctcgcaatgccaccccatcggcacgacggtgccgtcgagtcggcgcccatggagcggtgttgcgtagcgatcgtggcgtgaggcccagtcgccttgggagatctcgtcgccgaggtagcgtccgccgaggtcggcggcgatgcgccagagccgtcgcccacccgcgcgcacctcgtcctcccagccatacaaggccgtacagaccaccgagcgcaccgaggcgggctgggggatgtaggcctcgtcgtcgcggcgcaggtaggcgaccttggcctcgtcgaagaggacggcgcccgcgaacgttgcgaccccggcgccagcgagggcgtcgacgcactggtgggcatcctcgtagcgtgcaaagccccagaagagggagagctcggcctctggcttcgggtagagcttcagcgtgacctcggtggcgatcccgagcgtgccctgatggcccatgaacagctgcttgagcgagagacccgtggaactcttcgagatcttcggtccgccaccgtcaccgatgcgcaccacgcgcccgtctgccaggacacacaggaaactgaggaccagatcgcgggtgtggccgaagcgggcgccgatcagcgaccagccgctcgtgccgatcctgccgcccaccaggctggtcgggtacgacgccggatcgtcgggatagaacaagccgaacggggcgagcgcctcgttgagcttgagcatgttgacccccaccccgaccgtggcggtgcgacgcaggggatcgatctcgtagatctggccgaagcccttcatgtcgagcaggatgccgccgtgttcggggaccgcaccatcggtgagtccggtgccgccagcgcgcgcgacgaccggcacgcgccgctcgttcgcgagcgcgaggatcgcagatacctcctcggtggtgtgcggcagcacgacgacctgcggaaggtgctcccgccaccgatggaccggaaacggcgccgggacgcgcgtgcgcgcgaggcgcgcccccgcatcggtacgaacgcggtcgggacccacgatcgcgctgagctcggcgacgagcccctcgtcgagacccacggcgaggctcatcggacccaccccggcacctcgatgggcgcaccacacgagatcgcgaccagctcgagcaggtcgatgaccgccatgccccgctcggcgcccgcgttcgagagcggccgctccgcccaggggcaggcggtcacgacggcgttgacctcgaggtccgccgcgcgcgccacccgccgacgcgagagctcggccgtcacctcggggcgtgcgatcgcgagccccccgccgcctcccgagcagtagctccactgggtcacccgatcctcgtcgacgaactcgagacccgggatcgacgcgagcagcgcacggggctcaacccagatccccttgcgcttgttcagtcgacagggatcgtggtaggtcacgcgggtgttgatggggagcgtcggagtgaggcgcccctcgcgcacccaacccgcgacgagatccaacgcgaggaccacctcgacgtcgtagtcgtcgccgaagtaacgggggtagtcctccgtgaaggagatgtagtcgtgtggatcgagcaccacgatgcgtcgcgcacccgctcgccgccaatcggccacgttgtgctcggcgaaccgccgcgcctgatccgcatagcccatctcagctgcgggtccgccgcagcaccagggctctggctggagcccgatcggctccccggcggccttgaagagccacgcgacggcctgtgggaggctcgtgcggtagaaggcggcctcgcagtcgacgaagagcaccgtgtcacctccgaacggaaggtcgaacgaactcgcccacgccctggagagctccacgccgacctcggcaaccacgggctcgtggcgatcgcgatcggttgccgcgttccacgccgaccacgcaggttcctcgacacctcgatcgacggcgagcgtgcgcgctgcacgaacgacgtcgaccgtgcgcgtgcggaagcggtagaagtcgccgacgaacagcgtgttcggacaccggagctcgcaggcaccgcacatggtgcagttgacgtagtcgcgagcgacgtcctcgaactcgaccaggccctgctccatcgcgacgatgttcgcgtggaacgccgtgggaaggtacgtctcgtcgcgcgtgacctggtagacggggcacacctcccgacagaacttgtgcccggacgagtagcagttgtaggccgcattgcgccacgactcgacgaaggcttcgtccgtggctggcctcgcggcgtcgtcgctgcgatgctggatgtccatcggttccctccctaaaacacctgaaatcagatgttagatcctttccagtgtgctgtcaagcactctcgaggtgcactcacacgacgatttggtagggtcatctcgatgcctcgagccgccgagcacgtgctcacgcacgtgccgttctcatcgctgcacgagaccgacaaggtcgaccaggtggtccagcggctcgaccacgccatcgcggccggactccttccgacgggctcacgcctgccacccgaagcgctccttgcccgcatgctcggcatctcgctcaccacgctgcgggctgcgctcggcatcctccggctccgcggcacgatcacgacgcgccgaggccgccaaggcggatcggtcgtcaccgccgacccagaggccgtgcgcgccgccgcgatcgcacggcttcgcacactcggtccctccgaggttcgcgacgagggcgacctccatgcagcgatcctcacgaggagcgcaaccctcgcggccgagcgcgccaccgacggcgaacgcttggcgctctcgctggctgcgaccatgctcgacgaactctctctgatgcatgagctccaactccatctcgaactggttgcactggcacagtcgacgaagctcctcgaggtcgaactcgactgtctcctctggttcggaggcttccttcagctccgctccgacaccgagaggagcgccatgctggcgtcactcggcagcctcgtggcggcggtcgccgagggaaccagcgaggaagccggtcgacgcgcgcagcgacacgcagagcgcatgacgcgatgggtgcatgccaccctcatcgccacgacgcatgaggacggccagcgatgagcccaccagacgtgctcgacgagctcatcggcacgctcgcgactgcgatgagcgacgttcgagcgctgctcgacgatctcgctcacgaggcagcgacccacgacgccgtcgaagtgctcgtgcgccgcgagctatcgcgaccgggctccatcgtgctcggggcaggcgtcattcgagcgggcggacgcgccgacagcctctggtggtggtggcgacgtggaaccgtcacgagcgagctactcgtcgccctcgagccgacgtcgctcacgttctacgacgtcgagcaccagccatggttcctcgagcccctccaatcaggcacactgaacctggtcgggccctacctcgatcgctcggggacgaacctgatggtcgtgaccgtctcgaggccagcccccggcgcgccggccggcatcgtcggcgccgacctcagcctcgacgccatcttccgactcctcgtggcgacaccggcaggacgccagctcccctgggttctcgagaatctcgagggccgggtgatcgcctcggccgaccccgcgatcaccgtcggtgagcgcgacgtcggaccgtggcgaatccaacgcgcctgtccgatgctgccgtggcgcgtcgtcgtgcgagcgtccgcggcagcatcggattccttcgcgtcgggctaggcgctgacgctgaccgtcgtcggcagcgtcgcagacttcgccgatgactggatggtgaagcccacctggatgctcgcgcccggctcgatggtgccgttccagctcgccggcgtcacggtgacggtgccggtcgaaccggagaccgtgccgttccagaggctcccgatgctctcacccgagggcaccgtgaacccgagggtccatcccgacaccggcgccgtgccggtgttcttgatggtcacgtccacctgaccaccaccccaccaggtcgaggtcaccgtcgcggtggcggtgagctggccggacgaggtcggcgtcggtgtcggcgtcgtcggcgcagggtcactcgcggtcgacgacccactgagttcatagctcgaggggaacacgccgttctcgggcccaccgttgagcgtgaagcccacctggatgctcgcgcccggctcgatggtgccgttccagctcgccggcgtcacggtgacggtgccggtcgaaccggagaccgtgccgttccagaggctcccgatgctctcacccgagggcaccgtgaacccgagggtccatcccgagaccggagccgtgccggtgttcttgatggtcacgtccacctgaccaccaccccaccacgtggaggtcaccgtcgcggtgcccgccaaggagcccgaggagaacgagatcgggccaggcgtcgtcgggctggtgggagcgggcgtcgggttagacggcggtggcgtgggatccgacggcggtggcgtgggatccgacggagcgggcagtgacccaccggcggcctgctcgaagatctgcgagaactgccacggggtctcggtcgtgccggagcagtagttcgagtcctcgtcggcgttgttcgcgcactcgacgtcgcggtggatctcccacatcgagagcctgccgaggccaacctgctcggcgaaggccccgagctgctgggcgtcttgggtggtgaagatctcacccgagaggtcgttctgccctatcatcggggtcacgccgaccatctgccagagctgggcggtggacaggttcgaccagatcgaggcgagctgttgctcggtggcctgggcggcctcgatcgccatcgtgcccatcgcaccttgggcctgggggatgccgtagtccatcgccatgacgttgacgttggacacgtcgacaccgtaggtcttcgccgagttcagcagatacagcgagttcgcgagcagaccccacggcataaccggcagcgtgtaggagacgctcactgggtggccttgcgctgcttcttgttgctggaccagggcgagggcctggttgcgcaggttcacagcggcctggtcgttcaggtccgaaccctcgatatcgaagtcgaggttgtagacgtggtaggtgttgatgacggtctcgtaggcttgggcgagcgcctggggcgaggagcacacctgggcgagctcctggttgatctcaccgccgaaggagacgatgggcgtgccaccctcggcttggtaggcagcgatctcgttgcggaagaggccgttgttctggcccaccgggaagtagttgccccagctcggatagcaggtgcccttcgagctcacaatgaacgccagcgtgagcgccttggcgccggactcggagccgagctgggcgagggtgccggtcggcggcagggtcatgtccacgtagggcgcgaaggccgtcgaggtcgacgaagtcgtcgaggtggacgaggagaccgtgcttgcctgcatcgtcgaggctgccacggtggtcgtcggggcccaaccggtcaggttcgagatcacgatggtctcgggactggtagccgcatcgagctggagaccgaggacgggcgaggttccgacccccggaccgagcgcgagggtcgtggcctgctggcccacggttgcgtcaggcaggaacgaggcgtggtacgaggaggacagtgcgaacggcgtcacctgcgcatccccggtgggtgagctcaccgacacggtgtagccgtcggcaccgctcagcgcacagctcggccccacgagctcgacagccggatagccgctcgttgcggtgacgctgataccggcactcgtctgcgtgatcgtggcgttcccccatcgcacctggggcgtgcaggccgcagcacccgacgtgcccgccatggcgatgggcgtcgcgacgccgctgatcgaaggctcgtcgatcacacccgtgagggttgcaccctgaggcacggtgagcgccacgggggtgctcgtctcgacggccgagcccggttggacgagcggcacgaggttctgccccgtactcagtgcgatcgtctccggggacgcggcccccacgggcgtgagagcgagcgacccggagcccgccgtctcgtcgacgaccgcataggcctgaccgagcgctccgagcgcgggcaccgagaccgtcgagcccgacgccgtcgtcaccgagggcgcggcgggctcgttcgcctgcaccgcaccactggcaaggcccaggctctgctgctggaccacgacccctccgtcgaagggggttccctgctcgttggcgatcagcgacggaaaactgcagctgccgccgttgggtccggcgaaccagccccacgcggtccaaccgatgccgtgctgctcgaggtagtcgacgatcgactgctcggtggaggtcggatacggggtcgcacaccccagcacgccgaactccgtcgcgacgaccggggcgagcgacggcacggttccgagcgatgcgctccattgcgacggggtggtgggcgtgctctcgtgcacgtagagatggaagccataggcgacattcgcaccagcgaggccccactcggcgatcggcgcgaggttgcctgcccagtgattgccgtcgacgatcaccacgttctcggcgccggtcgcgcgcacgatatcgaggagctgctgctcgccaacggccgtgtaggactggccggtatcggcacaggtgatggccccgccgttgcgccacacggaccatgggatgtcgtggggctcgttgtagagctcgaacatgacgttcggatcacccttgaagatcgaggcggcctgctgccagaaggtctcactgggcacgtccggggcgcacgcggggttggccgagggtgtcgcggtcaccgagtcggccccgatcacccggtgaagatcgatgatcgggatcatgccgttgtgctcgacgagcgacacgaccgactcgacggttgcgatgtagccaggggcgtactccggcgaacccttcagccagaaggcttcgttaaccgggatacggacggcgttcgcaccccactgcttggccatcgcgacgaactcattcggattgacccccgactggctcgcgttggcccactggccatccggattccacacgaggctcggccagtccacgccgtggagatacacgggcgctccggctgcgtcgacgatgacgttgccacggacctggaacggaccgctcaccgcgccaggaggtgtcgccgggaacgcggtcgcggctgccgtcagcgctgtctgtgctcccaacacgctcgcgatgccaccggcaacgaggccaagagcaagagccacgcgcgttgccctcgacaacctcgctgcatgacgtgcaaatgaaaccatgccgtggccatcggcatcgcaaacctcgaacctgaaccggccgcgacgatctcgccgaacgggcagttcagcgtgtcaacggtcgttgagcaccgcagcagctgggctcggcctacgcccgacgcgacgcacgatctccggatcgacctggcgggcatcgatgctgatccggtagcggcgaggcgacctccctgccgagaagaggctgatggggatcacaccgtgacgcgcgtgctcgttcaactccgaattcaacctcgacaaacgggggcgcagccacgcggtatcgacgcccgacctcgtggcccgaatggtccgacggtcgatccgaacatcgatggctcgagcaagctcgatgagctccgcaccgagcgcctggtcgcgctggcgctcgcggggagcggcgagccagccatcgccctcgacgacgcgacgaaccagcaagctcaggagcagggtcgacgacggacggaggtcgaggggaacgcctccccagacgaatcgcgacatcgacccgacggtctcgagcgtgaggatcggattgagcgcatcgttgaccgcgcgaacactcagggcaagctcggcgccgacgccgaggagttggcgaaacgcgctcaggcgaacataggggacgtcgatgagcgtgaccacgcgcgcggcagcatcgaggcgcacgccgtcgaggttcacgatcgtgccctgctcgcgactcgggtagtagaacgagggagcccgctcgtaggcgggagggacgatgacgtgcaggagtcgatcgcccgcccgcgcatacagcgagaacgccaaccccacgtgataggccatggtcttacgaccgccagagagcagggcgaggatcccttggctgtcgtccttggccagttcggcgagctgcgcgaacaccgcctcacccgaggcgagggccgcctcgttggagtcgacgtcctcggcgggaatcgcgacggacgacgcctcgatggtcgacagcgacacacgcggtggtttcacgccgggggcccattcctggtagaggcgagccagccgcccggattcgccgaggagccgctgcgccagatcggcaccgacacgcgtggcgagtaggacgatctcgtccggaacgatcggctccggctgtgtcgccagcagcgcccagcaggcctcagtcacgacctgcggtgcaagtcctatcgttgcgaacagcgaccaggaacgttgtccttcgccgttgttcacacaacgaaatgtagcgccaccaccaccccctgatgacccaggaccagcgtttgcaatgttgcaacttggccgacggacatcaccaaatgatgaacattgcaatcttggttaattggtacggggagtcagggcactgcatcgtgcatgctggagggcatcatgcacgttggacgtcgcgagtcgccctgagcgcctcacggaagcagcaacgctcatgcgccgaccgacctcgcccgaacggctaggcccggctcgcaacccagacgtcagcgctccgtggtcacgcaccgcccagtggtctttgtcacgaccgactaggacgtcgtcgcgctctgtgcggtgtctacctcggtcgtcggaacggcgcgcgcgaccacgaggtgacacacctcgcgttcggggcagtcttccggtcgcagggacgcagctcgcccgaggaccatctccagctcgtcacggagcatcacgagaccggcgatctgttgctcgacccgcgcacggtgacgctcgagcagcgtcgccacatgacggcacggaacctcgccatggtcccgcaccgccaggatctcgcggatctcccctagcgaaagacccagcgtctgcgccgcacgaacgaactcgatgcggccgatcgcgagatcgtcgtacacgcggtagcccgacgcatcgcgaggaggctcggccaagaccccgatcgactcccagaatcgcagcgtcttcgagggcacgccggttcgttctgcgagctcgccgatcctcatggctgaagcatagctgaatccgcgggtacaagattccagctagctggaaggcgcagactgatgtccagacacaccgagtgtaggaggaggacatggtcatgagcacccttcacgcatccgctccctgggatctcggcatcatcggctctggctcagccgcctttgccgccgcgctcgaggctcgcgcacgcggcgcctcggtcgtcctgatcgaacgcgatgcgctgggcggcacctgcgtgaacgtgggttgcgtgccctcgaaggcactgctcgtcgcggcacaccgccgaagcctcgccgcatcggcgtacccgggcctcggagccgagacactccccatcgaccacgacgaactcgctgccggggttcgcggcgtggtttcgagcctcgtcaagcggaagtaccgcgatctcgctgagcggatggggatcgacgtacgctacggtactgcgcgcttcgtgtccgacgagacggtgagcgtcggcggtgacgagctcaccgcgcgccgctggatcatcgcaaccggtgcccatgcggtactgccatcggtcgacggtctcgacccagcggagctctggacctccaccgacgctctcacggcgctcgagattcccgctcgcgtcgcgatcatcggcgccggctcgatcggtctcgaactcgcgaccgcctacagcgggctcggagcccgggtccacctgatcgagagcactccccaggctgtcgcgagtgcgccgctcgaactgacaggagccctggtcgagcacctccgcgcatccggtgtcgccgtggcgctcacgaccacggtcggttctgcacaggcgacgacctcagggtggctcctccagctgcaaggaccagaaggtgcgacgcaggtggaggtcgatcgggtgatcgcggccgtgggtcggcgccccaccaccgagaatctggggctggagacggtcggcgtcgaactcggggcccgcggggaagtcgtcgtcgacgccaccatgcgtacgtcgaatcgaggcatctgggcggccggcgacgtgaccggcggaccccagtacgtctacgtcgctgccgcccagggcgcgctcgcagcccgcaacgccctctccgacggtgacgagcacttcgacgaccgcgcgattcccgccgtcgtcttcaccgatccgcccctggcccaggtcggtctgacgctcgacgaggcacaacaccagggctacgacgccgagtcgaccaccttctcgttcgccgatctcccacgtgcaatcgtcgagcacgcgaccgagggcctggccgtcatggtcgcagaacgcacgagtgggcgcctcctcggcgtgcacctctggggcgtgaacgcagccgaagtcatccagagcgccgtgctcgcactccgcaccaatctcacgatcagcgacctcgcgacaacgtgggcaccctacctcacggcctccgaggcgcttcggctcgcagcacagagcttcacaacggacgtcgcgaacctgtcctgctgcgcctaggtcgcctcacgagcgacgatggactgcggaccgcggacgtcgctccgccgatggtcagggcctgagctgccccgacgagcacgcgggacgctcgcgtcgcggaggcgaccgctcggccgcatccacggacgggtgtcgggcccgatcagctgagccttcgcgaaaccgacggaaacctggtcgcctggagccgtaccgcgaggcaggtgcgttcctgcggtgggcgctcaaggccttgagcgatcacgcctccggaggtggggcctgctgggtgctcaaccggatcctgatcggaccacgcgccgtcgcggggtcgaccggccgaccgtgctgcgtgatctcgacgacgttgcgagtcgccagacgtcgagccgctgcacgggccggctccacgagttcgcgccaccggtcgcctccgactgcccgagcggcctcggaagggcagatggagccacctggacgccgcccgacaagcaggtcgcagatcgcaccctcgagcgcgacgtcgatggcacgggattttgctcgccgacacgcatcggagcagtagcggacctcatcccaggtccgctcccaccggcgtcgccaagtcatgactcgaccacacgtcgcgcagaccttggcgggtacggcacctttggttgggctgcgacgtgaacgagccacgacgaccgatccccgagggatcgatccggatcgagaccgcgccacgttgcacagcctacgaacctctcacacgactgtcgcgctcacgacgcacgaccgtcgcaacgccacgatcggcgtaacggcgcgggccgcccgacacgagtccctggatgcagcggtgaggatggcgttcgtgcgacgctcttgcggcgtcgcctggcccactcccacgggtcggtagaccctccgcagcgaaacgaatcgcgctggtcctcggcggttcacaccggttcgcaccacaggtccctccttccctctactggccctcgggaacgagggcagccgcaccactgcagagctgcgatgccagcgacgatgtccatggacgacccgccgacgggttcggccgggaccttgctcgacgttctcgcgctgcgccgtgctcggtcggcgcgcacccccacaccaccacgcgcgctgatgccggattttcaccagctgcgggcccctcgatgccccacgaccatcggcctagtctgcctcatcggcgcaccagaacgcggggtggcggcctctggacaaccagcgcttcttcgagccacggagatcgcaccaccaagcaccgaggccgccatcgttgcggccgcgcatggctcgtagtcggcgtgcggcgcatgtgacgctcgaggcggcggggccgccgccggccaccagactgaggacgtgggaacacggccaaccaccgtctggatcctcggcgaccaactcaaccgatcgatctcgtcactcgagggggcagacccgtcgtcgacggtcgtgctgttcgtcgtcagccgagccaagctggccgcccgcccatggcatcgccagcgtctgcacgccatcctcgcggggatggcgcggttcgcagccgagctgagagccgagggattccgtgtcgacgagcgagaggccgacacgttcaccgagggtctcgcggcccaccgcgcctcctatcgacctgagaccgtgcgcatgatggcgccggagtcgttcgctggcgaggcgctggctcgccggcttggggtcgaactcgttgcatccaacctcttcctgacgacgcgcgaggagttcggcgagtggatcgctcagacccttgagcgtgggcgtcgcccacgcatggaggagttctaccgctggcagcgtcggcgcctcggcatcctcatggacgaagacggacccgccggaggccgctggaacttcgactcggagaaccgactgcctccgccacgagccccggttgcatggcccacggtgatcgtcgatcagctcgatcagctcgatgtgcgtatcgtggcctcactgccggatcaagctgtcggagacccaccccagggttggtggccgaccaatcgggtcggagcactgcgacgcctgcgcgccttcatcgacgagggacttagtcgcttcggaccgtacgaggacgccatgttggctgacgaaccgcgcctcgcgcactccatgctctccgtcgccctgaatctcggcctcctccacccgcacgaggttgtcgaggctgtcgaacgcgcctttcgggacggtcgcgtcggactctcgtccgccgagggcttcctgcgccaggtgatcgggtggcgtgagtacgtgcgtgggttctattggtggcagggccccacgtatcggagtcagaacgcactcggtgctgagcgaccattgccgccagcgctggccaccggacgaaccaggatgcgctgcgtgcgaacgacgctcgaaggggtcgagcgccatggctgggtccaccacatccaacgactcatggtgctggcgaacctcggcaccctcaccggcgtccagccggccgcgatgctcgactggatgtgggagcgcttcgtcgacggagcggagtgggtcatggtgccgaacgtgatcggaatgggcctctgggccgacggcggcgtcatggcaacgaagccctacgtcgcgggaggtgcgtacctgcgacgtatgagcgactactgccgatcctgtgagtacgaccctcgtcagcgcacgggagatcgcgcatgccccttcacgacgctgtattggtggtttctcgaccgacaccgtgaacgctttgctcaccatccgcgcatggccccgctcctgcacaacctcgatcgactcggtgacctcactgcgatccgagagcgtgcccggcagatcctcgaactcctcgacgcgggcctcgcctgatgtgcccgagcccgactggttcttcgagtcgatcgtcaacgtacgaccgtcacgggcgatgtgactccggacattggatgagaacaccgatgccggagacgtgtcgccaccctcgatggcatcctcgccgagcgaggagccccaggcttccgccgagtcggcaacggcccggagtccgtggcagcttccgtggccagctgggcagccgaactcgcggtgacctcgtgattcacggatccgggctccccgcggcggtaacggtccgggttcaaccggtcgttgcaacacccccgatgacgcaggtgcatgtgcaaccaaacaggaaccaggctcctccgggagcgaggcgacagtgggcggccgatcgtgccctgcggccgccgatgcgctccccagggcggccagacccaccacggatgctccagtaggccttctggcagctcatcgccacggggatctcgaccgcggacgcctgcgagcgcgtgggctcgcgcgtgctacgccaacctgtgctcccatgcccgctacggagcctcccgagcggtcatcaccaccgtccacaacgaccgctggcggagagacggccgaccccgagcctcgtcggctcgaccggcggcagaagttcgagtctcacaccgagacttgatccagacacgcgacatccgtcgtcaatggagctgacgacttctcactcgaacctgcctgaactgcgggaacggatcaatgcgttcgcccgcaccgacaggagccaccatcagacccggatcacctcgaggcccggaacggcgtcgtagtcgcggtcttgagtgacgaccgggattgaggggaccccaagagttgagccacccgctttgcgagttgatgtgcttgtcggtggagccaggcctcgacgaactcgaccggagtgagccagccgtgtgcgctgtggggcctgttcatgttgtagtcgatcctccagtcctcggttaggacctgggcttcgaggaggctgtcgaactgctggccgttgaggtgctcgtcgcgcatccggccgttgaagctctcgatccaggcgttctgccaggggctgccgggatcgatgaagacggtcccggtaccgttgaaccggcaccagtcagccacggcgtgggcgatgaactccgggccgttgtcgaagcggacgtagactggggcgctgcgacctgcggccaggcggtccaggcatctgaccaccccgtcggcgtcgatcgaacgctcgacgtcacaggcgagggcttcgcgggtgaactcgtccacgacgttcaagaagttcaagaacttgagcatcctcccgtccgacgtctggtcgaactggaagtccatggcccagatcacgttgggccggatcgggcacatcgccccgacgggcttgccgatcccccgcaggggcttcttgcgctttctgtagggcacacgcaggccttcggcgatccagaggcggtggatgcgcttgtggttggcccgccagcccgccttcttcgcctcgacggcggcccgccgccagccccagcgcggacggcgccgggcaaagtcacgcagccacgcccgcagtgccagctcgtcgtcggaggggatggggggcttgaggcgctgagtcgagcggggctggccgacgacccggcacgcccggcgttcggtcaccccgaactactctcggagggccaccacggcccgccagcggcagtccggggtcagaagtttccccggttcagctccttcaacatgtcgatgtcgagggcctggtcggccacgatcttcttgagacgcgtgttctccttctcgagctccttcagccgcttgacgtcatccgccttcatgccgccgtactggttgcgccaacggtgccaggtcgactcggtgatctccaggtggcgggccacctcctcgatcgactggccctggccgaggagcttctcgccctcagccagcttccggatgatctgctcggtcgtgtgccggcgtctcttcatcgtgtgctgtcctccttccccacatcgtggggcttggactcgcacaacgggtggagcagcctacggggacccggccaggatcccttcgaccatcgcggttgccgcaacaagcacgtcgagtatcgggacccggcggcgctcagcgtgcagcacggcggccacacgggcaaactgacgcgccacctcggcgtccaccggtagcggatcccacgtcgactccacggctgaaagcgtcgccactcgcgccggtcgatcatcgtcattcgccatgagcacgccgagcgtcagttcggccaccgtcaccaccgacacctctgtgtcggtcaccccttccatcgcgcccaggggtcgacccgactcagtggcgacgaagaacgaggtgtcgagcagtgccctcatagatcgtcggtcgtgtcggacagcagactccgcacctccctcaggagcccgcggtcggccgggtggcgagacgcaattgcgaccgcctcggtcgccgacaccgtccggcgacggcgcaagggcacgatctcggcgaccggtcgccggtcaaccgtgaccgtcaacctctcgccgctctcgacccggcggatcacctcgctgaccgtgttccccaggtcccgcaccgaaatagaaccactcacgtcgctacatgtagcacatgtagccacaagtgacccgcgtggagacgaggggactcgaacccctgacctcctgcgtgcaaagcaggcgctcttccagctgagctacgcccccaaggcttcgctcatgctaatggatcgtgctcggaccaccagtggtccaggcccttctgcaccatcagcgacgtcccggaccaagcaaccgcaggctcacaggctgcacggctggaccacgactggtcaccagtcggacgcgctcgaaaacgtgtaagaccacggcattcgccgccgcaccatcgagactctacgtctgtgccagccccgagcggggccggcacagacgccacgcggagggagtgggattcgaacccacggtacccttgcgggtacagcggttttcgagaccgcccgattcggccactctcgcatccctccccgcccaacgaccgaagtcgccgaacgcaagcagagtctacggcacgacgcctgggcgccgctccgagaagaaacggcgaaggagcaaagcagctcgttcggcatcgaccccgccgacgatctcgagctcgtggttcagccgcggatcggcggcgatgttcatgagcgacccgcatgcacccgcctttggatcccaagccgcaaagacgacgcgtcgggcacgggcgagcaccagcgccccggcacacatcgcacacggctccagagtgacgtacacgtccgcaccgaggacatagccgtcgccggcatcggcgagcgcatccgacagcgcaagcagttccgcgtgcgcaaggctggagcgccgctcgatcgtctcgttgtgacgcgcgccgagcacgcgaccactgcggaccaccacggcccccaccggaacctcagccgtccgcgcagcatcctcggccagaccgaaggcgacgtcaagccaccgacggtcgtcagcgctgagcatcgacgtcagggggtgcgacgcgcttggacgcgtcgaccggtcgagtctgtcgcttggcgatggtcgtgaccacccattcggcatacggatcgtgcgggagcgcgacagagcgaaccagcacctccgggacgtcgtacgggtgggcagacgcgatgagcttcgtcagacggagcacatgctcagggagtgacaaggcccgcacctcgacctcgtcctcggtgtgccagtcgccctgccagtagtaggtcgagcggaccccatcggtacgcttgacgcaggcacacaggccggattcgacgagcgcgtccaccagcgccgctgcgtgctcgtcacttgcgagggtggtgacaatctcgactgcgtcgatcactagcccctccgctcggtccccgccactatagtgatctgcgcttgtgcgctcgtagctcaacggatagagcatctgactacggatcagaaggttgggggttcgaatccctccgagcgcgccacaaagctcctggtaagagggttgacggcacgtggactgggcgtggttcccgctcgcgaagtcaacggcaggcccaggcatcgtgacaccggtcggcgcactccgctctgactcggcgtcctaccaccgaagggtgcttctgtcaggtcgccgcgccggaacatcggcatctggtcctggaacaggtgcagattgctctggaacgtcgttcctagcttgatcctcgaaggttgatcgcgacgtggtcggcttgtgggagtgtggttactccctcggcgtccagggccattggtcgatgtaggtggggatctcgatcgagctgcgcccatagcgcgaactctcgaggatcgcgcagctacgatccgctgtcattgtgagcgacgtccgaagggcttggctgatcaatcggcgcccggtcgagcatctcggtgtcgagctttcgggcccgactgcgacggatcgttgctgcagatctgctcctgaagcctgattcaccggacagacggaggacgacgggcacgatcgctcggcacccggagcggccgccgtggagctcggcggactccctagacggtcgggatgcgacgacggattcgaaggttgggggttcagattcctccgaactcgcatcgccgtccagctgagggggcttagaacctgcaggcaccctgccgatcacgtgcctcgtacgcttgcttcgttcgcctggccaagcgagaacacgggctccggccgatgccggagtccgcaccagtggcctcctcccttcgaatggcactggtgcgaccccgcgtcactcgagcccgaagagtgaaccggtgagcgttgcggcccgccgcgcgcgtcatcagcgaccagcctcaccatgccggtcggcaggtttggagcaggtcccagtgtgagagaccatgcccgccccggtgccaccgtactacgtcgaaatatcgggatagggaagccggacgtgcgagaggcgccgtgcgtactctcgctggaaaccgagaggctcctcgtagtcgtgctcgaacagggcgatgaacagggtcaaggtgaggaagtggtgggcacccaattcgaagagccgcacgtagtcgtgcgtggccagggcctctcgctcctcatcactgaagcccagccaggtggtcgcctccccactgtggaggttgaggacgcgattggcccgctcgcgctcccaccactcgaccgttccccgcggatccacgcgatagcgcgcgacgagttcgggatcgcgatcgaccgtgtagagaaacttgtctacgagatagcggctcacgcctcccccctcctcggataccaggtgaaatatgcctccatcgtgtggaacaggtcgaggttgtcgacgtaatcggctcgcacaccctgaccgacgacgcccatcatgagcaggaagtccatgaatccgtgcgtggcgttgcccggcagccagagactctcgagactgacctctgccagagccccatcgatgtcagcgttcgcgatccactggatcgccttctgatcgaaatctgggtccggcccgtgcggaccgaactgacgcggtccgcccaactccagcgagagatgtccagttccgatgatggcgacgcgctggttgctcggccactgctcgacgatgcgccggagcgccgctcccagctcgacgaaccgtttgggctggggcatcggcggcgcgaagatgttcgtgtagacgggcacgatgggcaggtcgacctgcggtcgcagcgtgatgagcgcacacgtgatcgagtggtcgatgcggagctcgttcgagaacgcaagatcaaagccctcgtcgagtccctgtcgaaggatgtacgcggcgagttcctcctggccggacacccgcatacgtgggagtccgaactcccgctcctcgttgtagtagttcgcgtcgaacaccggcgccttgccgaccaggaactgtggcatgttgtcgagccacagttggtgaaagtggtcagagccgaccatcacgagcacgtccggctcggcgcgggtcaacgtctctcggaacgcctcgatcttggcgacccagacgtcggcgaagtcggggcgatcggctccggtactcgtgctcgccctgtagtagaacgggtggtgcgtcgacgcgatgatcgcacacacatcggccatcatgccccccttcgtgtcatgctaggcagtcggatcgcttgcgcctggggcgacgtagcgcgcccctcgatccaccgtgaggtacacatccatcgcgatgggccgccgacgctcctcggcaagatggccaaggatcccggcggtacgcgcgagcaggaccacgcctcgcgcgagttctccctcgatgccaaggtcccagagaacggccccggctgcaccagcgccgttcagcggcagccggcgaccgagtatgtcggcgtgcactcgtccgatcgcctcgaagagtgccacgtgcggacccgcggcgccctcgcgtcgcgccagttccatgagcacgcccgtgcgcgggtcgcgctccttgtgaaccgggtggcccaaccccgggacgtagcgcccatcacggtgggcgctcgcgactgcgtcccgagcgatcgcatcgaagtccgacgcggtctgcggtgtctgctcggcacgggccaatgcgtcggcgagaaagcgaccggtatcctcggtgactccgaggaacctggagcccccaccgaggattcccgcagcaagcgccccctggatcgactccggcgcgctcaggagcgtcaaccgagctgcgatcgcggtgggggtgaagccgtggtcagcgagcgagaccaagcacgcctcgaacacgcggacctcgccagcgctgggtcgcctgccggtcacgagccagaaggccagctctccgaagctcaccgaacccatgagctcgcccgcgaggtcagccccgagcagggtgatcgcctcgggcgtggatacgccaatactggtcgggaactcgggcgtgctcaacggtcctcctccatcgggcgctggagccagtcccggatctcgtcgccgtgctcgtcatgggccggcggaggaaggtcatagcgtggcgccgtcttcgaatagatcaccgggtggcgcgtctggcgtacggcgcgcgacccctcccccaccacgatgacaggctcgagtccgatgcgctcggcgaaggcaacgccctcggccacggtgttgatcggtccgcacgggacgccgacggcggtgagccgctcaaaccacgcgtccgcactgtcgtgacggagttggtgctcaagcagtggccgcagctgttctcgatgagcggtgcggtcgtcggggtgggcaaagcgcggatcctgggcaagttcaggcacgccaaggacgtcacagagacgagcgaactggacgtcgttgccgatcgtgacgacgagttcaccctcagccgtcgggaacggctcataggggaacagactcggatgcgcgttgcccatgcggctcggcaccacgccgcccgcgacgtaggcgctggtctggttcaccatgccggacaacgccgaggcgaagaggctcgcctcgaggtgctggccctcgccggtcaacgtacggtgatggagggcggccagtatcgcgatcgccgtgtgcagtcctgtcatgacgtcgaacaccgaaatgcccgaacgcagcgctgggccgtcaggctctcccgtcaagctcatcaacccagacatcgcctggaccaccaggtcatagccgggcagttcccgcccaccctgactcgtgccaaagccgctgatcgacgcgtagacgaccgcggggttctcggccgcgacgtcctcgtaggcgaggccgaagcgtgccaatccaccaggcttgaagttctcgacgacgacatcagcacgacgtgcgagttcctgtgcgagggcacgatcgtcatcgtccttgaggtcgagaacgaccgaccgcttgttgcggttgatcgcaaggtagtacgtggacgtcccgtcggcggtgaccggaggcttccaaaaacgagtctcgtcgccggtcgggctctccaccttgatcaccgtggcaccgaggtcgccgaggagcatcgtgcagtagggaccggcgagcacccgcgagaagtcggcgaccaggaggccagcaagtggcccacgcccttggtcctggttgcgatcgtccacgcgaactcacctcgttgccacgcaccgcacgacgtcacgaacccgccgaactcggagtcgaccccgacgtgtccgtagatcggacgcctgtccgtctttgcgtggatactaaaggttcccggcggtgctgtcaagcgtccgggccgaatgcaagccgtcacgcaccgccaatggcgctgccgcgatccgagcgacgtcggcgtcgatggccttggcggtctcgatcagtctcgggagatggtgctcgagcaactcgtccagactggtctcggcagcatgcacgttcacgttgacagccgctaccaccttgccgtctggatcatggagtgcgacggcgatggagcgaatacccacggcgagctcctcgtcggtgagagcccagccccgctcgcgcacgttggcgagcacgcgccgcagctcctcgagggcaggggcacgacgcggcgtcaccggagagcgcgacggcacggccagggtgcgctccagttcgtcgtggtcgagatcggccagcagcaccttgccgagtgacgtcacggaagccggaaagcgcgtccccacggtcaccgcgattgccacgatctttggcaccgcaacccgggcaacgtagagcacgtccgaaccatccaagacagcgatcgaggacgattccctggtctcggccaccaactgctcgaggtgaggtcgcgcgacctcccaacgactcctcgcgagcaccgacgccgtgccgagatccagcaccctcggggtcagctcataacgcccgtcgtctcgttgccgaacgtaaccgagttcggccaacgtcgccaggatgcggtgggcggtcggacgcgcgagatgagctcgggtcgcgagctcgacgaggctggctggctcgccgcgaccgaacgcgagaaggacgtcgagaccccgggcgagcgactcgacgaagtcggggttctcgctgcgtctgaccaccgtgctccctctcgtccgagcccagagggagcctactcggtgcgcgcctgcacgatcgatgcgaggtccttgacgacagacgagcgatggtgcatacttgcgcatcaccatacggacacatgtccgaaactgcggaccagcagcgaccggtccagtgccgacgaagggagcgagcatgcgaaccagcgaagtcgtccgcgagccgatggtgctgcgcgagggactcgtcctcacgatgaatcgggcccacgacgtgctcgcctcgaccgacgtgctcgtccggaacggacggatcgaggcgatcggcccgcgcctcgaagtgcccgagggcacccgagagatcgacgctcgcggcggcatcatcatgcccgggatgatcgacacccaccggcacatgtggcagaccgcaatgcgtggctacggagcagactggaccttaacgcaatacttcgtgtggtactacctcacctggggcaagcggttccgtcctgaggacatctgggcagggaacttcctcagcgccctcgaggcgctcgacgccggtgtgacgaccacggtggattggtcccatggactccagaccgtcgagcacgccgaggccgccgcggacgccctcgaggaggctcccggacggttcgtccttgcctacggcaacattcaacaggggccatgggagtggacgaccgaccacgcgttccgcgccttcgtcgagcgacgtttcgggggcggaggcaccgagctcctcgggttccagctcgcgttcgacgtcaccggcgatccggcgttccccgagcgagccgccttcgaggttgctcgagatctcgacgtcccggtcaccacacacgctggggtctggggtgccaccaacgacgacggaatccgtctgatgcacgagcacgggttcatgacaccgcggaccatctacgtccacgccgccaccctgtcgccggactcctaccaccgcatcagtgcaaccggcggctgggcatcggtatcgaccgagagcgaacagagcgccggtcagggttacccgcccacctggcagctgcgacgctacggtatcggcgtctcgctctcgatggacaccagtgtgtggtggagtgccgacctcttcagcgcgatgcgagccactctcggcgccgaccgcgcgcgcgagcacctcgaggcgcacgcccgcaacgaaaccgtcaccaatcaccacctgcgtgccgagcacgtggtcgaatgggcaaccataggtggagctcgcgcactgggcctcgaccacctcatcggcagcatcgagatcggcaagcgcgccgacctcgtcgtcctcaagaatgaccactcgccagcgatgacgccgatcttgcacccctacggccacgtagcgttccaggcccagcgagccgacgttcacaccgtcatcgtcgacggggttctcgtcaaggacgaccatcggctcgtcggtgaccatctcgcccgagcgcgacgcggcgtcgacgagaccgtggcctacctcatgcaagagcttggtgacgaggcatggctcgaagggatgcatccggcgatcccggagctctcggtcctcgagaacccctatacctacaccgagtggcgcagcgagagcgcacgttggcgggaccgcggcggcccggacacctccgagcagaacgccgatggcggcacgcccaagccgccgtctgcctgacagagcccgatagctctgcccactgaggtgggcacttggccttcgaccgagaccaccggcttgggcgcaccagcaggtgcccatgggtcccccgtcgtctgctccagagtgcccacccggtggaccactgaccagagctgcgacgacaatggtccgcaagacctgcctgcaccgcgcagctccagacgtcatcgattgatgagcttgcaggaaacccgcggctggtatcgacggcctcgaggccgacggaacgacctcaccctccgcacgcggcagcccgctcgctccgacgagaggccgaccacccagcgccctgccatgaccgggagtctgcctgtcctcgctcggggcgaggtctttgtactctaccactatttcgaagctggagatacactgaggagcagcacaagcagaagggagacggtcatgctcacgatgcatcgtgttgcgctcgcagcgctcatggtcgcagcgggaggagcttcgctcaccgcctgcggatcgacgacgacctcctcgaagccgacgaccaccagtcccaccgcagcgatcaagaagagctacaccgacttcttcgccggcacgacgtccgccgcaacgaagatctcgctcctccagaacggcagagagttcgccgacatcatcgacggccaggcttcgtcgtcgctcgccaagagcgtgcaagcaaccgtccagaaggtgacgctcacctccgggacgaccgcacgcgtcgtctacaccctggacgtcggcggacagcccgcactgaagaaccagaccggcgaggcggtcaaggtcggtggccactggctcgtgggtgatgggagcttctgtggcctcttggcgctcgagggcgtgaagaacgtacctgggtgcacgagcaccgctggctaagaccgtgcatccgtcggcccgcgcacgagcgctggtggtgctctgtgcggtcatgtccctgacgttcctcgacaccacgatcgtcgcggttgcgctcgccagcgtgcagaccagcctgcacgctggcgtggcccagttgcaatgggtgatcggtggctatgcgctcgccttcggcgcgctgatgctgcccttcggagcgctcggggatcgcttcggtcggcggcgcgcgatgctcgtcggtctggcactctttgctgttggatctgcgaccgctgcgcttgcccactcacccgctcagttgatcgccgctcgcgtggtcatgggtgtcggcgctgccgccagcgagcctgggacgctctcgatcattcggcagctctacaccgagcccggcagccgcgcacgagcactcggcgtgtggtccgcagtagcggcactcgcgctcgccgtcggaccggtcatcgggggagtactcgtcgggattggaggctggccagcgatcttctggttcaatgtcgccgcgagcgtcgtcgtcatcgtggtcacggccatcgtcatccccgagagtacggaccccggtgtcgggcgcatcgactggggtggagcagcactcggcctgatcgccatcggtggggcgctcttcggcgtcatccagggcgaggcacgcggctatggcaaccctctcatcgtggcggtcttcgtcgtggccgccgtcggtttggccgtcttcagcgtccttgaggcacacgtgccgaacccgatgctcgacctgcactaccttcgtcgaccaggcttctccgggtcgctggtgctggcgttcagcgtgtacttctcgatcttcgcgatcttcttcttcactgccctgtatctgcagatcgtcgagggctacagcggctaccgcatcgcgtcggtgttcctcccgatggcgctcgccatgatcctgacctcgctggccaccggacggtgggtagcgcgcattggcgtcggcatgcccatcgcactgggatcactgctcgccggcctcggcgtgctcggtgccgacgtcggcctcagcggcagcacgcatccattggtgctcgccctctccctcaccgtggctggactcggcttcggcaccaccgtcgttccggtcacgagtatcgcgctcgccgtcgtaccgcagcagcactcaggcatggccgctgcgtccacaaacaccgcacgagccctcggcgtgatcgcgagcgtctcggttctcggctcgtacctcaatgcccagctcaccagtggccttggtaccaagctcgcccgactcggggtcccaccggtcttccgccacgtggtgatcagcgcggtcgagacgggcggcgtccccggtggctcgagcattgcggccgacaccaaaacgttcgggcctctcgtcgccaaggtcgtcacagctgcctacggagcatttcatcgaggtctcaccatctcattgatcatcgctggcgcgctcatcatcgtctcgggcgtcttgagcgccgtcgcggtgcgaggtgcgcggacgcgccccgacggcgagacgtcccaggcgtagtcgaggcccaaccaccgggcgaccccgagctgtgctcgaggccgcccgaagtgcgagctcaggccgtggtcgccgacgacgtcgtcgccgacgttccggtatgagccgggcacgggttggtggtcgtggatggcgtggtcgtggtggtcgtcggcgtcgtcgacgaactcagctggacgactgttccggtcgtcggtgcggccatcgactgcgcgatggcgaaaccgacaccgccaccagcgatcgccgctcccgcgacgccgagacggatcaggactctccgagacagggtcacgctccctctacctccttcattgtgtctgttgctggtgcccgcaggcacgccgatgggtcatcggcacccccatcctcgcgtatgggcctgggagcgagtccagctcgaccatggaagcaggcaagaggccacgcgcgactcgcgctgccttcgatcactctccgaccgctcgacgatgaagctcagccatggccgcggtagctcgctgcgcctgtgcataccatccgccccgtcgaagcagttcgtcgtgggtgccgtcctccaggatgcttccggcacccacgacgacgatccgatccatgcgctcggcactgtggaggcgatgcgcgatcatgaccgtcgtgcggccggcgccggcacgctcgatgccagcgtgcacgcgagcgtcgagctcgggatcgaggttcgacgtcgcttcatcgaggagcaagatcgcgggatcgatgaggacggctctcgcaagacacacgagttggcgctcccccgccgccagcgcgcgaccacgctcgcccacgacctggtcgtagccgtccggcagtgcagcgatgacgtcatgggcaccgacggctcgcgctgcggcctcgacgtcgtcgtcgctggcccagggtgcaccgaacgtgatgttgtcccgaatcgtgcctgagaagaggaacggctcctgggggacgtagccgacccggctgcggaaccacgcaaggtccaaggctcgcagatccgtgccgtcgaggcgcaccgcgccttgcgagggatcgacgaagcgaaccagcagcttcatgagggtcgacttaccggcgcctgtctcacccaccaccgcgacgtgctggcccgctgggatcgcgagcgagcagtcacgaagcgcggggcgctgaacccccgggtaggcgaaccacacccgatcgagttcgatgctccctcggatccgggtgggtcgactcgcgttcgggctggagcggatgctcggttgctcgtcgaggagcgagttgatcttgcgcagtccggccctcgctcgctggtacgcgtcgaaggtttgtgcgagctgttggacgggcgcgaacagctgcgtgatgtagagcaagaacgcgaccagcacgccgacttcgatcacatggccacgcaccagcccactccccacccagaggacaccggcggtcaccaccacactggtaaggtccgcgagggccacgtagatcgcctggacaccaagagcggtcaagctggcgttgcgataggcaatccccagccgtcgaaacgtcgcgagaccagcctcctcctgaccgagggcctggacgacttgcacgccagcgatgctctcttggaaatgcgcgttcaccgcggccacgtgttcgcgctgccggtcgtaggcgcgctgagcgatggctcgatacaccacggtcgcgaccacgagcaccggcacggcgaccagtgcgaccaacgcgagacgcggctcgagtgcgacgagcacgaccgcaatcaccacgaccgtcgcgatccccacgatggcactgaccaagccgttctggagcagctgcgacatggtctcgacgtcgctggtcagccgggtgacgagccgaccgctcggctcccgttcgaagacgtcgataccgagccgctgtaggtgcgagaacagtcggagccgcagctcgaagagcatcgactcccccacacggcccgtctggacagtctcggcccactgatcgatccaaccgatcaacgcgaccgcgaggagtccgagcgcggcgagcacaaccgtgatgccactgtgggcgagcatgcctccgtcgataccacttcgcacgatgagggggccgatgacccccgaagcggtgtcgatggcgacgagtgccaacgcgagcacgaggccgaagcgccagccggagagaaacgtgccgagtcggatgcgaccctcgccaggtggctgtgtccaccggggccgctgcggctcatcacgagtcggggggaggtgcgcgatgagctcgccgacccaaggcggcacgtcacccaggctccgagcagctgcgaggcgacgccgaccagaaccactcgcctcgacgatctgtcgcttgggggacaccgcctcgatctcgacatcagagccatccccaccatcgagaaatcggcgcacccacgacgacatcgcggcgacacgggcaaccgaaccgtcagcgacgacacagccctgctccaacaccaccacacgatcgaccaaggagacgacagaggcacggtgcgacacgacgatcaccgtcgggcgctctggcagcgcccggatcgacgcgatgatgcgctcctcggtcgtcggatcgatggccgaggtcgcgtcgtcgagcacgagcacgtgcgggcgcatgacgagtgcacgcgcaagcgcgaggcgttggcgctgacctcctgagagtgtcactccgccttcgccgatctgggtgtcgaacccgtcaggcaaggcctcgatgaactccagggcgcccgcccgtccacaggcctcacgaacctcggcctccgacgcatccgggcaaccgaaacgaacgttgtcgaccaccgtgccggccagcaggacgctctcctcgaagaccatgctcacgcggcgccgtagctcggcgagcgacaccgagcggacgtcgacgccgccaacgagcaccgcgccccccgagacctcggccaaccgcggcaacaacgtgcagagcgtggtcttcccggatcccgacgggccgaggatcgcgaccatctcaccagccgcgatctcgagatcgacccctgcgagcacttcgtgcgtccccccacgtagcgccgtgacgccccgtacgctgacacggcgagcgtcgcgtggaagtggcagtgggtgcggcacctcggtgatgccaggttcgatcgagaggagttggtcaatccgttcgaagcctgctcgcgcctgctggccgacgacgaggatgccggccaccatgcgcgcgggcgccgcgagctgcgtcaggtagctcgcgaaggcgacgaacgtcccgatcgtgacgtcgccgttcaacgcaagcagaccgccgagggcgagaatgcctgcctgcacgagctgcggtatcgcctggagctcagcggtgacccaggcgcgcagcctgatgttgcgaagcctcgacgcgtagagcgcacgcgcgccatcgacgaaccggcgtatctgcgacgcttcctgcccgaaggcgcgcaccacacgagctccgatgatcgactcggtcaccacggtcgtgagttcgccctcccgctgctgtgcgtcccagctcgacgggaagaccgtggagcgcagggttcgcgacgctaggaaggtggcaaccgggacgatcagtgcgagcagcatgagccagacgttcagcacgctcatgatgacgatcgacacgatcgcttggagaaccgcgccaagaaccatcggagcccacgccaggacttgttgaacgagaccgagatccgtcgtcacacgtgagagcagctggccgatctcgagaccttcgtgggtggcgagatcgagcgagacgaggtgcgcgtacacctcgttccggatgtcgagttgcacgtcgtaggccactcggccaccgatgaaccgtcgcaccagggtcgtgccaaaacgcacgataccgatccccactaagccgagcaccagcgcctcgatggcggcccgtcggcctccaagcccgtcgatcacggctcgttgcaccacgggaaccaacgccagcgaccccatcgacacggccgatgcaagcagggtcacggcaagcttgccacggtgccggcgaagccatggcgcaaccgctgcccacgagccttcggtcaccgacgtcgcgatcggacgggaccgctccccgcccttggtcatcctcaccgctctcgtgctccccgccgctgcgccccacgtgctggctcacatacttgtattctcccaccaccctagagcgatagcagcgcgatcacacctctccagggacctcatccgctaccacgagtccacccacgtggcctccgttgtgcgccgcgaccctcctctgtctcgggcgcggaccgcacggcccaaccaccgaactgccccaacgatacgagcaacgcccttggcggctgacgcgaccggtctccttggctcacaatccacagggttgtgcacacctgtgcacaaccctcttgttcaccttccgataaccctacgcctcgacttgagggtgggggtcgacgatgcccgacgcgatgcgatggagatcggcaagatcgacgaaccgaactcggatgtaccctgcgccactcttgctcacgtcgatctgcacatccgactccatgacgtccgcgagcaaccgctcgagctcgacgacgatggccggacgcagccgtgcctcgggcaccgcctccttggggccctgcgcatgctccgattcgccagcctcgaccctcgtcgcctcggccgcggggttcgagatcgcccgcaccgcctcctcgacgtctcggacggacaggccttcctcgaccgttctcctggccaactcctcctgcagacgacgatccgggcaaccgagcaaggccctcgcatgccccgccgacaacaccccatcgagcagcatccgctgcagcgcagcggggagctgcaggagtcgcagcgtattcgagacagccgcccgactcttgccgacaccacgagcaacctcgtcgtgcgtcagctggaaatcgtcgatcaactgccggtacgcagctgcctcttccagcgggttcaagtcacgacggtgcaggttctcgatgacggccacctggagcgacccgcggtcgtctcgatcttgcacgatggcggggatgcgatccaggccagctcgctgcgccgcgcgccaccgccgttcgccagcgatcagctcgtagccgtccgcgacccgccgcacgaggatcggttggagaacgccgacctcggcgatcgatgcggcaaggccactcagcgcctcctcgtcgaagatcgtccgcggctgcagaggattcggacgaatcgcccctactggaatctcgacgaggccatgctgctcctgctgaacgcctgttggaatcagcgcaccaagtccgcgccccaaaccggtctgcctagccatccttgcgcagctccgtcgccaggtcgcgataggcaatggcgcctcgcgagctcggatcgaacgtcgtaattggctgcccaaacgagggggcctcggagagtcgtatgttgcgagggatcactgtctcacacaccaagtcaccgcagaactccttcacgttggctaccacctgctcggagaggttcgtccgggcatcgaacatcgtcatgaccacgtgcgaaacacggagcgtcgggttcaggctctgctgcaccaatgtcacgttccgaaacagctgcgacaatccctcgagggcgtagtactcgcactggatcggcacgagcacctcatctgcggcagccaacgcattgaccgtcagcagtccgagcgacggcggacaatcaatgaagatgtagtcgtagtcgcctcggaccggctccaacgccctgcgcaaccgagtctcacgcgacagcaccgacaccagctcgatctccgcaccagcgaggtcgatggttgcacccgcgacgaacacattgcggaccccagtcgcctcgatgacgtcttccaacggcgtctcgtgcacgaccgcgtcatagatcgaccccgcaagatcccgagggttcaccccgaggcccgtcgtcgcgttgccttgcggatcgaagtcgaccagcaagaccctcgccccctgctcagccaacgctgcagcgaggttcacggctgtcgtggtcttaccgaccccacccttctgattggcgaccgcaatgaccctacccatggctactcccgcggacgtgttcgcctgcagttccacgtggaacttgacgcttcacggcaggctactcgatcacggctccaccccgcgccacagaccctccctccaccgtcacgttccacgtgaaactggagctgcagaccaaccacccacgccacgtcttccgtccgcaccatcagaccaaccctcccgggtctccaagcgcgcaacacgcataccaccccgccgccgctcgataccacatgaccgacggatcgaccatcgagcaccttcgaactccatgagcctgcctccgcctcacccgcgcccacccaaacccctcaacctggagcccccgtcgcagccggaaccacccgtaccatcgactccccgtgcgaccacagcttccacctggcggaccaacgccaacggccatcgacgacccccaccaaccagtacgtgcgactaccccaaacgcatgcacgtccggagcccagcgatcgatcacgcgagaacggtcaccccacagaagggcgagaggggagtgacaagggaacgagaggggagcgagtcctaggagccttctgaacaagcccctccctggtagcgactgatgccagccacccagcccgggaacgagctcagctgacccgtgctcgcccagctcctcaccctctcctcttcgtcccctcctcgtgggtgcggaggagagggcccgagcgtctctcaggtggcaagcacccagccaccacccactcgggtgagccccaggcgtagcagcaccttcaggttccaggtcgcacagagcagctcgaagtgcaggcggttgcgcacgagtccccggtagcgcagcctcgccccggagagcttgcgcttgagctgtgcgtggatccgctcgacgttcggtcgggtgcgctggtagtcgagacggacagccgggtccccaaagtgcgcccgctggctgatgccgtgccaggtggcaggggtgaaggtgaggacccgtccgcgcttcgatcgtgtgcagcgctcccggagcggacagccatcgcagtgcttggcgaaggaggcacggcccttcgcggaaatggggactcggtgccccgcaggacagctaacccatccctcctcgacgacgaagtcgtcgatcgtgaagccaccagggaccgccatagaaaggggccgaggcttgatcacctcgtcgtggccatgagcggcaagctcgttgaagacctcgctcgtggcgtaggcgctgtcgccatagaccgtgcgtgggccgtcctcgtcaccaaggagctcgggcacgacctgtgcatcaggcacgctacccgtcgtgatggtcgaggcggtgacgatgccgctgtctggctcgacggccacgtggcccttgtagccatcgatggcacgggcacgggacttgtgcacatggcgagcgtcggggtccacggtggagatgaccctgtcgcgggccactcgcctcgcgatgcgccagcggcctgcggtggcatctgtgcactcgacgtcctggcccgccacgagcccaaggaggcccagggcctcgcgctggggctcggtgagagacgcgagcttctcggcctcggcgaggtgggcggtggcatcggcgacgagggcgctcaccgtgcgcaccactgcttcttcgtctcggtagtcgatggcaggctttggacgggtgtagtcgatcgctggtgacagaggaacttcgcggagctcggggatcagcctgcgtacccggttgatctgagcgacgagttgggtcatggtgtcttgggtcgcgaccgcatcggcgagcacggtggagtcgacgacgcgcttcgtcgtgcccttgagcacccccgtggcaccgatcacctcggccacgagctcggtgatgagtcttggggtctcggaggtggcgatgcgcctgcgccagtaggtgagcaccgtggggtgaaaacctgggtcctcgaggtcgagaccgagggcgtacttccagcgcaggttgtagcggacctgctctgtcgcctcggtgtccgagagcccctcgagcacctggagcaccatgaccgcgagcaccctcgaggcggggatggagggtctgccggtcgtggagggatagaggtggcggaagcgctcgtcggggaagagctccctgcggtgctcggcgaggaaggcgtagatggaccctggctcgatgagcgaggagcagaaggcctccgtcgcggtgaggtgtgcctggtctgattcggtgcccaacatgcaaaaagtctagctgagctgggcaaatggcgctgggcaggaggggaggagcgccgtgcgtcgccgcgctacgtggaggagttgttcaggaggctcctagaggcctacggccacctcgcacaccgatcacgggtggaccacagccgcgacgctcccagacgcctctcgatccatgcacggctgctcgtcggtgcccatcgccacaggacgggcggaccgccgccatcacgtcacacggaatcgcgccgaaccacgcgcagctcgtcccggaatgccgtcgtccgacatcggccgcacacgccgctcgcgatgaccctcacgatccgactccctgcgcagagctgccaacgccgagcccaggcatcactgacctggcggaccaccccaacggccacggtcgagaacgccagccacgacactacggacaccaccagcgccaactccagcgaccaagcacgcgcctacgccacgacgccgatgcgaccacgtgcgatcggtgcgtgccgacctcgagttcacccacctcaccgaatgcccacagcagctgatcgcccgcaggagctggccacaccaccacgtgctgccggagccagtgtgacttgccgacgagaccaacccaccgttcctcaccgaccgtcgccccgcgctccagcaagcaggcacgccacagctcgcgaggccgctctctcggcacgcaccacccgcacgtcagcgcacgacccccgaggcaatcccgtgggcggctctcgtcgacgatcgagtgccagcatcgaggcacaccgaggcaatccacacaggtccccaaccagccgcccactcatacgtcgtcgcgcccgacccgcagtgtcgtcgaggaacgctcctcgctccacaacggtcgacgctccggtatcccggagcgtcgaggatactgtcccgcgagcggtgctaccttgcgcagcacagtgaagtgtggggggcccaccaccacttcagccacgacgagaccgagcctcgcgagctgctcgctggccgaccaacgccgtccagccccctcaggtggatcggagaccacgatgacgcctccaacgcgaacgaatccgctaccgatctcggcggtgaccggcggagctccgaatccacgagcgaccacggcgtcagcccgttcacgaatctccttcgaccttgcgagcacctcgccccgctcagcggcgattcgcacccgagccgaccagttcaaggctcgaaccgcctcggtgaggaacgccgcacgccgctggcgagcatcgaccagcagtccttccgatgcgggtagctcgagcgcgacgatcaggcccggtatgcctccgcccgatccaagatcgacccatcgctcggcaccgtagcgacgcacgagcgcagagaaggccctcgaatgttcgagggccttctctgtgggctcgcctacgagaccgagctcgtgggcccgatcaatccactgctcgaccggcagcatcgacggactcggcggccgatggtgctaccccgacacggaagatcacaacgtagcgatccggttcctcaccctctgaacgcgtcccgacaccgtcgatctcggccaccacgtcatggatcaccttccgatctgcggcgctcatcggctcgagcacgcgctcttcgccagtcgtcagtgcgacctctgcctgctctcgcgcgaagcgctcgagcgcgacccgccgtcgctcgcgatagccggcgacgtcgaccgccacccgtcccacaccctcgccggcgatggcctgcaacacactgcgcgtcagctcttgaatcgcgttcaggacactcgcccgtggccccacgaggaccccgagcccatcgccctcgatgtcgagactcatctcttcgtcatcgaggttgctgacgcgaacctcgcccgtcagcccgaactcctgcatgagcccggccaagaaggcctgtgctcgcgcggcaagctccacacgcgagaggggaggagttccctctgccgccggggcttcggccgtctgttgttcgtcgttcatcggagcatcctctgtttcgtctcgcctggtaccagccccgggccgcgcgtcaacggcccgatttcgtcgtccacgacgccgatcacgctttggcatcggaagcttcggccgaagacgagctcgaacccgtgcctctctccgtccgaacccgagaaaacttgctcgcccttcgtcgaggacctcgaactcgacctcggcgtcttccacgccgagcacatccagtgcttgctcacgtgcctcttcgacagttcgtcctgtcgtctcgatccaatccatgctctgactcctagcgattcgccggtcgccgttagcgacgacgccgaccacggcgacggcgatagctgttcttcgaaccctgctgcttgttcttcgctggccccggtggggtcgctggaccgtcggacccgccctcgaccgccgacggcaaccccttcttgccgccaaggaagccaaagataccgccacctgcgggagctgtcggactcgccgcaccgttaccgcgctgctctgcgacccgacgtctcgcctcgaccgagtgcgcacgaaggaccggatcacggcgccacatcacctcctgctgggcgacgcggaacaacccggaaaccaggaagtacacggcaacaccggcagggacatcgaggtagatgacaccgaagacgaccgttgtgagctgttgggtcagcagcgccgatcggttcgccgcggccgccgtgggattcttcgacgcaatctgctgaatctgcaggtactggataccgaccgcgatcagcaccagcacgtagtaggggagtgcgtgcacgaaaccgacgtgcagatgcaagggggtcagggccaggttgatccccacaaagtccatgtgcccgcggtcggccaccagattcttgtagagcttgctggcgtgtgagatgtacaacggcgctgcgacgatggcatgatgactcgtcaccgtgtgtgtcaggccacggatgacgtcgtacatcacgaacagcagcgggaactgcaacagcatcggcaagcaaccgccgagcggcgaaacgccctcctccttgaagagtcgctgctgcgcttcggcgagccccgcacggtccttgccgtactggcgctgcaactccttgagcttcggctgaatcgcttgcatctgcagcatcgaccgcgtggagcggatggtcagcggcgacagcgcgaccatcacggtcaccgtcagcagcgcgatcgcgatgccgtagctcgggatgatggcgtaccagaaggtcacgatccccgcgaggagctcgaacaacgggcggaagatctcgcccagaacacttgcgacgatcatgcgtgcgttacctttccggaccgtcgaggtggaacgggatcgtaccctgagcccccgaacgggttacagcgacccactcgtttagccgccaaccagcttcccctcgccaagccgtgcaactcgactgcctcgtacgcgtactgagagcagctcggcacgtagcgacacggcgatggacgaccacgccgtgcgacctggtaggcgcgaatgaggcccatgccggcccgacggggaagcgcacgtacgcgcgccacaaggctcacgggtcctcccgggggaactcgcctaggtgctccagcctagtgacatccgcacgaatggcggcaaaggaggcgtcgagcttcccttctctcggcccgatcaggtagctgccgggtgcgacagcgctgacgcgcaaggcctcgcgaacccggcgccgaaatcgattgcgctcgaccgccgtacctgctcggcgcggtatggcaaacgcgacacgaactgcggcgctctgctcgtcgcctgacacggtctccgtcggcgcgaccacgacccacatggtgccgagctgatagcgccgacccacgcgccggagacgatggaagtcctgccggcgggcaagccttccgagccgcacctacgccgacagccggtgacgccccttgaggcgccgagccttgagcaccgcacgaccggctctcgtcgacatccgcgcgcgaaaaccatgggtgcgcgcacgacgccgattgttgggctggaacgtccgcttcatcgcctgatcaccttccttgtcgagccccgcagtctaggagttcgaggagtcgaggccaacaccctgcgaggcgagcgaacgtgccctatgat

SEQ ID NO: 2 - DNA, 17 bp, synthetic construct
  misc_feature 1..17: note = Synthetic construct, Bact-338F1 primer
  source 1..17: mol_type = other DNA
cctacgggrggcagcag

SEQ ID NO: 3 - DNA, 18 bp, synthetic construct
  misc_feature 1..18: note = Synthetic construct, 909R primer
  source 1..18: mol_type = other DNA
ccgtcaattyhtttragt

SEQ ID NO: 4 - DNA, 20 bp, synthetic construct
  misc_feature 1..20: note = Synthetic construct, acd320f primer
  source 1..20: mol_type = other DNA
cggtccagactcctacggga

SEQ ID NO: 5 - DNA, 23 bp, synthetic construct
  misc_feature 1..23: note = Synthetic construct, 423r primer
  source 1..23: mol_type = other DNA
gacagggttttacagtccgaaga

SEQ ID NO: 6 - DNA, 20 bp, synthetic construct
  misc_feature 1..20: note = Synthetic construct, acm342f primer
  source 1..20: mol_type = other DNA
gcaatgggggaaaccctgac

SEQ ID NO: 7 - DNA, 20 bp, synthetic construct
  misc_feature 1..20: note = Synthetic construct, 439r primer
  source 1..20: mol_type = other DNA
accgtcaatttcgtccctgc

SEQ ID NO: 8 - DNA, 507 bp, unidentified
  misc_feature 1..507: note = FMO gene, ERCFMO_0001
  source 1..507: mol_type = unassigned DNA
ggtgactgggacttctggcttgactggaaagaccggcaatggtggccggtggtcacaccgattgtagggattacctactgcgcggccatcatgtattacctgtgggtgaactaccgcctgccctatggcgcaacgctttgcattgtctgccttttggtaggcgaatggctgacgcgtttctggggcttttactggtggtcgcactaccccatcaacttcgtatttccctccacgatgatacctggggcgctggtgatggacaccgtcatgctgctcacgcgcaactggatgatcaccgcgctgtttggcggcggagcatttgggttattgttctacccgggcaactggccgatttttggccccacccacctgccgctggttgctgaaggcgtgctgctgtcgttggccgactacaccggctttctgtatgtacgcacgggcacccctgagtacgtacggctgatcgaacaaggctcgcttagaacctttggcggtcacaccaccgtg

SEQ ID NO: 9 - DNA, 507 bp, unidentified
  misc_feature 1..507: note = FMO gene, ERCFMO_0002
  source 1..507: mol_type = unassigned DNA
ggtgactgggacttctggactgactggaaagaccgtcgtctgtgggtgactgttgcaccaatcgttgctgtaactttcccggcggcagtgcaagcttgcttgtggggccgttatcgtatgccttggggcgctactatgtgcgttctgggcttgttgttaggtgaatggatcaacagatatttcaacttctggggctggacatatttcccagttaacttctgcttcccttcacaattgattcctagcgctatcattttggacgttgtgttgttgctgtctaacagcttcaccttcaccgctatcgccggcgcgatgggctggggtctgattttctacccaagcaactggccagtaattggaccattgcacgtgccggtagaatataacggtatgatgatgactttggctgacttacaaggttaccactatgtaagaaccggtactcctgagtacatccgtatggttgaaaaaggtactttgagaacgttcggtaaagacgttgctccg

SEQ ID NO: 10 - DNA, 507 bp, unidentified
  misc_feature 1..507: note = FMO gene, ERCFMO_0003
  source 1..507: mol_type = unassigned DNA
ggggactgggacttctggtccgactggaaagaccgtcgtctgtgggtcaccgtcaccccgatcgtgctggtcaccttcccggcggccgtccaatacttcctgtgggaacggttccgtctgccgtggggcgccaccgtgtgcgtgctggccctgctgttcggcgaatgggtcaaccgctacttcaacttctggggctggacctacttcccggtgaacttcgtgttcccggcgattctgactccgggcgccatcctgctcgacaccgtgctgatgctgtcgggcagctacctgttcaccgccatcatcggcagcatggcctggggtctgattttctatccgggcaactggccgatcatcgcgccgatccacgtgccggtggaatacaacggcatgctcatgtcggtggcggacatccagggctacaactatgtccgtaccggtacccccgagtacatccgcatggttgaaaaaggcaccctgcgtaccttcggtaaagacgttgctccg

SEQ ID NO: 11 - DNA, 501 bp, unidentified
  misc_feature 1..501: note = FMO gene, ERCFMO_0004
  source 1..501: mol_type = unassigned DNA
tgggacttctggtccgactggaaagaccgccgtctgtgggtcaccgtgaccccgatcgtgttggtcaccttcccggcagccctccaggttctgctgtgggaacgcttccgtctgccgtggggcgcgaccctcgccatcctgtctctgctgtttcgcgaatgggtcaaccgatacttcaacttctggggctggacctacttcccggtgaacttcgtgttcccggctattctcattcccagtgcgatcctgctggacatcatgctgatgctgtccaacagcttcctggtcaccgctgtcgttggcggcctggcttggggtctgatgttctatcccggcaactggcccatcatcgctccactgcacgtgccggtcgaatacaacggcatgctgatgaccctcgccgaccttcaaggctaccactatgtacgaaccggtactcccgagtacatccgcatggttgaaaaaggcaccctgagaaccttcggtaaagacgttgctccg

SEQ ID NO: 12 - DNA, 510 bp, unidentified
  misc_feature 1..510: note = FMO gene, ERCFMO_0005
  source 1..510: mol_type = unassigned DNA
gactggcatgttcgaccaatcgttgctggcatcgaaccctgtacgctcgataccgactggaaagaccgtcgtctgtgggcaactgttgggacatgcgagcctgcaccatcgtggctgtactttccctgcagctgtgcaagcttgcttgtggggtcgttcaacttctggggctggacatatttcccagcttacttctgcttcccttcacaattgattccttgcgctatcgttcctcaccgtactggatgttgtgttgttgctgtcatgcagcttcaccttcagccagacgctcctacccgctatcgctggcgcaatgggctggggttcttgttttctacccaagcaactggccggttatcgcgccattgcacgtgccggttgaatataacggtactgatgatgactttggctgacttacaaggttaccactatgtaagaaccggtactcctgagtacatccgtatcgtcaagcgaagctccctacgatttagtgggaaagacgttgctccg

SEQ ID NO: 13 - DNA, 507 bp, unidentified
  misc_feature 1..507: note = FMO gene, ERCFMO_0006
  source 1..507: mol_type = unassigned DNA
ggggactgggacttctggtccgactggaaagaccgtcgtctgtgggtcaccgtcaccccgatcgtgctggtcaccctgcaggcggccgtccaatacttcctgtgggaacggttccgtctgccgtggggcgccaccgtgtgcgtgctggccctgctgttcggcgaatgggtccaccgctacttcaacttctggggctggacctacttcccggtgaacttcgtgttcgcggcgattctgactccgggcgccatcctgctcgacaccgtgctgatgctgtcgggcagctacctgttcaccgccatcatcggcagcatggcctggggtctgattttctatccgggcaactggccgatcatcgcgccgatccacgtgccggtggaatacaacggcatgctcatgtcggtggcggacatccagggctacaactatgtccgtaccggtacccccgagtacatccgcatggttgaaaaaggcaccctgcgtaccttcggtaaagacgttgctccg

SEQ ID NO: 14 - DNA, 506 bp, unidentified
  misc_feature 1..506: note = FMO gene, ERCFMO_0007
  source 1..506: mol_type = unassigned DNA
ggagactgggacttctgggttgactggaaggatcgtcgtatgtggccgacggtcgtgccgattctcggcgtgaccttctgcgccgcggcgcaggcgttctggtgggtgaacttccgtctgccgttcggcgcggtgttcgcggctcttggcctgctgattggcgagtggatcaaccgctacgtctacttctggggctggacctacttcccgatcaaccttgtgttcccgtctgcgttgatcgttccggcgatctggattgacgtgatcctgcttctgtcgggctcctatgtgatcacggcgattgttggttcgctcggctggggtctgttgttctaccccaaccactggccggcgattgccaagttccatcaggcgacggaacagcatggtcagcttatgacgcttgaggatctgatcggcttccacttcgtccgcacctcgatgccggaatatatccgcatggtccagcgcaccttccagccaccttcggtaaagacgttgctccg

SEQ ID NO: 15 - DNA, 506 bp, unidentified
  misc_feature 1..506: note = FMO gene, ERCFMO_0008
  source 1..506: mol_type = unassigned DNA
gactgggacttctggaccgactggaaagatagacgtctatgggttactgttgtgcctatagttggtattacttttcctgctgctgttcaagcttgcttgtggcggcgttaccgtttgccttacggcgcggtagtttgtgttttgggtctgcttttaggtgagtggatcaacagatacattaacttctggggttggacttatttcccagtaagtttctgcttcccttcacaactagtaccaggtgctatcgttcttgatgttgtgttaatgctgtcaaacagtatgacaattacagcagtaatcggcggtatggcatggggtctgttgttctatccaggcaactggccagttatagctccattacatgttcctgttgaatacaatggcatgatgatcgcactggctgatttacaaggttaccactacgtaagaactggtacacctgagtacatcagaatggttgaaaaaggtacattaagaacatttggtaaagacgttgctccgga

SEQ ID NO: 16 - DNA, 509 bp, unidentified
  misc_feature 1..509: note = FMO gene, ERCFMO_0009
  source 1..509: mol_type = unassigned DNA
ggtgactgggacttctggactgactggaaagatggacgtctatgggtaactgtagctccaatcgtttcaatcactttcccagcagctgttcaagctgttctgcggtggcgttaccgtttgcctttcggtgcggtagtttgtatcttaagtcttctgttaggtgagtggatcaacagatatatgaacttctggggttggacttatttcccagtgaatttctgtttcccttcaaacctgatgccaggtgctatcgttcttgacgttgtgttaatgctgacaaacagcatgacaattacagcggtaattggtggtatggcttatggtttgttgttctatccaggcaactggccaatcatggctccattacatgttcctgttgaatacaatggcatgatgatgactcttgctgatttacaaggttaccactacacaagaactggtacacctgagtacatcataatggttgaaaaaggtacattaagaacttttggtaaagacgttgctccgga

SEQ ID NO: 17 - DNA, 467 bp, unidentified
  misc_feature 1..467: note = FMO gene, ERCFMO_0010
  source 1..467: mol_type = unassigned DNA
ggtgactgggatttttggaccgactggaaagatagacgtctatgggtaaccgtagctcctatcgtttctattacattccctgcggctgttcaagcttgcttgtggtggagataccgtttgccagttggcgcaactttgtctgttgttgctctgatgattggtgagtggatcaaccgttatatgaacttctggggctggacatacttcccagttaacatttgcttcccatctaacctgttgccaggtgccattgttcttgacgttatcctgatgttgggtaacagcatgactctgacagctgttgttggtggtttggcttatggcctgttgttctacccaggtaactggcctgttatcgctccattgcacgtgcctgtagaatacaacggcatgatgatgactttggctgacttacaaggttaccactatgttcgtacaggtacacctgagtacatccgtatggtaga

SEQ ID NO: 18 - DNA, 506 bp, unidentified
  misc_feature 1..506: note = FMO gene, ERCFMO_0011
  source 1..506: mol_type = unassigned DNA
gactggcatgttcgaccaatcgttgctggcatcgaaccctgtacgctcgataccgactggaaagaccgtcgtctgtgggcaactgttgggacatgcgagcctgcaccaccgtcgctgtactttccctgcagctgtgcaagcttgcttgtggggtcgttcaacttctggggctggacatatttcccagcttacttctgcttcccttcacaattgattccttgcgctatcgttcctcaccgtactggatgttgtgttgttgctgtcttacagcttcaccttcagccagacgctcctacccgctatcgctggcgcaatgggctggggttcttgttttctacccaagcaactggccggttatcgcgccattgcacgtgccggttgaatataacggtatcactgtcgctttggctgacttacaaggttaccactatgtatgaaccggtactcctgagtacatccgtatcgtcaagcgaacctcccgaagaagtgggaaagacgttgctccg

SEQ ID NO: 19 - DNA, 508 bp, unidentified
  misc_feature 1..508: note = FMO gene, ERCFMO_0012
  source 1..508: mol_type = unassigned DNA
cgagactgggactcctggaccgactggaaagatagacgtctatgggtaaccgtagcacctatcgtttctattacattccctgcggctgttcaagcttgcttgtggtggagataccgtttaccagttggtgcaacactttcagttgttgctctgatgattggtgagtggatcaacagatatatgaacttctggggctggacatacttcccagttaatatctgcttcccatcaaacttactgccaggtgctatcgtactggacgttatcctgatgttgggtaacagcatgactctgaccgctgttgttggtggtttggcttatggcttgttgttctacccaggtaactggcctgtaatcgcgccattgcacgtgcctgtagaatataacggcatgatgatgactttggctgacttacaaggttaccactatgttcgtaccggtacacctcggtacattcgtatggtagagaaaggtacattaagaactttcggtaaagacgttgcgccgg

SEQ ID NO: 20 - DNA, 468 bp, unidentified
  misc_feature 1..468: note = FMO gene, ERCFMO_0013
  source 1..468: mol_type = unassigned DNA
gactggaaagatagacgtctatgggtaactgtagctccaatcgtttcaattactttccctgcagctgttcaagctgtgttgtggtggcgttaccgtttgccttttggcgcggtagtttgtatcttaggtctgctcttaggtgagtgggtcaacagatatttgaatttctggggttggacttatttcccagtaaatttctgcttcccttcaaacttgatgccaggtgctattgttcttgacgttgtgttaatgctgtcaggaagtatgacagttacagcggtaatcggtggtatggcatggggtctgttgttctatccaggcaactggcctgttatggcaccattacatgttcctgttgaatacaatggcatgatgatgacacttgctgatttacaaggttaccactatgttagaactggtacacctgaatacatcagaatggttgaaaaaggtacactgagaactttc

SEQ ID NO: 21 - DNA, 387 bp, unidentified
  misc_feature 1..387: note = FMO gene, ERCFMO_0014
  source 1..387: mol_type = unassigned DNA
acgttgacgccgatcctgatgatcaccttccctgcggcgacgcaatatttcatgtgggagaagatgcggcttccgatcggcgccaccttttgcgtgatgacggttcacttcggccaatggatgaatcgggtctttaacttctacatgtgggcctggttcccggtcaactttaccacccctggtttgctgatacccagcgcaatcttcctggacgtggtgttgatgatgacaggaagctacatgtttacggcgctgttcggcggcatggggtggtccctgttgttctatccgtccaactggacctggcttgccccgtttcacttggctgtgaagcatccaagcggaccgctcatgtcgatcgctgatttgatggggatgggtatgtgc

SEQ ID NO: 22 - DNA, 508 bp, unidentified
  misc_feature 1..508: note = FMO gene, ERCFMO_0015
  source 1..508: mol_type = unassigned DNA
actggcatgttcgaccaatcgttgctggcatcgaaccctgtacgctcgataccgactggaaagaccgtcgtctgtgggcaactgttgggacatgcgagcctgcaccaccgtcgctgtactttccctgcagctgtgcaagcttgcttgtggggtcgttcaacttctggggctggacatatttcccagcttacttctgcttcccttcacaatcaattccttgcgctatcgttcctcaccgtactggatgttgtgttgttgctgtctaacagcttcaccttcagccagacgctcctacccgctatcgctggcgcaatgggctggggttctgattttctacccaagcaactggccggttatcgcgccattgcacgtgccggtagaataatgcggtatgatgatgactttggctaccttacaaggttaccactatgtaagaaccggtactccatggtacatccgtatcgtcaagcgaacctccctgagaagaagtgggaaagacgttgctccg

SEQ ID NO: 23 - DNA, 508 bp, unidentified
  misc_feature 1..508: note = FMO gene, ERCFMO_0016
  source 1..508: mol_type = unassigned DNA
tgggacttctggcttgactggaaggacagggaattttggccaacctttaccccggtgctgttgatcacctttccggcggccgttcaatacgtgctctggacctacttccgtctgcctatcggcgccaccctttgctgtcttggactgctcatcggcgaatggatcgtcaggatccacggctttcacatctgggcgtggttcccgtttacgctgatttggccggcgaccatgttgccgggcgccatcgcactcgatctggtcctaatgctcagcggcaatttcattatgaccggcatattcggcggtatgcttttcgcactgctgttctatcccggaaactggccgatgttggctgcgtaccgtttaccgcttgagcacattggatcgcttctcacggtcggagatctgatcggctacgtctatccgcgcagcagcatgccggaatatctgcgcatcattgagcggggtaccctgcgcacctttggtggtcattccgcggtggttgctg

SEQ ID NO: 24 - DNA, 509 bp, unidentified
  misc_feature 1..509: note = FMO gene, ERCFMO_0017
  source 1..509: mol_type = unassigned DNA
gactggcatgttcgaccaatcgttgctggcatcgaaccctgtacgctcgataccgactggaaagaccgtcgtctgtgggcaactgttgggacatgcgagcctgcaccatcgtggctgtactttccctgcagctgtgcgaatggcatgcgcggtcgttcaacttctgcggctggacatatttcccagcttacttctgcttcccttcacaattcattccttgcgctatcgttcctcaccgtactggatgttgtgttgttgctgtctaacagcttcaccttcagccagacgctcctacccgctatcgctggcgcaatgggctggggttctcattttctacccaagcaactggccggttatcgcgccattgcacgtgccggtagaataatgcggtatgaatcgtccctttggctgacttacaaggttaccactatgccggaaccggtactcctcagtacatccgtatcgtcaagcgaagctccctacgatcaagtgggaaagacgttgctccg

SEQ ID NO: 25 - DNA, 507 bp, unidentified
  misc_feature 1..507: note = FMO gene, ERCFMO_0018
  source 1..507: mol_type = unassigned DNA
gccgactgggacttctggaccgactggaaagatagacgtctgtgggtaaccgtagcacctatcgtttctattacattccctgcggctgttcaagcttgcttgtggtggagataccgtctgccaatcggcgcaaccgtttctgttgttgctctgatgctgggcgagtggatcaaccgttacatgaacttctggggttggacatacttcccagtaaacatttgcttcccatctaacttgctgccaggcgctatcgttctggacgtggttctgatgctgggcaatagcatgactctgaccgctgttgttggtggtttggcttatggtttgctgttctacccaggcaactggcctatcattgctcctctgcacgttcctgttgaatacaacggcatgatgatgactctggctgacttgcaaggttaccactatgttcgtaccggtacacctgagtacatccgtatggtagagaagggtactttgagaactttcggtaaagacgttgctccg

SEQ ID NO: 26 - DNA, 507 bp, unidentified
  misc_feature 1..507: note = FMO gene, ERCFMO_0019
  source 1..507: mol_type = unassigned DNA
ggcgactgggacttctggtcggactggaaagaccgtcgactgtgggtcacggtgaccccgatggtactggtcaccttcccggcggccgtacaatcctacttgtggaaccggtatcgtctgccttggggagccaccgtgtgcgtcctgggtctgctgctgggcgagtggatcaaccgttatttcaacttctggggctggacctacttcccgatcaacttcgtgttccctgcctcgctggtgccgggcgccatcatcctggacaccgtgctgatgctgtcgggcagctacctgttcaccgcgatcgtcggtgcgatgggctggggtctgatcttctacccgggcaactggccgatcatcgcgccgctgcacgtgccggtggaatacaacggcatgctgatgtcgatcgccgacatccagggttacaactatgtgcgtacgggtacgcctgagtacatccgcatggtagagaagggcaccctgcgtaccttcggtaaggacgttgctccg

SEQ ID NO: 27 - DNA, 468 bp, unidentified
  misc_feature 1..468: note = FMO gene, ERCFMO_0020
  source 1..468: mol_type = unassigned DNA
gactgggacttctgggcggaccggaaggaccggcgtttatgggtgacggtttatccgattgtgatgatcacgtttcctgcggcggtgcaggcggtgatttgggagcgtatgcggttgccctggggggcgacggtatgcattttaggcatcctgtttgaggagtgggttaaccgctacttcaacttctggatgtggacatatttccccattaactttgtatctccgacggcggcggttcacatggcgatctctttagacgttgtgttgatgcagtctgggagcttcttgtctacggcggtgattggtgggttaggctgggggctattgatgtatcctggcaactggtcgatcattgcgcccttgcccgtaccggtggaatacaatggcatgctgatgtcgattgccgacattcatgggtaccaatatgtgcgtacgggcgcgtctgggtacattcggatggtagatgac

SEQ ID NO: 28 - DNA, 514 bp, unidentified
  misc_feature 1..514: note = FMO gene, ERCFMO_0021
  source 1..514: mol_type = unassigned DNA
ggggactgggacttctggctggactggaaagaccgtcaatggtggcctgtggtgacccccatcgtaggcatcgcctactgtgctgccatcatgtactacctatgggtgaactaccggctgccctatggcgccaccttatgtatcgtctgtctcttggtaggcgaatggctgacgcgtttctggggattttactggtggtcgcactaccccatcaacttcgtctttccctccaccatgataccgggcgcgctggtcatggacaccgtcctgctgctcacccgcaactggatgatcaccgcactgattggaggcggcgcatttggcctgctgttctacccgggcaactggcccatctttggcccgacccacctgccgctggtagccgaaggcgtattgctgtcggtcgccgactacaccggctttttgtatgtacgcaccggcacgcctgagtacgtgcgcctgatcgaacaaggctcgctacgaaccttcgggggccacaccaccgcgattggcg

SEQ ID NO: 29 - protein, 169 aa, unidentified
  REGION 1..169: note = MISC_FEATURE - FMO enzyme, ERCFMO_0001
GDWDFWLDWKDRQWWPVVTPIVGITYCAAIMYYLWVNYRLPYGATLCIVCLLVGEWLTRFWGFYWWSHYPINFVFPSTMIPGALVMDTVMLLTRNWMITALFGGGAFGLLFYPGNWPIFGPTHLPLVAEGVLLSLADYTGFLYVRTGTPEYVRLIEQGSLRTFGGHTTV

SEQ ID NO: 30 - protein, 169 aa, unidentified
  REGION 1..169: note = MISC_FEATURE - FMO enzyme, ERCFMO_0002
GDWDFWTDWKDRRLWVTVAPIVAVTFPAAVQACLWGRYRMPWGATMCVLGLLLGEWINRYFNFWGWTYFPVNFCFPSQLIPSAIILDVVLLLSNSFTFTAIAGAMGWGLIFYPSNWPVIGPLHVPVEYNGMMMTLADLQGYHYVRTGTPEYIRMVEKGTLRTFGKDVAP

SEQ ID NO: 31 - protein, 169 aa, unidentified
  REGION 1..169: note = MISC_FEATURE - FMO enzyme, ERCFMO_0003
GDWDFWSDWKDRRLWVTVTPIVLVTFPAAVQYFLWERFRLPWGATVCVLALLFGEWVNRYFNFWGWTYFPVNFVFPAILTPGAILLDTVLMLSGSYLFTAIIGSMAWGLIFYPGNWPIIAPIHVPVEYNGMLMSVADIQGYNYVRTGTPEYIRMVEKGTLRTFGKDVAP

SEQ ID NO: 32 - protein, 167 aa, unidentified
  REGION 1..167: note = MISC_FEATURE - FMO enzyme, ERCFMO_0004
WDFWSDWKDRRLWVTVTPIVLVTFPAALQVLLWERFRLPWGATLAILSLLFREWVNRYFNFWGWTYFPVNFVFPAILIPSAILLDIMLMLSNSFLVTAVVGGLAWGLMFYPGNWPIIAPLHVPVEYNGMLMTLADLQGYHYVRTGTPEYIRMVEKGTLRTFGKDVAP

SEQ ID NO: 33 - protein, 170 aa, unidentified
  REGION 1..170: note = MISC_FEATURE - FMO enzyme, ERCFMO_0005
DWHVRPIVAGIEPCTLDTDWKDRRLWATVGTCEPAPSWLYFPCSCASLLVGSFNFWGWTYFPAYFCFPSQLIPCAIVPHRTGCCVVAVMQLHLQPDAPTRYRWRNGLGFLFSTQATGRLSRHCTCRLNITVLMMTLADLQGYHYVRTGTPEYIRIVKRSSLRFSGKDVAP

SEQ ID NO: 34 - protein, 169 aa, unidentified
  REGION 1..169: note = MISC_FEATURE - FMO enzyme, ERCFMO_0006
GDWDFWSDWKDRRLWVTVTPIVLVTLQAAVQYFLWERFRLPWGATVCVLALLFGEWVHRYFNFWGWTYFPVNFVFAAILTPGAILLDTVLMLSGSYLFTAIIGSMAWGLIFYPGNWPIIAPIHVPVEYNGMLMSVADIQGYNYVRTGTPEYIRMVEKGTLRTFGKDVAP

SEQ ID NO: 35 - protein, 168 aa, unidentified
  REGION 1..168: note = MISC_FEATURE - FMO enzyme, ERCFMO_0007
GDWDFWVDWKDRRMWPTVVPILGVTFCAAAQAFWWVNFRLPFGAVFAALGLLIGEWINRYVYFWGWTYFPINLVFPSALIVPAIWIDVILLLSGSYVITAIVGSLGWGLLFYPNHWPAIAKFHQATEQHGQLMTLEDLIGFHFVRTSMPEYIRMVQRTFQPPSVKTLL

SEQ ID NO: 36 - protein, 168 aa, unidentified
  REGION 1..168: note = MISC_FEATURE - FMO enzyme, ERCFMO_0008
DWDFWTDWKDRRLWVTVVPIVGITFPAAVQACLWRRYRLPYGAVVCVLGLLLGEWINRYINFWGWTYFPVSFCFPSQLVPGAIVLDVVLMLSNSMTITAVIGGMAWGLLFYPGNWPVIAPLHVPVEYNGMMIALADLQGYHYVRTGTPEYIRMVEKGTLRTFGKDVAP

SEQ ID NO: 37 - protein, 169 aa, unidentified
  REGION 1..169: note = MISC_FEATURE - FMO enzyme, ERCFMO_0009
GDWDFWTDWKDGRLWVTVAPIVSITFPAAVQAVLRWRYRLPFGAVVCILSLLLGEWINRYMNFWGWTYFPVNFCFPSNLMPGAIVLDVVLMLTNSMTITAVIGGMAYGLLFYPGNWPIMAPLHVPVEYNGMMMTLADLQGYHYTRTGTPEYIIMVEKGTLRTFGKDVAP

SEQ ID NO: 38 - protein, 155 aa, unidentified
  REGION 1..155: note = MISC_FEATURE - FMO enzyme, ERCFMO_0010
GDWDFWTDWKDRRLWVTVAPIVSITFPAAVQACLWWRYRLPVGATLSVVALMIGEWINRYMNFWGWTYFPVNICFPSNLLPGAIVLDVILMLGNSMTLTAVVGGLAYGLLFYPGNWPVIAPLHVPVEYNGMMMTLADLQGYHYVRTGTPEYIRMV

SEQ ID NO: 39 - protein, 168 aa, unidentified
  REGION 1..168: note = MISC_FEATURE - FMO enzyme, ERCFMO_0011
DWHVRPIVAGIEPCTLDTDWKDRRLWATVGTCEPAPPSLYFPCSCASLLVGSFNFWGWTYFPAYFCFPSQLIPCAIVPHRTGCCVVAVLQLHLQPDAPTRYRWRNGLGFLFSTQATGRLSRHCTCRLNITVSLSLWLTYKVTTMYEPVLLSTSVSSSEPPEEVGKTLL

SEQ ID NO: 40 - protein, 169 aa, unidentified
  REGION 1..169: note = MISC_FEATURE - FMO enzyme, ERCFMO_0012
RDWDSWTDWKDRRLWVTVAPIVSITFPAAVQACLWWRYRLPVGATLSVVALMIGEWINRYMNFWGWTYFPVNICFPSNLLPGAIVLDVILMLGNSMTLTAVVGGLAYGLLFYPGNWPVIAPLHVPVEYNGMMMTLADLQGYHYVRTGTPRYIRMVEKGTLRTFGKDVAP

SEQ ID NO: 41 - protein, 156 aa, unidentified
  REGION 1..156: note = MISC_FEATURE - FMO enzyme,ERCFMO_0013
DWKDRRLWVTVAPIVSITFPAAVQAVLWWRYRLPFGAVVCILGLLLGEWVNRYLNFWGWTYFPVNFCFPSNLMPGAIVLDVVLMLSGSMTVTAVIGGMAWGLLFYPGNWPVMAPLHVPVEYNGMMMTLADLQGYHYVRTGTPEYIRMVEKGTLRTF

SEQ ID NO: 42 - protein, 129 aa, unidentified
  REGION 1..129: note = MISC_FEATURE - FMO enzyme, ERCFMO_0014
TLTPILMITFPAATQYFMWEKMRLPIGATFCVMTVHFGQWMNRVFNFYMWAWFPVNFTTPGLLIPSAIFLDVVLMMTGSYMFTALFGGMGWSLLFYPSNWTWLAPFHLAVKHPSGPLMSIADLMGMGMC

SEQ ID NO: 43 - protein, 169 aa, unidentified
  REGION 1..169: note = MISC_FEATURE - FMO enzyme, ERCFMO_0015
TGMFDQSLLASNPVRSIPTGKTVVCGQLLGHASLHHRRCTFPAAVQACLWGRSTSGAGHISQLTSASLHNQFLALSFLTVLDVVLLLSNSFTFSQTLLPAIAGAMGWGSDFLPKQLAGYRAIARAGRIMRYDDDFGYLTRLPLCKNRYSMVHPYRQANLPEKKWERRCS

SEQ ID NO: 44 - protein, 169 aa, unidentified
  REGION 1..169: note = MISC_FEATURE - FMO enzyme, ERCFMO_0016
WDFWLDWKDREFWPTFTPVLLITFPAAVQYVLWTYFRLPIGATLCCLGLLIGEWIVRIHGFHIWAWFPFTLIWPATMLPGAIALDLVLMLSGNFIMTGIFGGMLFALLFYPGNWPMLAAYRLPLEHIGSLLTVGDLIGYVYPRSSMPEYLRIIERGTLRTFGGHSAVVA

SEQ ID NO: 45 - protein, 169 aa, unidentified
  REGION 1..169: note = MISC_FEATURE - FMO enzyme, ERCFMO_0017
DWHVRPIVAGIEPCTLDTDWKDRRLWATVGTCEPAPSWLYFPCSCANGMRGRSTSAAGHISQLTSASLHNSFLALSFLTVLDVVLLLSNSFTFSQTLLPAIAGAMGWGSHFLPKQLAGYRAIARAGRIMRYESSLWLTYKVTTMPEPVLLSTSVSSSEAPYDQVGKTLL

SEQ ID NO: 46 - protein, 169 aa, unidentified
  REGION 1..169: note = MISC_FEATURE - FMO enzyme, ERCFMO_0018
ADWDFWTDWKDRRLWVTVAPIVSITFPAAVQACLWWRYRLPIGATVSVVALMLGEWINRYMNFWGWTYFPVNICFPSNLLPGAIVLDVVLMLGNSMTLTAVVGGLAYGLLFYPGNWPIIAPLHVPVEYNGMMMTLADLQGYHYVRTGTPEYIRMVEKGTLRTFGKDVAP

SEQ ID NO: 47 - protein, 169 aa, unidentified
  REGION 1..169: note = MISC_FEATURE - FMO enzyme, ERCFMO_0019
GDWDFWSDWKDRRLWVTVTPMVLVTFPAAVQSYLWNRYRLPWGATVCVLGLLLGEWINRYFNFWGWTYFPINFVFPASLVPGAIILDTVLMLSGSYLFTAIVGAMGWGLIFYPGNWPIIAPLHVPVEYNGMLMSIADIQGYNYVRTGTPEYIRMVEKGTLRTFGKDVAP

SEQ ID NO: 48 - protein, 156 aa, unidentified
  REGION 1..156: note = MISC_FEATURE - FMO enzyme, ERCFMO_0020
DWDFWADRKDRRLWVTVYPIVMITFPAAVQAVIWERMRLPWGATVCILGILFEEWVNRYFNFWMWTYFPINFVSPTAAVHMAISLDVVLMQSGSFLSTAVIGGLGWGLLMYPGNWSIIAPLPVPVEYNGMLMSIADIHGYQYVRTGASGYIRMVDD

SEQ ID NO: 49 - protein, 171 aa, unidentified
  REGION 1..171: note = MISC_FEATURE - FMO enzyme, ERCFMO_0021
GDWDFWLDWKDRQWWPVVTPIVGIAYCAAIMYYLWVNYRLPYGATLCIVCLLVGEWLTRFWGFYWWSHYPINFVFPSTMIPGALVMDTVLLLTRNWMITALIGGGAFGLLFYPGNWPIFGPTHLPLVAEGVLLSVADYTGFLYVRTGTPEYVRLIEQGSLRTFGGHTTAIG

The invention claimed is:

1. A medium comprising:

an electron donor;

an electron acceptor comprising iron particles having a polymeric coating; and a Feammox bacterium and/or one or more enzymes capable of oxidizing the electron donor coupled with reduction of Fe(III) of the iron particles to Fe(II).

2. The medium of claim 1, wherein the electron donor comprises ammonium or an ammonium containing compound.

3. The medium of claim 1, wherein the electron donor comprises molecular hydrogen.

4. The medium of claim 1, wherein the electron donor comprises a mixture of $H_2$ and ammonium.

5. The medium of claim 1, wherein the polymer of the polymeric coating comprises one or more negatively charged moieties.

6. The medium of claim 5, wherein the one or more negatively charged moieties are pendant to the polymer backbone.

7. The medium of claim 5, wherein the one or more negatively charged moieties are selected from the group consisting of carboxylate, sulfonate, and phosphonate.

8. The medium of claim 5, wherein the one or more negatively charged moieties have a pKa of 4 to 6.

9. The medium of claim 1, wherein polymer of the polymeric coating comprises polyacrylate.

10. The medium of claim 1, wherein polymer of the polymeric coating comprises polysulfonic acid or polyphosphonic acid.

11. The medium of claim 1, wherein polymer of the polymeric coating has a weight average molecular weight of 2,000 Da to 500,000 Da.

12. The medium of claim 11 having a pH of 4 to 7.

13. The medium of claim 1, wherein the polymeric coating exhibits porosity.

14. The medium of claim 1, wherein the iron particles comprise ferrihydrite, iron oxide, elemental iron, a goethite, a nontronite, an iron-rich clay, or mixtures thereof.

15. The medium of claim 1, wherein the medium is aqueous-based.

16. The medium of claim 1 further comprising an oxidant operable to oxidize the Fe(II) to Fe(III).

17. The medium of claim 1 further comprising a fluorochemical component, and the Feammox bacterium and/or one or more enzymes exhibit reductive dehalogenase activity capable of fluorochemical degradation in conjunction with oxidation of the electron donor and electron transfer to the electron acceptor.

18. The medium of claim 17, wherein the fluorochemical component comprises one or more fluorochemicals.

19. The medium of claim 18, wherein the fluorochemical component comprises fluoroalkyl compounds of perfluoroalkyl compounds.

20. The medium of claim 17, wherein the medium is soil, sludge, sorbent or solid contaminated with the fluorochemical component.

21. The medium of claim 1, wherein the Feammox bacterium is an Acidimicrobiaceae bacterium.

22. A system comprising:

a reactor, the reactor including one or more containers comprising a medium including an electron donor, an electron acceptor comprising iron particles having a polymeric coating, and a Feammox bacterium and/or one or more enzymes capable of oxidizing the electron donor coupled with reduction of Fe(III) of the iron particles to Fe(II).

23. The system of claim 22, wherein the medium further comprises a fluorochemical component, and the Feammox bacterium and/or one or more enzymes exhibit reductive dehalogenase activity capable of fluorochemical degradation in conjunction with oxidation of the electron donor and electron transfer to the electron acceptor.

24. A method of environmental remediation comprising:

providing a medium including an electron donor and a fluorochemical component;

disposing a Feammox bacterium and/or one or more enzymes exhibiting reductive dehalogenase activity in the medium;

degrading the fluorochemical component with the Feammox bacterium and/or enzymes in conjunction with oxidation of the electron donor and electron transfer to an electron acceptor comprising iron particles, wherein electron transfer to the iron particles is enhanced by providing the iron particles a polymeric coating.

25. The method of claim 24, wherein the electron donor comprises ammonium or an ammonium containing compound.

26. The method of claim 24, wherein the electron donor comprises molecular hydrogen.

27. The method of claim 24, wherein the polymer of the polymeric coating comprises one or more negatively charged moieties.

28. The method of claim 27, wherein the one or more negatively charged moieties are selected from the group consisting of carboxylate, sulfonate, and phosphonate.

29. The method of claim 24, wherein the medium has a pH of 4 to 7.

30. A method of ammonium oxidation comprising:

providing a medium including an electron donor comprising ammonium or an ammonium containing compound, an electron acceptor comprising iron particles, and a Feammox bacterium and/or one or more enzymes;

oxidizing the ammonium or ammonium containing compound with the Feammox bacterium and/or one or more enzymes coupled with reduction of Fe(III) of the iron particles to Fe(II), wherein electron transfer to the Fe(III) is enhanced by providing the iron particles a polymeric coating.

* * * * *